US007892730B2

(12) United States Patent
Morris et al.

(10) Patent No.: US 7,892,730 B2
(45) Date of Patent: Feb. 22, 2011

(54) COMPOSITIONS AND METHODS FOR CANCER

(75) Inventors: David W. Morris, Davis, CA (US); Eric K. Engelhard, Davis, CA (US)

(73) Assignee: Sagres Discovery, Inc., Emeryville, CA (US)

( * ) Notice: Subject to any disclaimer, the term of this patent is extended or adjusted under 35 U.S.C. 154(b) by 2350 days.

(21) Appl. No.: 10/087,192

(22) Filed: Mar. 1, 2002

(65) Prior Publication Data

US 2002/0182586 A1 Dec. 5, 2002

Related U.S. Application Data

(63) Continuation of application No. 09/747,377, filed on Dec. 22, 2000, now abandoned, and a continuation of application No. 09/798,586, filed on Mar. 2, 2001, now abandoned.

(51) Int. Cl.
C12Q 1/00 (2006.01)
C12Q 1/68 (2006.01)
G01N 1/00 (2006.01)
G01N 33/48 (2006.01)
G01N 33/53 (2006.01)
G01N 33/567 (2006.01)
G01N 33/574 (2006.01)

(52) U.S. Cl. .................. 435/6; 435/4; 435/7.1; 435/7.21; 435/7.23; 436/63; 436/64; 436/174

(58) Field of Classification Search ............ 435/4, 435/6, 7.1, 7.21, 7.23; 436/63, 64, 174
See application file for complete search history.

(56) References Cited

U.S. PATENT DOCUMENTS

| | | | |
|---|---|---|---|
| 4,179,337 A | 12/1979 | Davis et al. | |
| 4,301,144 A | 11/1981 | Iwashita et al. | |
| 4,469,863 A | 9/1984 | Ts'o et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,816,567 A | 3/1989 | Cabilly et al. | |
| 5,034,506 A | 7/1991 | Summerton et al. | |
| 5,124,246 A | 6/1992 | Urdea et al. | |
| 5,216,141 A | 6/1993 | Benner | |
| 5,235,033 A | 8/1993 | Summerton et al. | |
| 5,359,100 A | 10/1994 | Urdea et al. | |
| 5,360,733 A | 11/1994 | Fukuda et al. | |
| 5,386,023 A | 1/1995 | Sanghvi et al. | |
| 5,445,934 A | 8/1995 | Fodor et al. | |
| 5,545,730 A | 8/1996 | Urdea et al. | |
| 5,545,806 A | 8/1996 | Lonberg et al. | |
| 5,545,807 A | 8/1996 | Surani et al. | |
| 5,569,825 A | 10/1996 | Lonberg et al. | |
| 5,571,670 A | 11/1996 | Urdea et al. | |
| 5,580,731 A | 12/1996 | Chang et al. | |
| 5,591,584 A | 1/1997 | Chang et al. | |
| 5,594,117 A | 1/1997 | Urdea et al. | |
| 5,594,118 A | 1/1997 | Urdea et al. | |
| 5,597,909 A | 1/1997 | Urdea et al. | |
| 5,602,240 A | 2/1997 | De Mesmaeker et al. | |
| 5,624,802 A | 4/1997 | Urdea et al. | |
| 5,625,126 A | 4/1997 | Lonberg et al. | |
| 5,633,425 A | 5/1997 | Lonberg et al. | |
| 5,635,352 A | 6/1997 | Urdea et al. | |
| 5,637,684 A | 6/1997 | Cook et al. | |
| 5,644,048 A | 7/1997 | Yau | |
| 5,661,016 A | 8/1997 | Lonberg et al. | |
| 5,681,697 A | 10/1997 | Urdea et al. | |
| 5,681,702 A | 10/1997 | Collins et al. | |
| 5,700,637 A | 12/1997 | Southern | |
| 5,759,776 A | 6/1998 | Smith et al. | |
| 5,776,683 A | 7/1998 | Smith et al. | |
| 5,928,870 A | 7/1999 | Lapidus et al. | |
| 6,074,825 A | 6/2000 | Rundell et al. | |
| 6,153,441 A | 11/2000 | Appelbaum et al. | |

FOREIGN PATENT DOCUMENTS

| | | |
|---|---|---|
| WO | WO 87/05330 | 9/1987 |
| WO | WO 90/10448 | 9/1990 |
| WO | WO 91/04753 | 4/1991 |
| WO | WO 93/22443 | 11/1993 |
| WO | WO 95/25116 | 9/1995 |
| WO | WO 95/28490 | 10/1995 |
| WO | WO 95/35505 | 12/1995 |

(Continued)

OTHER PUBLICATIONS

Topalovski et al. Lymphoma of the breast. A clinicopathologic study of primary and secondary cases. Arch. Pathol. Lab Med. 123: 1208-1218, Dec. 1999.*

(Continued)

Primary Examiner—Alana M. Harris
(74) Attorney, Agent, or Firm—David A. Carpenter; Astrid Spain

(57) ABSTRACT

The present invention relates to novel sequences for use in diagnosis and treatment of carcinomas, especially lymphoma carcinomas. In addition, the present invention describes the use of novel compositions for use in screening methods.

19 Claims, No Drawings

FOREIGN PATENT DOCUMENTS

| | | |
|---|---|---|
| WO | WO 97/27212 | 7/1997 |
| WO | WO 97/27213 | 7/1997 |
| WO | WO 01/57182 | 8/2001 |
| WO | WO 01/94629 | 12/2001 |
| WO | WO 02/22660 | 3/2002 |
| WO | WO 03/008583 | 1/2003 |

OTHER PUBLICATIONS

Aguilera et al. T-cell lymphoma presenting in the breast: a histologic, immunophenotypic and molecular genetic study of four cases. Mod. Pathol. 13(6): 599-604, 2000.*

Database GeneCore Accession No. U78076, created on May 14, 1999, last visited on Oct. 24, 2004. Lee et al. "Cloning of Mouse Sepiapterin Reductase Gene and Characterization of its promoter Region," Gene Sequence, *Biochim Biophys Acta* (1999). vol. 1445, No. 1 pp. 165-171. MPSRCH Search Report 2004, 1 page.

International Search Report mailed on Nov. 10, 2004 for PCT patent application No. PCT/US02/41414 filed Dec. 26, 2002, 8 pages.

Allen, J. D. and Berns, A. (1996). "Complementation Tagging of Cooperating Oncogenes in Knockout Mice," *Cancer Biology* 7:299-306.

Altschul, S. F. and Gish, W. (1996). "Local Alignment Statistics" In *Methods in Enzymology* vol. 266, Academic Press, Inc., pp. 460-480.

Altschul, S. F. et al. (1990). "Basic Local Alignment Search Tool," *J. Mol. Biol.* 215:403-410.

Aplin, J. D. and Wriston, Jr., J. C. (1981). "Preparation, Properties, and Applications of Carbohydrate Conjugates of Proteins and Lipids," *CRC Crit. Rev. Biochem.* pp. 259-306.

Arenberg, D. A. et al. (2001). "The Murine CC Chemokine, 6C-Kine, Inhibits Tumor Growth and Angiogenesis in a Human Lung Cancer SCID Mouse Model," *Cancer Immunol. Immunother.* 49:587-592.

Ausubel, F. M. et al., eds. (1992). *Short Protocols in Molecular Biology*. Greene Publishing Associates and John Wiley & Sons, pp. iii-xviii (Table of Contents Only).

Bai, J. et al. (1999). "Sequence Comparison of JSRV with Endogenous Proviruses: Envelope Genotypes and a Novel ORF With Similarity to a G-Protein-Coupled Receptor," *Virology* 258:333-343.

Beaucage, S. L. and Iyer, R. P. (1993). "The Functionalization of Oligonucleotides Via Phosphoramidite Derivatives," *Tetrahedron* 49(10):1925-1963.

Boener, P. et al. (1991). "Production of Antigen-Specific Human Monoclonal Antibodies from in Vitro-Primed Human Splenocytes," *J. Immunol.* 147(1):86-95.

Bolli. M. et al. (1994). "α-Bicyclo-DNA: Synthesis, Characterization, and Pairing Properties of α-DNA-Analogues with Restricted Conformational Flexibility in the Sugar-Phosphate Backbone," Chapter 7 In *Carbohydrate Modifications in Antisense Research*. ACS Symposium Series 580, Shanghvi, Y. S and Cook, P. D, eds, American Chemical Society, Washington, pp. 100-117.

Brill, W. et al. (1989). "Synthesis of Oligodeoxynucleoside Phosphoridithioates via Thioamidites," *J. Am Chem soc.* 111:2321-2322.

Brower, V. (1998). "Naked DNA Vaccines Come of Age," *Nature Biotechnology* 16:1304-1305.

Carlsson, C. et al. (1996). "Screening for Genetic Mutations," *Nature* 380:207 (1 page total).

Cole, S.P.C., et al. (1985). "The EBV-Hybridoma Technique and Its Application to Human Lung Cancer," In *Monoclonal Antibodies and Cancer Therapy*, Reisfeld, R. A. and Sell, S., ed., Alan R. Liss, New York, p. 77-96 (Includes Table of Contents).

Creighton, T. E., ed. (1983). "Posttranslational Covalent Modifications of Polypeptide Chains," Chapter 2.4 In *Proteins: Structure and Molecular Properties*. W. H. Freeman & Co., San Francisco pp. 78-86 (Includes Table of Contents).

David, G. S. and Reisfeld, R. A. (1974). "Protein Iodination with Solid State Lactoperoxidase," *Biochemistry* 13(5):1014-1021.

De Mesmaeker, A. et al. (1994). "Comparison of Rigid and Flexible Backbones in Antisense Oligonucleotides," *Bioorganic & Medicinal Chem. Lett.* 4(3):395-398.

De Mesmaeker, A. et al. (1994). "Novel Backbone Replacements for Oligonucleotides," Chapter 2 In *Carbohydrate Modifications in Antisense Research*, ACS Symposium Series 580 . . . Shanghvi, Y. S Cook, P. D, eds, American Chemical Society, Washington, pp. 24-39.

Dempcy, R. O. et al. (1995). "Synthesis of a Thymidyl Pentamer of Deoxyribonucleic Guanidine and Binding Studies with DNA Homopolynucleotides," *Proc. Natl Acad. Sci. USA* 92:6097-6101.

Desbois, C. et al. (1996). "Exclusion of *Int*-6 from PML Nuclear Bodies by Binding to the HTLV-1 Tax Oncoprotein," *Science* 273:951-953.

Devereux et al. (1984). "A Comprehensive Set of Sequence Analysis Programs for the VAX," *Nuc. Acid. Res.* 12(1):387-395.

Doudney, K. et al. (2001). "Comparative Physical and Transcript Maps of~1 Mb around *looptail*, a Gene for Severe Neural Tube Defects on Distal Mouse Chromosome 1 and Human Chromosome 1q22-q23," *Genomics* 72(2):180-192.

Eckstein. F., ed. (1991). *Oligonucleotides and Analogues: A Practical Approach*, Oxford University Press, vii-xvii. (Table of Contents Only).

Edge, A. S. B. et al. (1981). "Deglycosylation of Glycoproteins by Trifluoromerathneusulfonic Acid," *Anal. Biochem.* 118:131-137.

Egholm, M. (1993). "PNA Hybridizes to Complementary Oligonucleotides Obeying the Watson-Crick Hydrogenbonding," *Nature* 365:566-568.

Elgholm, M. et al. (1992). "Peptide Nucleic Acids (PNA). Oligonucleotide Analogues with an Achiral Peptide Backbone," *J. Am. Chem. Soc.* 114:1895-1897.

Erny, K. M. et al. (1996). "Involvement of the *Tpl-2/cot* Oncogene in MMTV Turmorigenesis," *Oncogene* 13:2015-2020.

Evan, G. I. et al. (1985). "Isolation of Monoclonal Antibodies Specific for Human c-myc Proto-Oncogene Product," *Biology* 5(12):3610-3616.

Fan, L. et al. (2000). "Cutting Edge: Ectopic Expression of the Chemokine TCA4/SLC is Sufficient to Trigger Lymphoid Neogenesis,"*J. Immunol.* 164(8):3955-3959.

Feng, D. F. & Doolittle, R. F. (1987). "Progressive Sequence Alignment as a Prerequisite to Correct Phylogenetic Trees," *J. Mol. Evol.* 25:351-360.

Field, J. et al. (1988). "Purification of a RAS-Responsive Adenylyl Cyclase Complex from *Saccharomyces cerevisiae* by Use of a Epitope Addition Method," *Mol Cell. Biol.* 8(5):2159-2165.

Fishwild, D. M.et al. (1996). "High-Avidity Human IgGk Monoclonal Antibodies from a Novel Strain of Minilocus Transgenic Mice," *Nature Biotechnology* 14:845-851.

Gallahan, D. and Callahan, R. (1987). "Mammary Tumorigenesis in Feral Mice: Identification of a New *int* Locus in Mouse Mammary Tumor Virus (Czech II)-Induced Mammary Tumors," *J. Virol.* 61(1):66-74.

Gao, X. and Jeffs, W. P. (1994). "Unusual Conformation of a 3'-thioformacetal Linkage in a DNA Duplex," *J. Biomolecular NMR* 4:17-34.

Germer, S. et al. (2000). "High-Throughput SNP Allele-Frequency Determination in Pooled DNA Samples by Kinetic PCR," *Genome Res.* 10:258-266.

Goding, J. W. (1986). "Production of Monoclonal Antibodies," Chapter 3 In *Monoclonal Antibodies: Principles and Practice*, Academic Press, Inc., $2^{nd}$ edition, pp. 59-103.

Hansen, G. M. et al. (2000), "Genetic Profile of Insertion Mutations in Mouse Leukemias and Lymphomas," *Genome Res.* 10(2):237-243.

Heid, C. A et al. (1996). "Real Time Quantitative PCR," *Genome Research* 6:986-994.

Herdewjn, P. et al. (1994). "Hexopyranosyl-Like Oligonucleotides," Chapter 6 In *Carbohydrate Modifications in Antisense Research*. Shanghvi, Y. S and Cook, P. D, eds, ACS Symposium Series 580, American Chemical Society, Washington, pp. 80-99.

Higgins, D. G. and Sharp, P. M. (1989). "Fast and Sensitive Multiple Sequence Alignments on a Microcomputer," *CABIOS Communications* 5(2):151-153.

Hoogenboom, H. R. and Winter, G. (1991). "By-Passing Immunisation Human Antibodies from Synthetic Repertoires of Germline $V_H$ Gene Segments Rearranged in Vitro," *J. Mol. Biol.* 227:381-388.

Hopp, T. P. et al. (1988). "A Short Polypeptide Marker Sequence Useful for Recombinant Protein Identification and Purification," *Biotechnology* 6:1204-1210.

Horn, T. et al. (1996). "Oligonucleotides with Alternating Anionic and Cationic Phosphoramidate Linkages: Synthesis and Hybridization of Stereo-Uniform Isomers," *Tetrahedron Letters* 37(6):743-746.

Hwang, H. C. et al. (2002). "Identification of Oncognes Collaborating with p27$^{Kip1}$ Loss by Insertional Mutagenesis and High-Throughput Insertion Site Analysis," *Proc. Natl Acad. Sci. USA* 99(17):11293-11298 (Includes supporting information).

Jenkins, G. N. and Turner, N. J. (1995). "The Biosynthesis of Carbocyclic Nucleosides," *Chem. Soc. Rev.* pp. 169-176.

Jones, P. T. et al. (1986). "Replacing the Complementarity-Determining Regions in a Human Antibody with Those from a Mouse," *Nature* 321:522-525.

Jonkers, J. and Berns, A. (1996). "Retroviral Insertional Mutagenesis as a Strategy to Identify Cancer Genes," *Biochim. Biophys. Acta* 1287:29-57.

Joosten, M. et al. (2000). "Phenotyping of Evi 1, Evi 11/Cb2, and Evi 12 Transformed Leukemias Isolated from a Novel Panel of Cas-Br-M Murine Leukemia Virus-Infected Mice," *J. Virology* 268:308-318.

Jung, M. P. et al. (1994). "Hybridization of alternating Cationic/Anionic Oligonucleotides to RNA Segments," *Nucleosides & Nucleotides* 13(6&7):1597-1605.

Karlin, S. and Altschul, S.F. (1993). "Applications and Statistics for Multiple High-Scoring Segments in Molecular Sequences," *Proc. Natl Acad. Sci. USA* 90:5873-5877.

Köhler, G. and Milstein, C. (1975). "Continuous Cultures of Fused Cells Secreting Antibody of Predefined Specificity," *Nature* 256:495-497.

Kohno, T. et al. (2000). "Identification of Genes Associated with the Progression of Adult T-Cell Leukemia (ATL)," *Jpn. J. Cancer Res.* 91:1103-1110.

Lee, F. S. et al. (1995). "Insertional Mutagenesis Identifies a Member of the *Wnt* Gene Family as a Candidate Oncogene in the Mammary Eptithelium of *int-2/Fgf-3* Transgenic Mice,"*Proc. Natl. Acad. Sci. USA* 92:2268-2272.

Lee, S. Wong et al. (1999). "Cloning of Mouse Sepiapterin Reductase Gene and Characterization of its Promoter Region," *Biochimica and Biophysica Acta* 1445(1):165-171.

Letsinger, R. L. et al. (1986). "Effects of Pendant Groups at Phosphorus on Binding Properties of d-ApA Analogues," *Nucl. Acids. Res* 14(8):3487-3499.

Letsinger, R. L. et al. (1988). "Cationic Oligonucleotides," *J. Am. Chem. Soc.* 110:4470-4471.

Letsinger, R.L. and Mungall, W. S. (1970). "Phosphoramidate Analogs of Oligonucleotides," *J. Org. Chem* 35(11):3800-3803.

Li, J. et al. (1999). "Leukaemia Disease Genes: Large-Scale Cloning and Pathway Predictions," *Nature Genetics* 23:348-353.

Lockhart, D. J. et al. (1996). "Expression Monitoring by Hybridization High-Density Oligonucleotide Arrays," *Nature Biotechnology*, 14:1675-1680.

Lonberg, N. and Huszar, D. (1995). "Human Antibodies from Transgenic Mice," *Intern. Rev. Immunol.* 13:65-93.

Longberg, N. et al. (1994). "Antigen-Specific Human Antibodies from Mice Comprising Four Distinct Genetic Modifications," *Nature* 368:856-859.

Lund, A. H. et al. (2002). "Genome-Wide Retroviral Insertional Tagging of Genes Involved in Cancer in Cdkn2a-Deficient Mice," *Nature Genetics Advance online Publication* pp. 1-6.

Lutz-Freyermuth, C. et al. (1990). "Quantitative Determination That One of Two Potential RNA-Binding Domains of the A Protein Component of the U1 Small Nuclear Ribonucleoprotein Complex Binds with High Affinity to Stem-Loop II of U1 RNA," *Proc. Natl Acad. Sci. USA* 87:6393-6397.

MacArthur, C. A. et al. (1995). "*Fgf-8*, Activated by Proviral Insertion, Cooperates with the *Wnt-1* Transgene in Murine Mammary Tumorigenesis," *J. Virol.* 69(4):2501-2507.

Maddry, J. A. et al. (1994). "Synthesis of Nonionic Olgonucleotide Analogues," Chapter 3 *In Carbohydrate Modifications in Antisense Research*. Shanghvi, Y. S and Cook, P. D, eds, ACS Symposium Series 580 American Chemical Society, Washington, pp. 40-51.

Mag, M. et al. (1991). "Synthesis and Selective Cleavage of an Oligodeoynucleotide Containing a Bridged Internucleotide 5'-Phosphorotiate Linkage," *Nucleic Acids Res.* 19(7):1437-1441.

Marchetti, A. et al. (1995). "*Int-6*, a Highly Conserved, Widely Expressed Gene, is Mutated by Mouse Mammary Tumor Virus in Mammary Preneoplasia," *J. Virol.* 69(3):1932-1938.

Marks, J. D. et al. (1991). "By-Passing Immunization, Human Antibodies from V-Gene Libraries Displayed on Phage," *J. Mol. Biol.* 222:581-597.

Marks, J. D. et al. (1992). "By-Passing Immunization: Building High Affinity Human Antibodies by Chain Shuffling," *Bio/Technology* 10:779-783.

Martin, G. A. et al. (1992). "GAP Domains Responsible for Ras p21-Dependent Inhibition of Muscarinic Atrial K+ Channel Currents," *Science* 255:192-194.

Meier, C. et al. (1992). "Peptide Nucleic Acids (PNAs)—Unusual Properties of Nonionic Oligonucleotide Analogues," *Angew Chem. Int. Ed. Engl.* 31(8):1008-1010.

Mikkers ,H. et al. (2002). "High-Throughput Retroviral Tagging to Identify Components of Specific Signaling Pathways in Cancer," *Nature Genetics Advance Online Publication*, pp. 1-7.

Moore, A. S. (2001). "The Role of Chemoattraction in Cancer Metastases," *BioEssays* 23(8):674-676.

Morris, D. W. et al. (1986). "Transfer, by Selective Breeding, of the Pathogenic *Mtv-2* Endogenous Provirus from the GR strain to a Wild Mouse Line Free of Endogenous and Exogenous Mouse Mammary Tumor Virus," *J. Virol.* 58(2):247-252.

Morris, D. W. et al. (1990). "Insertion Mutation of the *Int-1* and *Int-2* Loci by Mouse Mammary Tumor Virus in Premalignant and Malignant Neoplasms from the GR Mouse Strain," *J. Virol.* 64(4):1794-1802.

Morrison, S. L. (1994). "Success in Specification," *Nature* 368:812-813.

Müller, A. et al. (2001). "Involvement of Chemokine Receptors in Breast Cancer Metastasis," *Nature* 410:50-56.

Needleman, S. B. and Wunsch, C. D. (1970). "A General Method Applicable to the Search for Similiarities in the Amino Acid Sequence of Two Proteins," *J. Mol. Biol.* 48:443-453.

Neuberger, M. (1996). "Generating High-Avidity Human Mabs in Mice," *Nature Biotechnology* 14:826 (1 page total).

Nusse, R. and Varmus, H. E. (1982). "Many Tumors Induced by the Mouse Mammary Tumor Virus Contain a Provirus Integrated in the Same Region of the Host Genome," *Cell* 31:99-109.

Nygren, H. (1982). "Conjugation of Horseradish Peroxidase to Fab Fragments with Different Homobifunctional and Heterobifunctional Cross-Linking Reagents," *J. Histochem. and Cytochem.* 30(5):407-412.

Paborsky, L. R. et al. (1990). "Mammalian Cell Transient Expression of Tissue Factor for the Production of Antigen," *Protein Engineering* 3(6):547-553.

Pain, D. and Surolia, A. (1981). "Preparation of Protein A-Peroxidase Monoconjugate Using A Heterobifunctional Reagent, and its Use in Enzyme Immunoassays," *J. Immunol. Meth.* 40:219-230.

Palmarini, M. et al. (1999). "Jaagsiekte Sheep Retrovirus is Necessary and Sufficient to Induce a Contagious Lung Cancer in Sheep," *J. Virol.* 73(8):6964-6972.

Pauwels, R. et al. (1986). "Biological Activity of New 2-5A Analogues," *Chemica Scripta* 26:141-145.

Pearson, W. R. and Lipman, D. J. (1988). "Improved Tools for Biological Sequence Comparison," 85:2444-2448.

Peters, G. et al. (1983). "Tumorigenesis by Mouse Mammary Turmor Virus: Evidence for a Common Region for Provirus Integration in Mammary Tumors," *Cell* 33:369-377.

Peters, G. et al. (1989). "The Mouse Homolog of the *Hst/k-FGF* Gene is Adjacent to *int-2* and is Activated by Proviral Insertion in Some Virally Induced Mammary Tumors," *Proc. Natl. Acad. Sci. USA* 86:5678-5682.

Pierce (1994). "Cross-Linking," *Pierce Catalog and Handbook* pp. 155-200.

Presta, L. G. (1992). "Antibody Engineering", *Current Opinion in Structural Biology* 2:593-596.

Rawls, R. L. (1997). "Optimistic About Antisense," *C & E News* pp. 35-40.

Riechmann, L. et al. (1988). "Reshaping Human Antibodies for Therapy," *Nature* 332:323-327.

Roelink, H. et al. (1990). "*Wnt-3*, a Gene Activated by Proviral Insertion in Mouse Mammary Tumors is Homologous to *int-1/Wnt-1* and is Normally Expressed in Mouse Embryos and Adult Brain," *Proc. Natl. Acad. Sci USA* 87:4519-4523.

Sambrook, J. et al., eds. (1989). *Molecular Cloning, a Laboratory Manual*, Second Edition. Cold Spring Harbor Laboraroty Press. pp. xi-xxxviii. (Table of Contents Only).

Scopes, R. K.,ed. (1982). *Protein Purification: Principles and Practice*. Springer-Verlag, New York, Heidelberg, Berlin, pp. xi-xiii.

Shiramizu, B. et al. (1994). "Identification of a Common Clonal Human Immunodeficiency Virus Integration Site in Human Immunodeficiency Virus-Associated Lymphomas," *Cancer Res.* 54:2069-2072.

Smith, T. F. and Waterman, M. S. (1981). "Comparison of Biosequences," *Adv. Appl. Math.* 2:482-489.

Sojar, H. T. and Bahl, O. P. (1987). "A Chemical Method for the Deglycosylation of Proteins," *Archives of Biochemistry and Biophysics* 259(1):52-57.

Sorensen, A. B. et al. (1993). "Amplification and Sequence Analysis of DNA Flanking Integrated Proviruses by a Simple Two-Step Polymerase Chain Reaction Method," *Journal of Virology* 67(12):7118-7124.

Sorensen, A. B. et al. (1993). "Sequence Tags for Provirus Integration Sites in DNAs of Tumors Induced by the Murine Retrovirus SL3-3," *Journal of Virology* 70(6):4063-4070.

Sorensen, A. B. et al. (2000). "Sintl, a Common Integration Site in SL3-3-Induced T-Cell Lymphomas, Harbors a Putative Proto-Oncogene with Homology to the Septin Gene Family, "*J. Virology* 74(5):2161-2168.

Sprinzl, M. et al. (1977). "Enzymatic Incorporation of ATP and CTP Analogues Into the 3' End of tRNA," *Eur. J. Biochem* 81:579-589.

Stein, C. A. and Cohen, J. S. (1988). "Oligodeoxynucleotides as Inhibitors of Gene Expression: A Review," *Cancer Res.* 48:2659-2668.

Sternsdorf, T. et al. (1997). "Nuclear Dots: Actors on Many Stages," *Immunobiology* 198:307-331.

Suzuki, T. et al. (2002). "New Genes Involved in Cancer Identified by Retroviral Tagging," *Nature Genetics Advance Online Publication* pp. 1-9.

Suzuki, T. et al. (2002). "Web Note A: CIS Definition, Retroviral Tagging in the Post-Genome Era Identifies New Genes Involved in Cancer". (1 page total).

Thotakura, N. R. and Bahl, O. P. (1987). "Enzymathic Deglycosylation of Glycoproteins," *In Methods in Enzymology* Academic Press, Inc., vol. 138. pp. 350-359.

Tijssen (1993). "Overview of Principles of Hybridization and the strategy of nucleic acid assays," Chapter 2 *In Laboratory Techniques in Biochemistry and Molecular Biology*, Hybridization with Nucleic Acid Probes, Van der Vliet, P. C., ed. Elsevier, Amsterdam, London, New York, and Tokyo, vol. 24 pp. 20-78.

Van der Krol, A. R et al. (1988). "Modulation of Eukaryotic Gene Expression by Complementary RNA or DNA Sequences," *Biotechniques* 6(10):958-976.

Varmus, H. E. (1983). "Using Retroviruses as Insertional Mutagens to Identify Cellular Oncogenes," *In Oncogenes and Retroviruses: Evaluation of Basic Findings and Clinical Potential*. Alan R. Liss, Inc., New York. pp. 23-35.

Vaughn, J. et al. (2000). "Genomic Structure and Expression of Human *KCNJ9* (Kir3.3/GIRK3)," *Biochem. Biophys. Res. Commun.* 274(2):302-309.

Verhoeyen, M. et al. (1988). "Reshaping Human Antibodies: Grafting an Antilysozyme Activity," *Science* 239:1534-1536.

von Kiedrowski, G. et al. (1991). "Parabolic Growth of a Self-Replicating Hexdeoxynucleotide Bearing a 3'-5'-Phosphoamidate Linkage," *Angew. Chem. Int. Ed. Engl* 30(4):423-426.

Washington University. (2002). "Washington University BLAST Archives" located at http://blast.wustl visited on Dec. 15, 2002.

Wolford, J. K. (2001). "Analysis of Linkage Disequilibrium Between Polymorphisms in the *KCNJ9* Gene with Type 2 Diabetes Mellitus in Pima Indians," *Mol. Genet. Metab* 73(1):97-103.

Zhang, W-X and Yang, S. Y. (2000). "Cloning and Characterization of a New Member of the T-Box Gene Family," *Genomics* 70(1):41-48.

Zlokarnik, G. et al. (1998). "Quantitation of Transcription and Clonal Selection of Single Living Cells with β-Lactamase as Reporter," *Science* 279:84-88.

International Search Report mailed on Dec. 1, 2003, for PCT patent application No. PCT/US02/33835 filed on Oct. 22, 2002, 4 pages.

Berns, A. (Date unknown). "Table A: Retroviral insertion Sites in $E\mu Myc$ and $E\mu Myc;Pim1^{-/-}$; $Pim2^{-/-}$lymphomas$^{a}$", published in the advance online issue of *Nature Genetics*, 13 pages total.

Berns, A. (Date Unknown). "Web Fig. A", describing PIM protein actions, published in the advance online issue of the *Nature Genetics*, 1 page total.

Campbell, A. M. (1984). "The Production and Characterization of Rodent and Human Hybridomas", Chapter 1 *In Monoclonal Antibody Technology*. Burdon, R. H. and van Knippenberg, P.H., eds, Elsevier, pp. 1-32.

Database GenCore on STN, Accession No. U52152, Schoots et al. "Cloning of four inwardly rectifying potassium channels from human", Direct Submission Mar. 25, 2996 amino acid and nucleic acid sequences.

Database GenCore on STN, on Accession No. AF275818, Yang et al. Jul. 23, 2000. "A family of novel PR-Domain (PRDM) genes as candidate tumor suppressors".

Hunter, W. M. and Greenwood, F. C., "Preparation of Iodine-131 Labelled Human Growth Hormone of High Specific Activity", *Nature* May 5, 1962, vol. 194: pp. 495-496.

Jiang, G-L et al. (2000). "The *yin-yang* of PR-domain family genes in tumorigenesis", *Histol. Histopathol* 15(1): pp. 109-117.

Lohuizen, V. (Date unknown). "Web Table A", describing genomic positions insertion site sequences analyzed against the Celera Mouse Genome Database (CMGD Release 12), published in the advance online issue of *Nature Genetics*, 9 pages total.

Lohuizen, V. (Date unknown). "Web Table B", describing genomic positions of insertion site sequences analyzed against the Ensembl Mouse Genome Database (Feb. 2002 freeze), published in the advance online issue of *Nature Genetics*, 12 pages total.

Lohuizen, V. (Date unknown). "Web Table C", listing GenBank accession Nos., published in the advance online issue of *Nature Genetics*, 11 pages total.

Sawai, H. et al. (1984). "Synthesis and Properties of Oligoadenylic Acids Containing 2'-5' Phosphoramide Linkage", *Chem. Lett.* pp. 805-808.

Schoots, O. et al (1999). "Co-expression of Human Kir3 Subunits Can Yield Channels with Different Functional Properties", *Cell. Signal.* 11(12) pp. 871-883.

Skinner, R. H. et al. (1991). "Use of the Glu-Glu-Phe C-terminal Epitope for Rapid Purification of the Catalytic Domain of Normal and Mutant *ras* GTPase-activating Proteins", *J. Biol. Chem.* 266(22) pgs. 14163-14166.

GenBank Accession No. AF357835. Sasaki, S.et al. (2000 ). "Cloning and Expression of Human B Cell-Specific Transcription Factor $BACH_2$ Mapped to Chromosome 6q15," *Oncogene* 19:3739-3749. (Abstract Only).

International Search Report mailed on Jun. 15, 2004, for PCT patent application No. PCT/US02/36071 filed on Nov. 8, 2002, 5 pages.

International Search Report mailed on Jun. 16, 2004, for PCT patent application No. PCT/US03/40082 filed on Dec. 15, 2003, 5 pages.

Sasaki, S.et al. (2000). "Cloning and Expression of Human B Cell-Specific Transcription Factor $BACH_2$ Mapped to Chromosome 6q15," *Oncogene* 19:3739-3749.

Kudo, S. et al., (1991), *The Journal of Biological Chemistry* 266:8483-8489.

Lai, R. et al., (1999), *American Journal of Clinical Pathology* 111:488-494.

Santamaria, M. et al., (1996) *Cancer Research* 56:3526-3529.

Sikut, R. et al., (1997) *Biochemical and Biophysical Research Communications* 238:612-619.

Sikut, R. et al., (1999) *International Journal of Cancer* 82:52-58.

Traweek, S. T. et al., (1993) *The American Journal of Surgical Pathology* 17(10):1011-1019.

Treasure, J. et al. (1992) *Journal of Clinical Pathology* 45:1018-1022.

International Search Report mailed on Jul. 26, 2004, for PCT patent application No. PCT/US02/38582, filed on Dec. 2, 2002, 8 pages.

Database EMBL, Accession No. AF127773.1, Szelei et al., "Identification of human estrogen-inducible transcripts from a serum-resistant variant of breast cancer MCF7 cells," (1999).

Databse EMBL, Accession No. AC110769, Kozlowicz et al., "*Homo sapiens* BAC clone RP11-141B14 from 2, complete sequence," (2002)**.

Database EMB, Accession No. AF006083, Welch et al., "*Homo sapiens* actin-related protein Arp3 (ARP3) mRNA, complete cds," (1999).

Database Geneseq, Accession No. AAM78861, "Human protein SEQ ID No. 1523," (2001).

Database Geneseq, Accession No. ADJ66601, "Actin-like protein 3 for anti-cancer protein complex," (2004).

Database Uniport, Accession No. "Actin-like protein 3; Actin-2," (2001), P32391.

Shindo-Okada et al., Isolation of a novel actin-related gene expressed in low-metastatic PC-14 human lung adenocarinoma, *Biochem. and Biophys. Res. Comm.* 280(1):61-67 (2001).

Otsubo et al., "Involvement of Arp2/3 complex in the process of colorectal carcinogensis," *Modern Pathology* 17:461-467 (2004).

Szelei et al., "Identification of human estrogen-inducible transcripts that potentially mediate the apoptotic response in breast cancer," *J. of Steroid Biochem. and Mol. Biol.* 72(3-4):89-102 (2000).

Welch et al., "The human Arp2/3 complex is composed of evolutionary conserved subunits and is localized to cellular regions of dynamic actin filament assembly," *J. of Cell Biology* 138(2): 375-384 (1997).

Wulfkuhle et al., "Proteomic analysis of ductal carcinoma in situ of the human breast," *Proceedings of the American Association for Cancer Research Annual Meeting* 43:38 (2002).

Zheng et al., "Arp2/3 overexpression contributed to pathogenesis, growth and invasion of gastric carcinoma," *Anticancer Res.* 28:2225-2232 (2008).

* cited by examiner ns COMPOSITIONS AND METHODS FOR CANCER

The present application is a continuing application of U.S. Ser. Nos. 09/747,377, filed Dec. 22, 2000 now abandoned and 09/798,586, filed Mar. 2, 2001, now abandoned both of which are expressly incorporated herein by reference.

SEQUENCE LISTING

The Sequence Listing submitted on compact disc under 37 C.F.R. §1.821(c), is incorporated herein by reference. Two identical discs submitted on CD-R are labeled "CRF" and "Sequence Listing".

FIELD OF THE INVENTION

The present invention relates to novel sequences for use in diagnosis and treatment of cancer, especially carcinomas, as well as the use of the novel compositions in screening methods.

BACKGROUND OF THE INVENTION

Oncogenes are genes that can cause cancer. Carcinogenesis can occur by a wide variety of mechanisms, including infection of cells by viruses containing oncogenes, activation of protooncogenes in the host genome, and mutations of protooncogenes and tumor suppressor genes.

There are a number of viruses known to be involved in human cancer as well as in animal cancer. Of particular interest here are viruses that do not contain oncogenes themselves; these are slow-transforming retroviruses. They induce tumors by integrating into the host genome and affecting neighboring protooncogenes in a variety of ways, including promoter insertion, enhancer insertion, and/or truncation of a protooncogene or tumor suppressor gene. The analysis of sequences at or near the insertion sites led to the identification of a number of new protooncogenes.

With respect to lymphoma and leukemia, murine leukemia retrovirus (MuLV), such as SL3-3 or Akv, is a potent inducer of tumors when inoculated into susceptible newborn mice, or when carried in the germline. A number of sequences have been identified as relevant in the induction of lymphoma and leukemia by analyzing the insertion sites; see Sorensen et al., J. of Virology 74:2161 (2000); Hansen et al., Genome Res. 10(2):237-43 (2000); Sorensen et al., J. Virology 70:4063 (1996); Sorensen et al. J. Virology 67:7118 (1993); Joosten et al., Virology 268:308 (2000); and Li et al., Nature Genetics 23:348 (1999); all of which are expressly incorporated by reference herein.

Accordingly, it is an object of the invention to provide sequences involved in cancer and in particular in oncogenesis.

SUMMARY OF THE INVENTION

In accordance with the objects outlined above, the present invention provides methods for screening for compositions which modulate carcinomas, especially lymphoma and leukemia. Also provided herein are methods of inhibiting proliferation of a cell, preferably a lymphoma cell. Methods of treatment of carcinomas, including diagnosis, are also provided herein.

In one aspect, a method of screening drug candidates comprises providing a cell that expresses a carcinoma associated (CA) gene or fragments thereof. Preferred embodiments of CA genes are genes which are differentially expressed in cancer cells, preferably lymphatic, breast, prostate or epithelial cells, compared to other cells. Preferred embodiments of CA genes used in the methods herein include, but are not limited to the nucleic acids selected from Table 1 06-001 to 06-343. The method further includes adding a drug candidate to the cell and determining the effect of the drug candidate on the expression of the CA gene.

In one embodiment, the method of screening drug candidates includes comparing the level of expression in the absence of the drug candidate to the level of expression in the presence of the drug candidate.

Also provided herein is a method of screening for a bioactive agent capable of binding to a CA protein (CAP), the method comprising combining the CAP and a candidate bioactive agent, and determining the binding of the candidate agent to the CAP.

Further provided herein is a method for screening for a bioactive agent capable of modulating the activity of a CAP. In one embodiment, the method comprises combining the CAP and a candidate bioactive agent, and determining the effect of the candidate agent on the bioactivity of the CAP.

Also provided is a method of evaluating the effect of a candidate carcinoma drug comprising administering the drug to a patient and removing a cell sample from the patient. The expression profile of the cell is then determined. This method may further comprise comparing the expression profile of the patient to an expression profile of a healthy individual.

In a further aspect, a method for inhibiting the activity of an CA protein is provided. In one embodiment, the method comprises administering to a patient an inhibitor of a CA protein preferably selected from the group consisting of the sequences outlined in Table 1 06-001 to 06-343 or their complements.

A method of neutralizing the effect of a CA protein, preferably a protein encoded by a nucleic acid selected from the group of sequences outlined in Table 1 06-001 to 06-343, is also provided. Preferably, the method comprises contacting an agent specific for said protein with said protein in an amount sufficient to effect neutralization.

Moreover, provided herein is a biochip comprising a nucleic acid segment which encodes a CA protein, preferably selected from the sequences outlined in Table 1 06-001 to 06-343.

Also provided herein is a method for diagnosing or determining the propensity to carcinomas, especially lymphoma or leukemia by sequencing at least one carcinoma or lymphoma gene of an individual. In yet another aspect of the invention, a method is provided for determining carcinoma including lymphoma and leukemia gene copy number in an individual.

Novel sequences are also provided herein. Other aspects of the invention will become apparent to the skilled artisan by the following description of the invention.

DETAILED DESCRIPTION OF THE INVENTION

The present invention is directed to a number of sequences associated with carcinomas, especially lymphoma, breast cancer or prostate cancer. The relatively tight linkage between clonally-integrated proviruses and protooncogenes forms "provirus tagging", in which slow-transforming retroviruses that act by an insertion mutation mechanism are used to isolate protooncogenes. In some models, uninfected animals have low cancer rates, and infected animals have high cancer rates. It is known that many of the retroviruses involved do not carry transduced host protooncogenes or pathogenic transacting viral genes, and thus the cancer incidence must therefor be a direct consequence of proviral integration effects into host protooncogenes. Since proviral integration is random, rare integrants will "activate" host protooncogenes that provide a selective growth advantage, and these rare events result in new proviruses at clonal stoichiometries in tumors.

The use of oncogenic retroviruses, whose sequences insert into the genome of the host organism resulting in carcinoma, allows the identification of host sequences involved in carcinoma. These sequences may then be used in a number of different ways, including diagnosis, prognosis, screening for modulators (including both agonists and antagonists), antibody generation (for immunotherapy and imaging), etc. However, as will be appreciated by those in the art, oncogenes that are identified in one type of cancer such as lymphoma or leukemia have a strong likelihood of being involved in other types of cancers as well. Thus, while the sequences outlined herein are initially identified as correlated with lymphoma, they can also be found in other types of cancers as well, outlined below.

Accordingly, the present invention provides nucleic acid and protein sequences that are associated with carcinoma, herein termed "carcinoma associated" or "CA" sequences. In a preferred embodiment, the present invention provides nucleic acid and protein sequences that are associated with carcinomas which originate in lymphatic tissue, herein termed "lymphoma associated", "leukemia associated" or "LA" sequences.

Suitable cancers which can be diagnosed or screened for using the methods of the present invention include cancers classified by site or by histological type. Cancers classified by site include cancer of the oral cavity and pharynx (lip, tongue, salivary gland, floor of mouth, gum and other mouth, nasopharynx, tonsil, oropharynx, hypopharynx, other oral/pharynx); cancers of the digestive system (esophagus; stomach; small intestine; colon and rectum; anus, anal canal, and anorectum; liver; intrahepatic bile duct; gallbladder; other biliary; pancreas; retroperitoneum; peritoneum, omentum, and mesentery; other digestive); cancers of the respiratory system (nasal cavity, middle ear, and sinuses; larynx; lung and bronchus; pleura; trachea, mediastinum, and other respiratory); cancers of the mesothelioma; bones and joints; and soft tissue, including heart; skin cancers, including melanomas and other non-epithelial skin cancers; Kaposi's sarcoma and breast cancer; cancer of the female genital system (cervix uteri; corpus uteri; uterus, nos; ovary; vagina; vulva; and other female genital); cancers of the male genital system (prostate gland; testis; penis; and other male genital); cancers of the urinary system (urinary bladder; kidney and renal pelvis; ureter; and other urinary); cancers of the eye and orbit; cancers of the brain and nervous system (brain; and other nervous system); cancers of the endocrine system (thyroid gland and other endocrine, including thymus); cancers of the lymphomas (hodgkin's disease and non-hodgkin's lymphoma), multiple myeloma, and leukemias (lymphocytic leukemia; myeloid leukemia; monocytic leukemia; and other leukemias).

Other cancers, classified by histological type, that may be associated with the sequences of the invention include, but are not limited to, Neoplasm, malignant; Carcinoma, NOS; Carcinoma, undifferentiated, NOS; Giant and spindle cell carcinoma; Small cell carcinoma, NOS; Papillary carcinoma, NOS; Squamous cell carcinoma, NOS; Lymphoepithelial carcinoma; Basal cell carcinoma, NOS; Pilomatrix carcinoma; Transitional cell carcinoma, NOS; Papillary transitional cell carcinoma; Adenocarcinoma, NOS; Gastrinoma, malignant; Cholangiocarcinoma; Hepatocellular carcinoma, NOS; Combined hepatocellular carcinoma and cholangiocarcinoma; Trabecular adenocarcinoma; Adenoid cystic carcinoma; Adenocarcinoma in adenomatous polyp; Adenocarcinoma, familial polyposis coli; Solid carcinoma, NOS; Carcinoid tumor, malignant; Branchiolo-alveolar adenocarcinoma; Papillary adenocarcinoma, NOS; Chromophobe carcinoma; Acidophil carcinoma; Oxyphilic adenocarcinoma; Basophil carcinoma; Clear cell adenocarcinoma, NOS; Granular cell carcinoma; Follicular adenocarcinoma, NOS; Papillary and follicular adenocarcinoma; Nonencapsulating sclerosing carcinoma; Adrenal cortical carcinoma; Endometroid carcinoma; Skin appendage carcinoma; Apocrine adenocarcinoma; Sebaceous adenocarcinoma; Ceruminous adenocarcinoma; Mucoepidermoid carcinoma; Cystadenocarcinoma, NOS; Papillary cystadenocarcinoma, NOS; Papillary serous cystadenocarcinoma; Mucinous cystadenocarcinoma, NOS; Mucinous adenocarcinoma; Signet ring cell carcinoma; Infiltrating duct carcinoma; Medullary carcinoma, NOS; Lobular carcinoma; Inflammatory carcinoma; Paget's disease, mammary; Acinar cell carcinoma; Adenosquamous carcinoma; Adenocarcinoma w/ squamous metaplasia; Thymoma, malignant; Ovarian stromal tumor, malignant; Thecoma, malignant; Granulosa cell tumor, malignant; Androblastoma, malignant; Sertoli cell carcinoma; Leydig cell tumor, malignant; Lipid cell tumor, malignant; Paraganglioma, malignant; Extra-mammary paraganglioma, malignant; Pheochromocytoma; Glomangiosarcoma; Malignant melanoma, NOS; Amelanotic melanoma; Superficial spreading melanoma; Malig melanoma in giant pigmented nevus; Epithelioid cell melanoma; Blue nevus, malignant; Sarcoma, NOS; Fibrosarcoma, NOS; Fibrous histiocytoma, malignant; Myxosarcoma; Liposarcoma, NOS; Leiomyosarcoma, NOS; Rhabdomyosarcoma, NOS; Embryonal rhabdomyosarcoma; Alveolar rhabdomyosarcoma; Stromal sarcoma, NOS; Mixed tumor, malignant, NOS; Mullerian mixed tumor; Nephroblastoma; Hepatoblastoma; Carcinosarcoma, NOS; Mesenchymoma, malignant; Brenner tumor, malignant; Phyllodes tumor, malignant; Synovial sarcoma, NOS; Mesothelioma, malignant; Dysgerminoma; Embryonal carcinoma, NOS; Teratoma, malignant, NOS; Struma ovarii, malignant; Choriocarcinoma; Mesonephroma, malignant; Hemangiosarcoma; Hemangioendothelioma, malignant; Kaposi's sarcoma; Hemangiopericytoma, malignant; Lymphangiosarcoma; Osteosarcoma, NOS; Juxtacortical osteosarcoma; Chondrosarcoma, NOS; Chondroblastoma, malignant; Mesenchymal chondrosarcoma; Giant cell tumor of bone; Ewing's sarcoma; Odontogenic tumor, malignant; Ameloblastic odontosarcoma; Ameloblastoma, malignant; Ameloblastic fibrosarcoma; Pinealoma, malignant; Chordoma; Glioma, malignant; Ependymoma, NOS; Astrocytoma, NOS; Protoplasmic astrocytoma; Fibrillary astrocytoma; Astroblastoma; Glioblastoma, NOS; Oligodendroglioma, NOS; Oligodendroblastoma; Primitive neuroectodermal; Cerebellar sarcoma, NOS; Ganglioneuroblastoma; Neuroblastoma, NOS; Retinoblastoma, NOS; Olfactory neurogenic tumor; Meningioma, malignant; Neurofibrosarcoma; Neurilemmoma, malignant; Granular cell tumor, malignant; Malignant lymphoma, NOS; Hodgkin's disease, NOS; Hodgkin's; paragranuloma, NOS; Malignant lymphoma, small lymphocytic; Malignant lymphoma, large cell, diffuse; Malignant lymphoma, follicular, NOS; Mycosis fungoides; Other specified non-Hodgkin's lymphomas; Malignant histiocytosis; Multiple myeloma; Mast cell sarcoma; Immunoproliferative small intestinal disease; Leukemia, NOS; Lymphoid leukemia, NOS; Plasma cell leukemia; Erythroleukemia; Lymphosarcoma cell leukemia; Myeloid leukemia, NOS; Basophilic leukemia; Eosinophilic leukemia; Monocytic leukemia, NOS; Mast cell leukemia; Megakaryoblastic leukemia; Myeloid sarcoma; and Hairy cell leukemia.

In addition, the genes may be involved in other diseases, such as but not limited to diseases associated with aging or neurodegenerative diseases.

Association in this context means that the nucleotide or protein sequences are either differentially expressed, activated, inactivated or altered in carcinomas as compared to normal tissue. As outlined below, CA sequences include those that are up-regulated (i.e. expressed at a higher level), as well as those that are down-regulated (i.e. expressed at a lower level), in carcinomas. CA sequences also include sequences which have been altered (i.e., truncated sequences or sequences with substitutions, deletions or insertions, including point mutations) and show either the same expression profile or an altered profile. In a preferred embodiment, the CA sequences are from humans; however, as will be appreciated by those in the art, CA sequences from other organisms may be useful in animal models of disease and drug evaluation; thus, other CA sequences are provided, from vertebrates, including mammals, including rodents (rats, mice, hamsters, guinea pigs, etc.), primates, farm animals (including sheep, goats, pigs, cows, horses, etc). In some cases, prokaryotic CA sequences may be useful. CA sequences from other organisms may be obtained using the techniques outlined below.

CA sequences can include both nucleic acid and amino acid sequences. In a preferred embodiment, the CA sequences are recombinant nucleic acids. By the term "recombinant nucleic acid" herein is meant nucleic acid, originally formed in vitro, in general, by the manipulation of nucleic acid by polymerases and endonucleases, in a form not normally found in nature. Thus an isolated nucleic acid, in a linear form, or an expression vector formed in vitro by ligating DNA molecules that are not normally joined, are both considered recombinant for the purposes of this invention. It is understood that once a recombinant nucleic acid is made and reintroduced into a host cell or organism, it will replicate non-recombinantly, i.e. using the in vivo cellular machinery of the host cell rather than in vitro manipulations; however, such nucleic acids, once produced recombinantly, although subsequently replicated non-recombinantly, are still considered recombinant for the purposes of the invention.

Similarly, a "recombinant protein" is a protein made using recombinant techniques, i.e. through the expression of a recombinant nucleic acid as depicted above. A recombinant protein is distinguished from naturally occurring protein by at least one or more characteristics. For example, the protein may be isolated or purified away from some or all of the proteins and compounds with which it is normally associated in its wild type host, and thus may be substantially pure. For example, an isolated protein is unaccompanied by at least some of the material with which it is normally associated in its natural state, preferably constituting at least about 0.5%, more preferably at least about 5% by weight of the total protein in a given sample. A substantially pure protein comprises at least about 75% by weight of the total protein, with at least about 80% being preferred, and at least about 90% being particularly preferred. The definition includes the production of an CA protein from one organism in a different organism or host cell. Alternatively, the protein may be made at a significantly higher concentration than is normally seen, through the use of an inducible promoter or high expression promoter, such that the protein is made at increased concentration levels. Alternatively, the protein may be in a form not normally found in nature, as in the addition of an epitope tag or amino acid substitutions, insertions and deletions, as discussed below.

In a preferred embodiment, the CA sequences are nucleic acids. As will be appreciated by those in the art and is more fully outlined below, CA sequences are useful in a variety of applications, including diagnostic applications, which will detect naturally occurring nucleic acids, as well as screening applications; for example, biochips comprising nucleic acid probes to the CA sequences can be generated. In the broadest sense, then, by "nucleic acid" or "oligonucleotide" or grammatical equivalents herein means at least two nucleotides covalently linked together. A nucleic acid of the present invention will generally contain phosphodiester bonds, although in some cases, as outlined below (for example in antisense applications or when a candidate agent is a nucleic acid), nucleic acid analogs may be used that have alternate backbones, comprising, for example, phosphoramidate (Beaucage et al., Tetrahedron 49(10):1925 (1993) and references therein; Letsinger, J. Org. Chem. 35:3800 (1970); Sprinzl et al., Eur. J. Biochem. 81:579 (1977); Letsinger et al., Nucl. Acids Res. 14:3487 (1986); Sawai et al, Chem. Lett. 805 (1984), Letsinger et al., J. Am. Chem. Soc. 110:4470 (1988); and Pauwels et al., Chemica Scripta 26:141 91986)), phosphorothioate (Mag et al., Nucleic Acids Res. 19:1437 (1991); and U.S. Pat. No. 5,644,048), phosphorodithioate (Briu et al., J. Am. Chem. Soc. 111:2321 (1989), O-methylphophoroamidite linkages (see Eckstein, Oligonucleotides and Analogues: A Practical Approach, Oxford University Press), and peptide nucleic acid backbones and linkages (see Egholm, J. Am. Chem. Soc. 114:1895 (1992); Meier et al., Chem. Int. Ed. Engl. 31:1008 (1992); Nielsen, Nature, 365: 566 (1993); Carlsson et al., Nature 380:207 (1996), all of which are incorporated by reference). Other analog nucleic acids include those with positive backbones (Denpcy et al., Proc. Natl. Acad. Sci. USA 92:6097 (1995); non-ionic backbones (U.S. Pat. Nos. 5,386,023, 5,637,684, 5,602,240, 5,216,141 and 4,469,863; Kiedrowshi et al., Angew. Chem. Intl. Ed. English 30:423 (1991); Letsinger et al., J. Am. Chem. Soc. 110:4470 (1988); Letsinger et al., Nucleoside & Nucleotide 13:1597 (1994); Chapters 2 and 3, ASC Symposium Series 580, "Carbohydrate Modifications in Antisense Research", Ed. Y. S. Sanghui and P. Dan Cook; Mesmaeker et al., Bioorganic & Medicinal Chem. Lett. 4:395 (1994); Jeffs et al., J. Biomolecular NMR 34:17 (1994); Tetrahedron Lett. 37:743 (1996)) and non-ribose backbones, including those described in U.S. Pat. Nos. 5,235,033 and 5,034,506, and Chapters 6 and 7, ASC Symposium Series 580, "Carbohydrate Modifications in Antisense Research", Ed. Y. S. Sanghui and P. Dan Cook. Nucleic acids containing one or more carbocyclic sugars are also included within one definition of nucleic acids (see Jenkins et al., Chem. Soc. Rev. (1995) pp 169-176). Several nucleic acid analogs are described in Rawls, C & E News Jun. 2, 1997 page 35. All of these references are hereby expressly incorporated by reference. These modifications of the ribose-phosphate backbone may be done for a variety of reasons, for example to increase the stability and half-life of such molecules in physiological environments for use in anti-sense applications or as probes on a biochip.

As will be appreciated by those in the art, all of these nucleic acid analogs may find use in the present invention. In addition, mixtures of naturally occurring nucleic acids and analogs can be made; alternatively, mixtures of different nucleic acid analogs, and mixtures of naturally occurring nucleic acids and analogs may be made.

The nucleic acids may be single stranded or double stranded, as specified, or contain portions of both double stranded or single stranded sequence. As will be appreciated by those in the art, the depiction of a single strand "Watson" also defines the sequence of the other strand "Crick"; thus the sequences described herein also includes the complement of the sequence. The nucleic acid may be DNA, both genomic and cDNA, RNA or a hybrid, where the nucleic acid contains any combination of deoxyribo- and ribo-nucleotides, and any combination of bases, including uracil, adenine, thymine, cytosine, guanine, inosine, xanthine hypoxanthine, isocytosine, isoguanine, etc. As used herein, the term "nucleoside" includes nucleotides and nucleoside and nucleotide analogs, and modified nucleosides such as amino modified nucleosides. In addition, "nucleoside" includes non-naturally occurring analog structures. Thus for example the individual units of a peptide nucleic acid, each containing a base, are referred to herein as a nucleoside.

An CA sequence can be initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

The CA sequences of the invention were initially identified as described herein; basically, infection of mice with murine leukemia viruses (MLV) resulted in lymphoma, although many of these sequences will also be involved in other cancers as is generally outlined herein.

The CA sequences outlined herein comprise the insertion sites for the virus. In general, the retrovirus can cause carcinomas in three basic ways: first of all, by inserting upstream of a normally silent host gene and activating it (e.g. promoter insertion); secondly, by truncating a host gene that leads to oncogenesis; or by enhancing the transcription of a neighboring gene. For example, retrovirus enhancers, including SL3-3, are known to act on genes up to approximately 200 kilobases of the insertion site.

In a preferred embodiment, CA sequences are those that are up-regulated in carcinomas; that is, the expression of these genes is higher in carcinoma tissue as compared to normal tissue of the same differentiation stage. "Up-regulation" as used herein means at least about 50%, more preferably at least about 100%, more preferably at least about 150%, more preferably, at least about 200%, with from 300 to at least 1000% being especially preferred.

In a preferred embodiment, CA sequences are those that are down-regulated in carcinomas; that is, the expression of these genes is lower in carcinoma tissue as compared to normal I tissue of the same differentiation stage. "Downregulation" as used herein means at least about 50%, more preferably at least about 100%, more preferably at least about 150%, more preferably, at least about 200%, with from 300 to at least 1000% being especially preferred.

In a preferred embodiment, CA sequences are those that are altered but show either the same expression profile or an altered profile as compared to normal lymphoid tissue of the same differentiation stage. "Altered CA sequences" as used herein refers to sequences which are truncated, contain insertions or contain point mutations.

CA proteins of the present invention may be classified as secreted proteins, transmembrane proteins or intracellular proteins.

In a preferred embodiment the CA protein is an intracellular protein. Intracellular proteins may be found in the cytoplasm and/or in the nucleus. Intracellular proteins are involved in all aspects of cellular function and replication (including, for example, signaling pathways); aberrant expression of such proteins results in unregulated or disregulated cellular processes. For example, many intracellular proteins have enzymatic activity such as protein kinase activity, protein phosphatase activity, protease activity, nucleotide cyclase activity, polymerase activity and the like. Intracellular proteins also serve as docking proteins that are involved in organizing complexes of proteins, or targeting proteins to various subcellular localizations, and are involved in maintaining the structural integrity of organelles.

An increasingly appreciated concept in characterizing intracellular proteins is the presence in the proteins of one or more motifs for which defined functions have been attributed. In addition to the highly conserved sequences found in the enzymatic domain of proteins, highly conserved sequences have been identified in proteins that are involved in protein-protein interaction. For example, Src-homology-2 (SH2) domains bind tyrosine-phosphorylated targets in a sequence dependent manner. PTB domains, which are distinct from SH2 domains, also bind tyrosine phosphorylated targets. SH3 domains bind to proline-rich targets. In addition, PH domains, tetratricopeptide repeats and WD domains to name only a few, have been shown to mediate protein-protein interactions. Some of these may also be involved in binding to phospholipids or other second messengers. As will be appreciated by one of ordinary skill in the art, these motifs can be identified on the basis of primary sequence; thus, an analysis of the sequence of proteins may provide insight into both the enzymatic potential of the molecule and/or molecules with which the protein may associate.

In a preferred embodiment, the CA sequences are transmembrane proteins. Transmembrane proteins are molecules that span the phospholipid bilayer of a cell. They may have an intracellular domain, an extracellular domain, or both. The intracellular domains of such proteins may have a number of functions including those already described for intracellular proteins. For example, the intracellular domain may have enzymatic activity and/or may serve as a binding site for additional proteins. Frequently the intracellular domain of transmembrane proteins serves both roles. For example certain receptor tyrosine kinases have both protein kinase activity and SH2 domains. In addition, autophosphorylation of tyrosines on the receptor molecule itself, creates binding sites for additional SH2 domain containing proteins.

Transmembrane proteins may contain from one to many transmembrane domains. For example, receptor tyrosine kinases, certain cytokine receptors, receptor guanylyl cyclases and receptor serine/threonine protein kinases contain a single transmembrane domain. However, various other proteins including channels and adenylyl cyclases contain numerous transmembrane domains. Many important cell surface receptors are classified as "seven transmembrane domain" proteins, as they contain 7 membrane spanning regions. Important transmembrane protein receptors include, but are not limited to insulin receptor, insulin-like growth factor receptor, human growth hormone receptor, glucose transporters, transferrin receptor, epidermal growth factor receptor, low density lipoprotein receptor, epidermal growth factor receptor, leptin receptor, interleukin receptors, e.g. IL-1 receptor, IL-2 receptor, etc.

Characteristics of transmembrane domains include approximately 20 consecutive hydrophobic amino acids that may be followed by charged amino acids. Therefore, upon analysis of the amino acid sequence of a particular protein, the localization and number of transmembrane domains within the protein may be predicted.

The extraceullar domains of transmembrane proteins are diverse, however, conserved motifs are found repeatedly among various extracellular domains. Conserved structure and/or functions have been ascribed to different extracellular motifs. For example, cytokine receptors are characterized by a cluster of cysteines and a WSXWS (SEQ ID NO: 2059) (W=tryptophan, S=serine, X=any amino acid) motif. Immunoglobulin-like domains are highly conserved. Mucin-like domains may be involved in cell adhesion and leucine-rich repeats participate in protein-protein interactions.

Many extracellular domains are involved in binding to other molecules. In one aspect, extracellular domains are receptors. Factors that bind the receptor domain include circulating ligands, which may be peptides, proteins, or small molecules such as adenosine and the like. For example, growth factors such as EGF, FGF and PDGF are circulating growth factors that bind to their cognate receptors to initiate a variety of cellular responses. Other factors include cytokines, mitogenic factors, neurotrophic factors and the like. Extracellular domains also bind to cell-associated molecules. In this respect, they mediate cell-cell interactions. Cell-associated ligands can be tethered to the cell for example via a glycosylphosphatidylinositol (GPI) anchor, or may themselves be transmembrane proteins. Extracellular domains also associate with the extracellular matrix and contribute to the maintenance of the cell structure.

CA proteins that are transmembrane are particularly preferred in the present invention as they are good targets for immunotherapeutics, as are described herein. In addition, as outlined below, transmembrane proteins can be also useful in imaging modalities.

It will also be appreciated by those in the art that a transmembrane protein can be made soluble by removing transmembrane sequences, for example through recombinant methods. Furthermore, transmembrane proteins that have been made soluble can be made to be secreted through recombinant means by adding an appropriate signal sequence.

In a preferred embodiment, the CA proteins are secreted proteins; the secretion of which can be either constitutive or regulated. These proteins have a signal peptide or signal sequence that targets the molecule to the secretory pathway. Secreted proteins are involved in numerous physiological events; by virtue of their circulating nature, they serve to transmit signals to various other cell types. The secreted protein may function in an autocrine manner (acting on the cell that secreted the factor), a paracrine manner (acting on cells in close proximity to the cell that secreted the factor) or an endocrine manner (acting on cells at a distance). Thus secreted molecules find use in modulating or altering numerous aspects of physiology. CA proteins that are secreted proteins are particularly preferred in the present invention as they serve as good targets for diagnostic markers, for example for blood tests.

An CA sequence is initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

As used herein, a nucleic acid is a "CA nucleic acid" if the overall homology of the nucleic acid sequence to one of the nucleic acids of Table 1 06-001 to 06-343 is preferably greater than about 75%, more preferably greater than about 80%, even more preferably greater than about 85% and most preferably greater than 90%. In some embodiments the homology will be as high as about 93 to 95 or 98%. In a preferred embodiment, the sequences which are used to determine sequence identity or similarity are selected from those of the nucleic acids of Table 1 06-001 to 06-343. In another embodiment, the sequences are naturally occurring allelic variants of the sequences of the nucleic acids of Table 1 06-001 to 06-343. In another embodiment, the sequences are sequence variants as further described herein.

Homology in this context means sequence similarity or identity, with identity being preferred. A preferred comparison for homology purposes is to compare the sequence containing sequencing errors to the correct sequence. This homology will be determined using standard techniques known in the art, including, but not limited to, the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, PNAS USA 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res. 12:387-395 (1984), preferably using the default settings, or by inspection.

One example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, J. Mol. Evol. 35:351-360 (1987); the method is similar to that described by Higgins & Sharp CABIOS 5:151-153 (1989). Useful PILEUP parameters including a default gap weight of 3.00, a default gap length weight of 0.10, and weighted end gaps.

Another example of a useful algorithm is the BLAST algorithm, described in Altschul et al., J. Mol. Biol. 215, 403-410, (1990) and Karlin et al., PNAS USA 90:5873-5787 (1993). A particularly useful BLAST program is the WU-BLAST-2 program which was obtained from Altschul et al., Methods in Enzymology, 266: 460-480 (1996); http://blast.wustl]. WU-BLAST-2 uses several search parameters, most of which are set to the default values. The adjustable parameters are set with the following values: overlap span=1, overlap fraction=0.125, word threshold (T)=11. The HSP S and HSP S2 parameters are dynamic values and are established by the program itself depending upon the composition of the particular sequence and composition of the particular database against which the sequence of interest is being searched; however, the values may be adjusted to increase sensitivity. A % amino acid sequence identity value is determined by the number of matching identical residues divided by the total number of residues of the "longer" sequence in the aligned region. The "longer" sequence is the one having the most actual residues in the aligned region (gaps introduced by WU-Blast-2 to maximize the alignment score are ignored).

Thus, "percent (%) nucleic acid sequence identity" is defined as the percentage of nucleotide residues in a candidate sequence that are identical with the nucleotide residues of the nucleic acids of Table 1 06-001 to 06-343. A preferred method utilizes the BLASTN module of WU-BLAST-2 set to the default parameters, with overlap span and overlap fraction set to 1 and 0.125, respectively.

The alignment may include the introduction of gaps in the sequences to be aligned. In addition, for sequences which contain either more or fewer nucleotides than those of the nucleic acids of Table 1 06-001 to 06-343, it is understood that the percentage of homology will be determined based on the number of homologous nucleosides in relation to the total number of nucleosides. Thus, for example, homology of sequences shorter than those of the sequences identified herein and as discussed below, will be determined using the number of nucleosides in the shorter sequence.

In one embodiment, the nucleic acid homology is determined through hybridization studies. Thus, for example, nucleic acids which hybridize under high stringency to the nucleic acids identified in the figures, or their complements, are considered CA sequences. High stringency conditions are known in the art; see for example Maniatis et al., Molecular Cloning: A Laboratory Manual, 2d Edition, 1989, and Short Protocols in Molecular Biology, ed. Ausubel, et al., both of which are hereby incorporated by reference. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Acid Probes, "Overview of principles of hybridization and the strategy of nucleic acid assays" (1993). Generally, stringent conditions are selected to be about 5-10° C. lower than the thermal melting point (Tm) for the specific sequence at a defined ionic strength pH. The Tm is the temperature (under defined ionic strength, pH and nucleic acid concentration) at which 50% of the probes complementary to the target hybridize to the target sequence at equilibrium (as the target sequences are present in excess, at Tm, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g. 10 to 50 nucleotides) and at least about 60° C. for long probes (e.g. greater than 50 nucleotides). Stringent conditions may also be achieved with the addition of destabilizing agents such as formamide.

In another embodiment, less stringent hybridization conditions are used; for example, moderate or low stringency conditions may be used, as are known in the art; see Maniatis and Ausubel, supra, and Tijssen, supra.

In addition, the CA nucleic acid sequences of the invention are fragments of larger genes, i.e. they are nucleic acid segments. Alternatively, the CA nucleic acid sequences can serve as indicators of oncogene position, for example, the CA sequence may be an enhancer that activates a protooncogene. "Genes" in this context includes coding regions, non-coding regions, and mixtures of coding and non-coding regions. Accordingly, as will be appreciated by those in the art, using the sequences provided herein, additional sequences of the CA genes can be obtained, using techniques well known in the art for cloning either longer sequences or the full length sequences; see Maniatis et al., and Ausubel, et al., supra, hereby expressly incorporated by reference. In general, this is done using PCR, for example, kinetic PCR.

Once the CA nucleic acid is identified, it can be cloned and, if necessary, its constituent parts recombined to form the entire CA nucleic acid. Once isolated from its natural source, e.g., contained within a plasmid or other vector or excised therefrom as a linear nucleic acid segment, the recombinant CA nucleic acid can be further used as a probe to identify and isolate other CA nucleic acids, for example additional coding regions. It can also be used as a "precursor" nucleic acid to make modified or variant CA nucleic acids and proteins.

The CA nucleic acids of the present invention are used in several ways. In a first embodiment, nucleic acid probes to the CA nucleic acids are made and attached to biochips to be used in screening and diagnostic methods, as outlined below, or for administration, for example for gene therapy and/or antisense applications. Alternatively, the CA nucleic acids that include coding regions of CA proteins can be put into expression vectors for the expression of CA proteins, again either for screening purposes or for administration to a patient.

In a preferred embodiment, nucleic acid probes to CA nucleic acids (both the nucleic acid sequences outlined in the figures and/or the complements thereof) are made. The nucleic acid probes attached to the biochip are designed to be substantially complementary to the CA nucleic acids, i.e. the target sequence (either the target sequence of the sample or to other probe sequences, for example in sandwich assays), such that hybridization of the target sequence and the probes of the present invention occurs. As outlined below, this complementarity need not be perfect; there may be any number of base pair mismatches which will interfere with hybridization between the target sequence and the single stranded nucleic acids of the present invention. However, if the number of mutations is so great that no hybridization can occur under even the least stringent of hybridization conditions, the sequence is not a complementary target sequence. Thus, by "substantially complementary" herein is meant that the probes are sufficiently complementary to the target sequences to hybridize under normal reaction conditions, particularly high stringency conditions, as outlined herein.

A nucleic acid probe is generally single stranded but can be partially single and partially double stranded. The strandedness of the probe is dictated by the structure, composition, and properties of the target sequence. In general, the nucleic acid probes range from about 8 to about 100 bases long, with from about 10 to about 80 bases being preferred, and from about 30 to about 50 bases being particularly preferred. That is, generally whole genes are not used. In some embodiments, much longer nucleic acids can be used, up to hundreds of bases.

In a preferred embodiment, more than one probe per sequence is used, with either overlapping probes or probes to different sections of the target being used. That is, two, three, four or more probes, with three being preferred, are used to build in a redundancy for a particular target. The probes can be overlapping (i.e. have some sequence in common), or separate.

As will be appreciated by those in the art, nucleic acids can be attached or immobilized to a solid support in a wide variety of ways. By "immobilized" and grammatical equivalents herein is meant the association or binding between the nucleic acid probe and the solid support is sufficient to be stable under the conditions of binding, washing, analysis, and removal as outlined below. The binding can be covalent or non-covalent. By "non-covalent binding" and grammatical equivalents herein is meant one or more of either electrostatic, hydrophilic, and hydrophobic interactions. Included in non-covalent binding is the covalent attachment of a molecule, such as, streptavidin to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilization may also involve a combination of covalent and non-covalent interactions.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid substrate. By "substrate" or "solid support" or other grammatical equivalents herein is meant any material that can be modified to contain discrete individual sites appropriate for the attachment or association of the nucleic acid probes and is amenable to at least one detection method. As will be appreciated by those in the art, the number of possible substrates are very large, and include, but are not limited to, glass and modified or functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, resins, silica or silica-based materials including silicon and modified silicon, carbon, metals, inorganic glasses, etc. In general, the substrates allow optical detection and do not appreciably fluoresce.

In a preferred embodiment, the surface of the biochip and the probe may be derivatized with chemical functional groups for subsequent attachment of the two. Thus, for example, the biochip is derivatized with a chemical functional group including, but not limited to, amino groups, carboxy groups, oxo groups and thiol groups, with amino groups being particularly preferred. Using these functional groups, the probes can be attached using functional groups on the probes. For example, nucleic acids containing amino groups can be attached to surfaces comprising amino groups, for example using linkers as are known in the art; for example, homo- or hetero-bifunctional linkers as are well known (see 1994 Pierce Chemical Company catalog, technical section on cross-linkers, pages 155-200, incorporated herein by reference). In addition, in some cases, additional linkers, such as alkyl groups (including substituted and heteroalkyl groups) may be used.

In this embodiment, the oligonucleotides are synthesized as is known in the art, and then attached to the surface of the solid support. As will be appreciated by those skilled in the art, either the 5' or 3' terminus may be attached to the solid support, or attachment may be via an internal nucleoside.

In an additional embodiment, the immobilization to the solid support may be very strong, yet non-covalent. For example, biotinylated oligonucleotides can be made, which bind to surfaces covalently coated with streptavidin, resulting in attachment.

Alternatively, the oligonucleotides may be synthesized on the surface, as is known in the art. For example, photoactivation techniques utilizing photopolymerization compounds and techniques are used. In a preferred embodiment, the nucleic acids can be synthesized in situ, using well known photolithographic techniques, such as those described in WO 95/25116; WO 95/35505; U.S. Pat. Nos. 5,700,637 and 5,445,934; and references cited within, all of which are expressly incorporated by reference; these methods of attachment form the basis of the Affymetrix GeneChip technology.

In addition to the solid-phase technology represented by biochip arrays, gene expression can also be quantified using liquid-phase arrays. One such system is kinetic polymerase chain reaction (PCR). Kinetic PCR allows for the simultaneous amplification and quantification of specific nucleic acid sequences. The specificity is derived from synthetic oligonucleotide primers designed to preferentially adhere to single-stranded nucleic acid sequences bracketing the target site. This pair of oligonucleotide primers form specific, non-covalently bound complexes on each strand of the target sequence. These complexes facilitate in vitro transcription of double-stranded DNA in opposite orientations. Temperature cycling of the reaction mixture creates a continuous cycle of primer binding, transcription, and re-melting of the nucleic acid to individual strands. The result is an exponential increase of the target dsDNA product. This product can be quantified in real time either through the use of an intercalating dye or a sequence specific probe. SYBR® Greene I, is an example of an intercalating dye, that preferentially binds to dsDNA resulting in a concomitant increase in the fluorescent signal. Sequence specific probes, such as used with TaqMan® technology, consist of a fluorochrome and a quenching molecule covalently bound to opposite ends of an oligonucleotide. The probe is designed to selectively bind the target DNA sequence between the two primers. When the DNA strands are synthesized during the PCR reaction, the fluorochrome is cleaved from the probe by the exonuclease activity of the polymerase resulting in signal dequenching. The probe signaling method can be more specific than the intercalating dye method, but in each case, signal strength is proportional to the dsDNA product produced. Each type of quantification method can be used in multi-well liquid phase arrays with each well representing primers and/or probes specific to nucleic acid sequences of interest. When used with messenger RNA preparations of tissues or cell lines, and an array of probe/primer reactions can simultaneously quantify the expression of multiple gene products of interest. See Germer, S., et al., Genome Res. 10:258-266 (2000); Heid, C. A., et al., Genome Res. 6, 986-994 (1996).

In a preferred embodiment, CA nucleic acids encoding CA proteins are used to make a variety of expression vectors to express CA proteins which can then be used in screening assays, as described below. The expression vectors may be either self-replicating extrachromosomal vectors or vectors which integrate into a host genome. Generally, these expression vectors include transcriptional and translational regulatory nucleic acid operably linked to the nucleic acid encoding the CA protein. The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, synthetic oligonucleotide adaptors or linkers are used in accordance with conventional practice. The transcriptional and translational regulatory nucleic acid will generally be appropriate to the host cell used to express the CA protein; for example, transcriptional and translational regulatory nucleic acid sequences from *Bacillus* are preferably used to express the CA protein in *Bacillus*. Numerous types of appropriate expression vectors, and suitable regulatory sequences are known in the art for a variety of host cells.

In general, the transcriptional and translational regulatory sequences may include, but are not limited to, promoter sequences, ribosomal binding sites, transcriptional start and stop sequences, translational start and stop sequences, and enhancer or activator sequences. In a preferred embodiment, the regulatory sequences include a promoter and transcriptional start and stop sequences.

Promoter sequences encode either constitutive or inducible promoters. The promoters may be either naturally occurring promoters or hybrid promoters. Hybrid promoters, which combine elements of more than one promoter, are also known in the art, and are useful in the present invention.

In addition, the expression vector may comprise additional elements. For example, the expression vector may have two replication systems, thus allowing it to be maintained in two organisms, for example in mammalian or insect cells for expression and in a procaryotic host for cloning and amplification. Furthermore, for integrating expression vectors, the expression vector contains at least one sequence homologous to the host cell genome, and preferably two homologous sequences which flank the expression construct. The integrating vector may be directed to a specific locus in the host cell by selecting the appropriate homologous sequence for inclusion in the vector. Constructs for integrating vectors are well known in the art.

In addition, in a preferred embodiment, the expression vector contains a selectable marker gene to allow the selection of transformed host cells. Selection genes are well known in the art and will vary with the host cell used.

The CA proteins of the present invention are produced by culturing a host cell transformed with an expression vector containing nucleic acid encoding an CA protein, under the appropriate conditions to induce or cause expression of the CA protein. The conditions appropriate for CA protein expression will vary with the choice of the expression vector and the host cell, and will be easily ascertained by one skilled in the art through routine experimentation. For example, the use of constitutive promoters in the expression vector will require optimizing the growth and proliferation of the host cell, while the use of an inducible promoter requires the appropriate growth conditions for induction. In addition, in some embodiments, the timing of the harvest is important. For example, the baculoviral systems used in insect cell expression are lytic viruses, and thus harvest time selection can be crucial for product yield.

Appropriate host cells include yeast, bacteria, archaebacteria, fungi, and insect, plant and animal cells, including mammalian cells. Of particular interest are *Drosophila melanogaster* cells, *Saccharomyces cerevisiae* and other yeasts, *E. coli, Bacillus subtilis*, Sf9 cells, C129 cells, 293 cells, *Neurospora*, BHK, CHO, COS, HeLa cells, THP1 cell line (a macrophage cell line) and human cells and cell lines.

In a preferred embodiment, the CA proteins are expressed in mammalian cells. Mammalian expression systems are also known in the art, and include retroviral systems. A preferred expression vector system is a retroviral vector system such as is generally described in PCT/US97/01019 and PCT/US97/01048, both of which are hereby expressly incorporated by reference. Of particular use as mammalian promoters are the promoters from mammalian viral genes, since the viral genes are often highly expressed and have a broad host range. Examples include the SV40 early promoter, mouse mammary tumor virus LTR promoter, adenovirus major late promoter, herpes simplex virus promoter, and the CMV promoter. Typically, transcription termination and polyadenylation sequences recognized by mammalian cells are regulatory regions located 3' to the translation stop codon and thus, together with the promoter elements, flank the coding sequence. Examples of transcription terminator and polyadenlytion signals include those derived form SV40.

The methods of introducing exogenous nucleic acid into mammalian hosts, as well as other hosts, is well known in the art, and will vary with the host cell used. Techniques include dextran-mediated transfection, calcium phosphate precipitation, polybrene mediated transfection, protoplast fusion, electroporation, viral infection, encapsulation of the polynucleotide(s) in liposomes, and direct microinjection of the DNA into nuclei.

In a preferred embodiment, CA proteins are expressed in bacterial systems. Bacterial expression systems are well known in the art. Promoters from bacteriophage may also be used and are known in the art. In addition, synthetic promoters and hybrid promoters are also useful; for example, the tac promoter is a hybrid of the trp and lac promoter sequences. Furthermore, a bacterial promoter can include naturally occurring promoters of non-bacterial origin that have the ability to bind bacterial RNA polymerase and initiate transcription. In addition to a functioning promoter sequence, an efficient ribosome binding site is desirable. The expression vector may also include a signal peptide sequence that provides for secretion of the CA protein in bacteria. The protein is either secreted into the growth media (gram-positive bacteria) or into the periplasmic space, located between the inner and outer membrane of the cell (gram-negative bacteria). The bacterial expression vector may also include a selectable marker gene to allow for the selection of bacterial strains that have been transformed. Suitable selection genes include genes which render the bacteria resistant to drugs such as ampicillin, chloramphenicol, erythromycin, kanamycin, neomycin and tetracycline. Selectable markers also include biosynthetic genes, such as those in the histidine, tryptophan and leucine biosynthetic pathways. These components are assembled into expression vectors. Expression vectors for bacteria are well known in the art, and include vectors for *Bacillus subtilis, E. coli, Streptococcus cremoris*, and *Streptococcus lividans*, among others. The bacterial expression vectors are transformed into bacterial host cells using techniques well known in the art, such as calcium chloride treatment, electroporation, and others.

In one embodiment, CA proteins are produced in insect cells. Expression vectors for the transformation of insect cells, and in particular, baculovirus-based expression vectors, are well known in the art.

In a preferred embodiment, CA protein is produced in yeast cells. Yeast expression systems are well known in the art, and include expression vectors for *Saccharomyces cerevisiae, Candida albicans* and *C. maltosa, Hansenula polymorpha, Kluyveromyces fragilis* and *K. lactis, Pichia guillerimondii* and *P. pastoris, Schizosaccharomyces pombe*, and *Yarrowia lipolytica*.

The CA protein may also be made as a fusion protein, using techniques well known in the art. Thus, for example, for the creation of monoclonal antibodies. If the desired epitope is small, the CA protein may be fused to a carrier protein to form an immunogen. Alternatively, the CA protein may be made as a fusion protein to increase expression, or for other reasons. For example, when the CA protein is an CA peptide, the nucleic acid encoding the peptide may be linked to other nucleic acid for expression purposes.

In one embodiment, the CA nucleic acids, proteins and antibodies of the invention are labeled. By "labeled" herein is meant that a compound has at least one element, isotope or chemical compound attached to enable the detection of the compound. In general, labels fall into three classes: a) isotopic labels, which may be radioactive or heavy isotopes; b)

immune labels, which may be antibodies or antigens; and c) colored or fluorescent dyes. The labels may be incorporated into the CA nucleic acids, proteins and antibodies at any position. For example, the label should be capable of producing, either directly or indirectly, a detectable signal. The detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the label may be employed, including those methods described by Hunter et al., Nature, 144:945 (1962); David et al., Biochemistry, 13:1014 (1974); Pain et al., J. Immunol. Meth., 40:219 (1981); and Nygren, J. Histochem. and Cytochem., 30:407 (1982).

Accordingly, the present invention also provides CA protein sequences. An CA protein of the present invention may be identified in several ways. "Protein" in this sense includes proteins, polypeptides, and peptides. As will be appreciated by those in the art, the nucleic acid sequences of the invention can be used to generate protein sequences. There are a variety of ways to do this, including cloning the entire gene and verifying its frame and amino acid sequence, or by comparing it to known sequences to search for homology to provide a frame, assuming the CA protein has homology to some protein in the database being used. Generally, the nucleic acid sequences are input into a program that will search all three frames for homology. This is done in a preferred embodiment using the following NCBI Advanced BLAST parameters. The program is blastx or blastn. The database is nr. The input data is as "Sequence in FASTA format". The organism list is "none". The "expect" is 10; the filter is default. The "descriptions" is 500, the "alignments" is 500, and the "alignment view" is pairwise. The "query Genetic Codes" is standard (1). The matrix is BLOSUM62; gap existence cost is 11, per residue gap cost is 1; and the lambda ratio is 0.85 default. This results in the generation of a putative protein sequence.

Also included within one embodiment of CA proteins are amino acid variants of the naturally occurring sequences, as determined herein. Preferably, the variants are preferably greater than about 75% homologous to the wild-type sequence, more preferably greater than about 80%, even more preferably greater than about 85% and most preferably greater than about 90%. In some embodiments the homology will be as high as about 93 to 95 or 98%. As for nucleic acids, homology in this context means sequence similarity or identity, with identity being preferred. This homology will be determined using standard techniques known in the art as are outlined above for the nucleic acid homologies.

CA proteins of the present invention may be shorter or longer than the wild type amino acid sequences. Thus, in a preferred embodiment, included within the definition of CA proteins are portions or fragments of the wild type sequences herein. In addition, as outlined above, the CA nucleic acids of the invention may be used to obtain additional coding regions, and thus additional protein sequence, using techniques known in the art.

In a preferred embodiment, the CA proteins are derivative or variant CA proteins as compared to the wild-type sequence. That is, as outlined more fully below, the derivative CA peptide will contain at least one amino acid substitution, deletion or insertion, with amino acid substitutions being particularly preferred. The amino acid substitution, insertion or deletion may occur at any residue within the CA peptide.

Also included in an embodiment of CA proteins of the present invention are amino acid sequence variants. These variants fall into one or more of three classes: substitutional, insertional or deletional variants. These variants ordinarily are prepared by site specific mutagenesis of nucleotides in the DNA encoding the CA protein, using cassette or PCR mutagenesis or other techniques well known in the art, to produce DNA encoding the variant, and thereafter expressing the DNA in recombinant cell culture as outlined above. However, variant CA protein fragments having up to about 100-150 residues may be prepared by in vitro synthesis using established techniques. Amino acid sequence variants are characterized by the predetermined nature of the variation, a feature that sets them apart from naturally occurring allelic or interspecies variation of the CA protein amino acid sequence. The variants typically exhibit the same qualitative biological activity as the naturally occurring analogue, although variants can also be selected which have modified characteristics as will be more fully outlined below.

While the site or region for introducing an amino acid sequence variation is predetermined, the mutation per se need not be predetermined. For example, in order to optimize the performance of a mutation at a given site, random mutagenesis may be conducted at the target codon or region and the expressed CA variants screened for the optimal combination of desired activity. Techniques for making substitution mutations at predetermined sites in DNA having a known sequence are well known, for example, M13 primer mutagenesis and LAR mutagenesis. Screening of the mutants is done using assays of CA protein activities.

Amino acid substitutions are typically of single residues; insertions usually will be on the order of from about 1 to 20 amino acids, although considerably larger insertions may be tolerated. Deletions range from about 1 to about 20 residues, although in some cases deletions may be much larger.

Substitutions, deletions, insertions or any combination thereof may be used to arrive at a final derivative. Generally these changes are done on a few amino acids to minimize the alteration of the molecule. However, larger changes may be tolerated in certain circumstances. When small alterations in the characteristics of the CA protein are desired, substitutions are generally made in accordance with the following chart:

| Chart I | |
|---|---|
| Original Residue | Exemplary Substitutions |
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

Substantial changes in function or immunological identity are made by selecting substitutions that are less conservative than those shown in Chart I. For example, substitutions may be made which more significantly affect: the structure of the polypeptide backbone in the area of the alteration, for example the alpha-helical or beta-sheet structure; the charge or hydrophobicity of the molecule at the target site; or the bulk of the side chain. The substitutions which in general are expected to produce the greatest changes in the polypeptide's properties are those in which (a) a hydrophilic residue, e.g. seryl or threonyl is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine.

The variants typically exhibit the same qualitative biological activity and will elicit the same immune response as the naturally-occurring analogue, although variants also are selected to modify the characteristics of the CA proteins as needed. Alternatively, the variant may be designed such that the biological activity of the CA protein is altered. For example, glycosylation sites may be altered or removed, dominant negative mutations created, etc.

Covalent modifications of CA polypeptides are included within the scope of this invention, for example for use in screening. One type of covalent modification includes reacting targeted amino acid residues of an CA polypeptide with an organic derivatizing agent that is capable of reacting with selected side chains or the N- or C-terminal residues of an CA polypeptide. Derivatization with bifunctional agents is useful, for instance, for crosslinking CA polypeptides to a water-insoluble support matrix or surface for use in the method for purifying anti-CA antibodies or screening assays, as is more fully described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl, threonyl or tyrosyl residues, methylation of the a-amino groups of lysine, arginine, and histidine side chains [T. E. Creighton, Proteins: Structure and Molecular Properties, W.H. Freeman & Co., San Francisco, pp. 79-86 (1983)], acetylation of the N-terminal amine, and amidation of any C-terminal carboxyl group.

Another type of covalent modification of the CA polypeptide included within the scope of this invention comprises altering the native glycosylation pattern of the polypeptide. "Altering the native glycosylation pattern" is intended for purposes herein to mean deleting one or more carbohydrate moieties found in native sequence CA polypeptide, and/or adding one or more glycosylation sites that are not present in the native sequence CA polypeptide.

Addition of glycosylation sites to CA polypeptides may be accomplished by altering the amino acid sequence thereof. The alteration may be made, for example, by the addition of, or substitution by, one or more serine or threonine residues to the native sequence CA polypeptide (for O-linked glycosylation sites). The CA amino acid sequence may optionally be altered through changes at the DNA level, particularly by mutating the DNA encoding the CA polypeptide at preselected bases such that codons are generated that will translate into the desired amino acids.

Another means of increasing the number of carbohydrate moieties on the CA polypeptide is by chemical or enzymatic coupling of glycosides to the polypeptide. Such methods are described in the art, e.g., in WO 87/05330 published Sep. 11, 1987, and in Aplin and Wriston, L A Crit. Rev. Biochem., pp. 259-306 (1981).

Removal of carbohydrate moieties present on the CA polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., Arch. Biochem. Biophys., 259:52 (1987) and by Edge et al., Anal. Biochem., 118:131 (1981). Enzymatic cleavage of carbohydrate moieties on polypeptides can be achieved by the use of a variety of endo- and exo-glycosidases as described by Thotakura et al., Meth. Enzymol., 138:350 (1987).

Another type of covalent modification of CA comprises linking the CA polypeptide to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192 or 4,179,337.

CA polypeptides of the present invention may also be modified in a way to form chimeric molecules comprising an CA polypeptide fused to another, heterologous polypeptide or amino acid sequence. In one embodiment, such a chimeric molecule comprises a fusion of an CA polypeptide with a tag polypeptide which provides an epitope to which an anti-tag antibody can selectively bind. The epitope tag is generally placed at the amino- or carboxyl-terminus of the CA polypeptide, although internal fusions may also be tolerated in some instances. The presence of such epitope-tagged forms of an CA polypeptide can be detected using an antibody against the tag polypeptide. Also, provision of the epitope tag enables the CA polypeptide to be readily purified by affinity purification using an anti-tag antibody or another type of affinity matrix that binds to the epitope tag. In an alternative embodiment, the chimeric molecule may comprise a fusion of an CA polypeptide with an immunoglobulin or a particular region of an immunoglobulin. For a bivalent form of the chimeric molecule, such a fusion could be to the Fc region of an IgG molecule.

Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., Mol. Cell. Biol., 8:2159-2165 (1988)]; the c-myc tag and the 8F9, 3C7, 6E10, G4, B7 and 9E10 antibodies thereto [Evan et al., Molecular and Cellular Biology, 5:3610-3616 (1985)]; and the Herpes Simplex virus glycoprotein D (gD) tag and its antibody [Paborsky et al., Protein Engineering, 3(6):547-553 (1990)]. Other tag polypeptides include the Flag-peptide [Hopp et al., BioTechnology, 6:1204-1210 (1988)]; the KT3 epitope peptide [Martin et al., Science, 255:192-194 (1992)]; tubulin epitope peptide [Skinner et al., J. Biol. Chem., 266: 15163-15166 (1991)]; and the T7 gene 10 protein peptide tag [Lutz-Freyermuth et al., Proc. Natl. Acad. Sci. USA, 87:6393-6397 (1990)].

Also included with the definition of CA protein in one embodiment are other CA proteins of the CA family, and CA proteins from other organisms, which are cloned and expressed as outlined below. Thus, probe or degenerate polymerase chain reaction (PCR) primer sequences may be used to find other related CA proteins from humans or other organisms. As will be appreciated by those in the art, particularly useful probe and/or PCR primer sequences include the unique areas of the CA nucleic acid sequence. As is generally known in the art, preferred PCR primers are from about 15 to about 35 nucleotides in length, with from about 20 to about 30 being preferred, and may contain inosine as needed. The conditions for the PCR reaction are well known in the art.

In addition, as is outlined herein, CA proteins can be made that are longer than those encoded by the nucleic acids of the figures, for example, by the elucidation of additional sequences, the addition of epitope or purification tags, the addition of other fusion sequences, etc.

CA proteins may also be identified as being encoded by CA nucleic acids. Thus, CA proteins are encoded by nucleic acids that will hybridize to the sequences of the sequence listings, or their complements, as outlined herein.

In a preferred embodiment, the invention provides CA antibodies. In a preferred embodiment, when the CA protein is to be used to generate antibodies, for example for immunotherapy, the CA protein should share at least one epitope or determinant with the full length protein. By "epitope" or "determinant" herein is meant a portion of a protein which will generate and/or bind an antibody or T-cell receptor in the context of MHC. Thus, in most instances, antibodies made to a smaller CA protein will be able to bind to the full length protein. In a preferred embodiment, the epitope is unique; that is, antibodies generated to a unique epitope show little or no cross-reactivity.

In one embodiment, the term "antibody" includes antibody fragments, as are known in the art, including Fab, $Fab_2$, single chain antibodies (Fv for example), chimeric antibodies, etc., either produced by the modification of whole antibodies or those synthesized de novo using recombinant DNA technologies.

Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include a protein encoded by a nucleic acid of the figures or fragment thereof or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

The antibodies may, alternatively, be monoclonal antibodies. Monoclonal antibodies may be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro. The immunizing agent will typically include a polypeptide encoded by a nucleic acid of Table 1 06-001 to 06-343, or fragment thereof or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, Monoclonal Antibodies: Principles and Practice, Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

In one embodiment, the antibodies are bispecific antibodies. Bispecific antibodies are monoclonal, preferably human or humanized, antibodies that have binding specificities for at least two different antigens. In the present case, one of the binding specificities is for a protein encoded by a nucleic acid of Table 1 06-001 to 06-343, or a fragment thereof, the other one is for any other antigen, and preferably for a cell-surface protein or receptor or receptor subunit, preferably one that is tumor specific.

In a preferred embodiment, the antibodies to CA are capable of reducing or eliminating the biological function of CA, as is described below. That is, the addition of anti-CA antibodies (either polyclonal or preferably monoclonal) to CA (or cells containing CA) may reduce or eliminate the CA activity. Generally, at least a 25% decrease in activity is preferred, with at least about 50% being particularly preferred and about a 95-100% decrease being especially preferred.

In a preferred embodiment the antibodies to the CA proteins are humanized antibodies. Humanized forms of non-human (e.g., murine) antibodies are chimeric molecules of immunoglobulins, immunoglobulin chains or fragments thereof (such as Fv, Fab, Fab', $F(ab')_2$ or other antigen binding subsequences of antibodies) which contain minimal sequence derived from non-human immunoglobulin. Humanized antibodies include human immunoglobulins (recipient antibody) in which residues form a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework residues (FR) regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature, 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies [Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10, 779-783 (1992); Lonberg et al., Nature 368 856-859 (1994); Morrison, Nature 368, 812-13 (1994); Fishwild et al., Nature Biotechnology 14, 845-51 (1996); Neuberger, Nature Biotechnology 14, 826 (1996); Lonberg and Huszar, Intern. Rev. Immunol. 13 65-93 (1995).

By immunotherapy is meant treatment of a carcinoma with an antibody raised against an CA protein. As used herein, immunotherapy can be passive or active. Passive immunotherapy as defined herein is the passive transfer of antibody to a recipient (patient). Active immunization is the induction of antibody and/or T-cell responses in a recipient (patient). Induction of an immune response is the result of providing the recipient with an antigen to which antibodies are raised. As appreciated by one of ordinary skill in the art, the antigen may be provided by injecting a polypeptide against which antibodies are desired to be raised into a recipient, or contacting the recipient with a nucleic acid capable of expressing the antigen and under conditions for expression of the antigen.

In a preferred embodiment, oncogenes which encode secreted growth factors may be inhibited by raising antibodies against CA proteins that are secreted proteins as described above. Without being bound by theory, antibodies used for treatment, bind and prevent the secreted protein from binding to its receptor, thereby inactivating the secreted CA protein.

In another preferred embodiment, the CA protein to which antibodies are raised is a transmembrane protein. Without being bound by theory, antibodies used for treatment, bind the extracellular domain of the CA protein and prevent it from binding to other proteins, such as circulating ligands or cell-associated molecules. The antibody may cause down-regulation of the transmembrane CA protein. As will be appreciated by one of ordinary skill in the art, the antibody may be a competitive, non-competitive or uncompetitive inhibitor of protein binding to the extracellular domain of the CA protein. The antibody is also an antagonist of the CA protein. Further, the antibody prevents activation of the transmembrane CA protein. In one aspect, when the antibody prevents the binding of other molecules to the CA protein, the antibody prevents growth of the cell. The antibody may also sensitize the cell to cytotoxic agents, including, but not limited to TNF-α, TNF-β, IL-1, INF-γ and IL-2, or chemotherapeutic agents including 5FU, vinblastine, actinomycin D, cisplatin, methotrexate, and the like. In some instances the antibody belongs to a sub-type that activates serum complement when complexed with the transmembrane protein thereby mediating cytotoxicity. Thus, carcinomas may be treated by administering to a patient antibodies directed against the transmembrane CA protein.

In another preferred embodiment, the antibody is conjugated to a therapeutic moiety. In one aspect the therapeutic moiety is a small molecule that modulates the activity of the CA protein. In another aspect the therapeutic moiety modulates the activity of molecules associated with or in close proximity to the CA protein. The therapeutic moiety may inhibit enzymatic activity such as protease or protein kinase activity associated with carcinoma.

In a preferred embodiment, the therapeutic moiety may also be a cytotoxic agent. In this method, targeting the cytotoxic agent to tumor tissue or cells, results in a reduction in the number of afflicted cells, thereby reducing symptoms associated with carcinomas, including lymphoma. Cytotoxic agents are numerous and varied and include, but are not limited to, cytotoxic drugs or toxins or active fragments of such toxins. Suitable toxins and their corresponding fragments include diphtheria A chain, exotoxin A chain, ricin A chain, abrin A chain, curcin, crotin, phenomycin, enomycin and the like. Cytotoxic agents also include radiochemicals made by conjugating radioisotopes to antibodies raised against CA proteins, or binding of a radionuclide to a chelating agent that has been covalently attached to the antibody. Targeting the therapeutic moiety to transmembrane CA proteins not only serves to increase the local concentration of therapeutic moiety in the carcinoma of interest, i.e., lymphoma, but also serves to reduce deleterious side effects that may be associated with the therapeutic moiety.

In another preferred embodiment, the CA protein against which the antibodies are raised is an intracellular protein. In this case, the antibody may be conjugated to a protein which facilitates entry into the cell. In one case, the antibody enters the cell by endocytosis. In another embodiment, a nucleic acid encoding the antibody is administered to the individual or cell. Moreover, wherein the CA protein can be targeted within a cell, i.e., the nucleus, an antibody thereto contains a signal for that target localization, i.e., a nuclear localization signal.

The CA antibodies of the invention specifically bind to CA proteins. By "specifically bind" herein is meant that the antibodies bind to the protein with a binding constant in the range of at least $10^{-4}$-$10^{-6}$ M$^{-1}$, with a preferred range being $10^{-7}$-$10^{-9}$ M$^{-1}$.

In a preferred embodiment, the CA protein is purified or isolated after expression. CA proteins may be isolated or purified in a variety of ways known to those skilled in the art depending on what other components are present in the sample. Standard purification methods include electrophoretic, molecular, immunological and chromatographic techniques, including ion exchange, hydrophobic, affinity, and reverse-phase HPLC chromatography, and chromatofocusing. For example, the CA protein may be purified using a standard anti-CA antibody column. Ultrafiltration and diafiltration techniques, in conjunction with protein concentration, are also useful. For general guidance in suitable purification techniques, see Scopes, R., Protein Purification, Springer-Verlag, N.Y. (1982). The degree of purification necessary will vary depending on the use of the CA protein. In some instances no purification will be necessary.

Once expressed and purified if necessary, the CA proteins and nucleic acids are useful in a number of applications.

In one aspect, the expression levels of genes are determined for different cellular states in the carcinoma phenotype; that is, the expression levels of genes in normal tissue and in carcinoma tissue (and in some cases, for varying severities of lymphoma that relate to prognosis, as outlined below) are evaluated to provide expression profiles. An expression profile of a particular cell state or point of development is essentially a "fingerprint" of the state; while two states may have any particular gene similarly expressed, the evaluation of a number of genes simultaneously allows the generation of a gene expression profile that is unique to the state of the cell. By comparing expression profiles of cells in different states, information regarding which genes are important (including both up- and down-regulation of genes) in each of these states is obtained. Then, diagnosis may be done or confirmed: does tissue from a particular patient have the gene expression profile of normal or carcinoma tissue.

"Differential expression," or grammatical equivalents as used herein, refers to both qualitative as well as quantitative differences in the genes temporal and/or cellular expression patterns within and among the cells. Thus, a differentially expressed gene can qualitatively have its expression altered, including an activation or inactivation, in, for example, normal versus carcinoma tissue. That is, genes may be turned on or turned off in a particular state, relative to another state. As is apparent to the skilled artisan, any comparison of two or more states can be made. Such a qualitatively regulated gene will exhibit an expression pattern within a state or cell type which is detectable by standard techniques in one such state or cell type, but is not detectable in both. Alternatively, the determination is quantitative in that expression is increased or decreased; that is, the expression of the gene is either upregulated, resulting in an increased amount of transcript, or downregulated, resulting in a decreased amount of transcript. The degree to which expression differs need only be large enough to quantify via standard characterization techniques as outlined below, such as by use of Affymetrix GeneChip® expression arrays, Lockhart, Nature Biotechnology, 14:1675-1680 (1996), hereby expressly incorporated by reference. Other techniques include, but are not limited to, quantitative reverse transcriptase PCR, Northern analysis and RNase protection. As outlined above, preferably the change in expression (i.e. upregulation or downregulation) is at least about 50%, more preferably at least about 100%, more preferably at least about 150%, more preferably, at least about 200%, with from 300 to at least 1000% being especially preferred.

As will be appreciated by those in the art, this may be done by evaluation at either the gene transcript, or the protein level; that is, the amount of gene expression may be monitored using nucleic acid probes to the DNA or RNA equivalent of the gene transcript, and the quantification of gene expression levels, or, alternatively, the final gene product itself (protein) can be monitored, for example through the use of antibodies to the CA protein and standard immunoassays (ELISAs, etc.) or other techniques, including mass spectroscopy assays, 2D gel electrophoresis assays, etc. Thus, the proteins corresponding to CA genes, i.e. those identified as being important in a particular carcinoma phenotype, i.e., lymphoma, can be evaluated in a diagnostic test specific for that carcinoma.

In a preferred embodiment, gene expression monitoring is done and a number of genes, i.e. an expression profile, is monitored simultaneously, although multiple protein expression monitoring can be done as well. Similarly, these assays may be done on an individual basis as well.

In this embodiment, the CA nucleic acid probes may be attached to biochips as outlined herein for the detection and quantification of CA sequences in a particular cell. The assays are done as is known in the art. As will be appreciated by those in the art, any number of different CA sequences may be used as probes, with single sequence assays being used in some cases, and a plurality of the sequences described herein being used in other embodiments. In addition, while solid-phase assays are described, any number of solution based assays may be done as well.

In a preferred embodiment, both solid and solution based assays may be used to detect CA sequences that are up-regulated or down-regulated in carcinomas as compared to normal tissue. In instances where the CA sequence has been altered but shows the same expression profile or an altered expression profile, the protein will be detected as outlined herein.

In a preferred embodiment nucleic acids encoding the CA protein are detected. Although DNA or RNA encoding the CA protein may be detected, of particular interest are methods wherein the mRNA encoding a CA protein is detected. The presence of mRNA in a sample is an indication that the CA gene has been transcribed to form the mRNA, and suggests that the protein is expressed. Probes to detect the mRNA can be any nucleotide/deoxynucleotide probe that is complementary to and base pairs with the mRNA and includes but is not limited to oligonucleotides, cDNA or RNA. Probes also should contain a detectable label, as defined herein. In one method the mRNA is detected after immobilizing the nucleic acid to be examined on a solid support such as nylon membranes and hybridizing the probe with the sample. Following washing to remove the non-specifically bound probe, the label is detected. In another method detection of the mRNA is performed in situ. In this method permeabilized cells or tissue samples are contacted with a detectably labeled nucleic acid probe for sufficient time to allow the probe to hybridize with the target mRNA. Following washing to remove the non-specifically bound probe, the label is detected. For example a digoxygenin labeled riboprobe (RNA probe) that is complementary to the mRNA encoding a CA protein is detected by binding the digoxygenin with an anti-digoxygenin secondary antibody and developed with nitro blue tetrazolium and 5-bromo-4-chloro-3-indoyl phosphate.

In a preferred embodiment, any of the three classes of proteins as described herein (secreted, transmembrane or intracellular proteins) are used in diagnostic assays. The CA proteins, antibodies, nucleic acids, modified proteins and cells containing CA sequences are used in diagnostic assays. This can be done on an individual gene or corresponding polypeptide level, or as sets of assays.

As described and defined herein, CA proteins find use as markers of carcinomas, including lymphomas such as, but not limited to, Hodgkin's and non-Hodgkin lymphoma. Detection of these proteins in putative carcinoma tissue or patients allows for a determination or diagnosis of the type of carcinoma. Numerous methods known to those of ordinary skill in the art find use in detecting carcinomas. In one embodiment, antibodies are used to detect CA proteins. A preferred method separates proteins from a sample or patient by electrophoresis on a gel (typically a denaturing and reducing protein gel, but may be any other type of gel including isoelectric focusing gels and the like). Following separation of proteins, the CA protein is detected by immunoblotting with antibodies raised against the CA protein. Methods of immunoblotting are well known to those of ordinary skill in the art.

In another preferred method, antibodies to the CA protein find use in in situ imaging techniques. In this method cells are contacted with from one to many antibodies to the CA protein(s). Following washing to remove non-specific antibody binding, the presence of the antibody or antibodies is detected. In one embodiment the antibody is detected by incubating with a secondary antibody that contains a detectable label. In another method the primary antibody to the CA protein(s) contains a detectable label. In another preferred embodiment each one of multiple primary antibodies contains a distinct and detectable label. This method finds particular use in simultaneous screening for a plurality of CA proteins. As will be appreciated by one of ordinary skill in the art, numerous other histological imaging techniques are useful in the invention.

In a preferred embodiment the label is detected in a fluorometer which has the ability to detect and distinguish emissions of different wavelengths. In addition, a fluorescence activated cell sorter (FACS) can be used in the method.

In another preferred embodiment, antibodies find use in diagnosing carcinomas from blood samples. As previously described, certain CA proteins are secreted/circulating molecules. Blood samples, therefore, are useful as samples to be probed or tested for the presence of secreted CA proteins. Antibodies can be used to detect the CA proteins by any of the previously described immunoassay techniques including ELISA, immunoblotting (Western blotting), immunoprecipitation, BIACORE technology and the like, as will be appreciated by one of ordinary skill in the art.

In a preferred embodiment, in situ hybridization of labeled CA nucleic acid probes to tissue arrays is done. For example, arrays of tissue samples, including CA tissue and/or normal tissue, are made. In situ hybridization as is known in the art can then be done.

It is understood that when comparing the expression fingerprints between an individual and a standard, the skilled artisan can make a diagnosis as well as a prognosis. It is further understood that the genes which indicate the diagnosis may differ from those which indicate the prognosis.

In a preferred embodiment, the CA proteins, antibodies, nucleic acids, modified proteins and cells containing CA sequences are used in prognosis assays. As above, gene expression profiles can be generated that correlate to carcinoma, especially lymphoma, severity, in terms of long term prognosis. Again, this may be done on either a protein or gene level, with the use of genes being preferred. As above, the CA probes are attached to biochips for the detection and quantification of CA sequences in a tissue or patient. The assays proceed as outlined for diagnosis.

In a preferred embodiment, any of the CA sequences as described herein are used in drug screening assays. The CA proteins, antibodies, nucleic acids, modified proteins and cells containing CA sequences are used in drug screening assays or by evaluating the effect of drug candidates on a "gene expression profile" or expression profile of polypeptides. In one embodiment, the expression profiles are used, preferably in conjunction with high throughput screening techniques to allow monitoring for expression profile genes after treatment with a candidate agent, Zlokarnik, et al., Science 279, 84-8 (1998), Heid, et al., Genome Res., 6:986-994 (1996).

In a preferred embodiment, the CA proteins, antibodies, nucleic acids, modified proteins and cells containing the native or modified CA proteins are used in screening assays. That is, the present invention provides novel methods for screening for compositions which modulate the carcinoma phenotype. As above, this can be done by screening for modulators of gene expression or for modulators of protein activity. Similarly, this may be done on an individual gene or protein level or by evaluating the effect of drug candidates on a "gene expression profile". In a preferred embodiment, the expression profiles are used, preferably in conjunction with high throughput screening techniques to allow monitoring for expression profile genes after treatment with a candidate agent, see Zlokarnik, supra.

Having identified the CA genes herein, a variety of assays to evaluate the effects of agents on gene expression may be executed. In a preferred embodiment, assays may be run on an individual gene or protein level. That is, having identified a particular gene as aberrantly regulated in carcinoma, candidate bioactive agents may be screened to modulate the genes response. "Modulation" thus includes both an increase and a decrease in gene expression or activity. The preferred amount of modulation will depend on the original change of the gene expression in normal versus tumor tissue, with changes of at least 10%, preferably 50%, more preferably 100-300%, and in some embodiments 300-1000% or greater. Thus, if a gene exhibits a 4 fold increase in tumor compared to normal tissue, a decrease of about four fold is desired; a 10 fold decrease in tumor compared to normal tissue gives a 10 fold increase in expression for a candidate agent is desired, etc. Alternatively, where the CA sequence has been altered but shows the same expression profile or an altered expression profile, the protein will be detected as outlined herein.

As will be appreciated by those in the art, this may be done by evaluation at either the gene or the protein level; that is, the amount of gene expression may be monitored using nucleic acid probes and the quantification of gene expression levels, or, alternatively, the level of the gene product itself can be monitored, for example through the use of antibodies to the CA protein and standard immunoassays. Alternatively, binding and bioactivity assays with the protein may be done as outlined below.

In a preferred embodiment, gene expression monitoring is done and a number of genes, i.e. an expression profile, is monitored simultaneously, although multiple protein expression monitoring can be done as well.

In this embodiment, the CA nucleic acid probes are attached to biochips as outlined herein for the detection and quantification of CA sequences in a particular cell. The assays are further described below.

Generally, in a preferred embodiment, a candidate bioactive agent is added to the cells prior to analysis. Moreover, screens are provided to identify a candidate bioactive agent which modulates a particular type of carcinoma, modulates CA proteins, binds to a CA protein, or interferes between the binding of a CA protein and an antibody.

The term "candidate bioactive agent" or "drug candidate" or grammatical equivalents as used herein describes any molecule, e.g., protein, oligopeptide, small organic or inorganic molecule, polysaccharide, polynucleotide, etc., to be tested for bioactive agents that are capable of directly or indirectly altering either the carcinoma phenotype, binding to and/or modulating the bioactivity of an CA protein, or the expression of a CA sequence, including both nucleic acid sequences and protein sequences. In a particularly preferred embodiment, the candidate agent suppresses a CA phenotype, for example to a normal tissue fingerprint. Similarly, the candidate agent preferably suppresses a severe CA phenotype. Generally a plurality of assay mixtures are run in parallel with different agent concentrations to obtain a differential response to the various concentrations. Typically, one of these concentrations serves as a negative control, i.e., at zero concentration or below the level of detection.

In one aspect, a candidate agent will neutralize the effect of an CA protein. By "neutralize" is meant that activity of a protein is either inhibited or counter acted against so as to have substantially no effect on a cell.

Candidate agents encompass numerous chemical classes, though typically they are organic or inorganic molecules, preferably small organic compounds having a molecular weight of more than 100 and less than about 2,500 daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof. Particularly preferred are peptides.

Candidate agents are obtained from a wide variety of sources including libraries of synthetic or natural compounds. For example, numerous means are available for random and directed synthesis of a wide variety of organic compounds and biomolecules, including expression of randomized oligonucleotides. Alternatively, libraries of natural compounds in the form of bacterial, fungal, plant and animal extracts are available or readily produced. Additionally, natural or synthetically produced libraries and compounds are readily modified through conventional chemical, physical and biochemical means. Known pharmacological agents may be subjected to directed or random chemical modifications, such as acylation, alkylation, esterification, amidification to produce structural analogs.

In a preferred embodiment, the candidate bioactive agents are proteins. By "protein" herein is meant at least two covalently attached amino acids, which includes proteins, polypeptides, oligopeptides and peptides. The protein may be made up of naturally occurring amino acids and peptide bonds, or synthetic peptidomimetic structures. Thus "amino acid", or "peptide residue", as used herein means both naturally occurring and synthetic amino acids. For example, homo-phenylalanine, citrulline and noreleucine are considered amino acids for the purposes of the invention. "Amino acid" also includes imino acid residues such as proline and hydroxyproline. The side chains may be in either the (R) or the (S) configuration. In the preferred embodiment, the amino acids are in the (S) or L-configuration. If non-naturally occurring side chains are used, non-amino acid substituents may be used, for example to prevent or retard in vivo degradations.

In a preferred embodiment, the candidate bioactive agents are naturally occurring proteins or fragments of naturally occurring proteins. Thus, for example, cellular extracts containing proteins, or random or directed digests of proteinaceous cellular extracts, may be used. In this way libraries of procaryotic and eucaryotic proteins may be made for screening in the methods of the invention. Particularly preferred in this embodiment are libraries of bacterial, fungal, viral, and mammalian proteins, with the latter being preferred, and human proteins being especially preferred.

In a preferred embodiment, the candidate bioactive agents are peptides of from about 5 to about 30 amino acids, with from about 5 to about 20 amino acids being preferred, and from about 7 to about 15 being particularly preferred. The peptides may be digests of naturally occurring proteins as is outlined above, random peptides, or "biased" random peptides. By "randomized" or grammatical equivalents herein is meant that each nucleic acid and peptide consists of essentially random nucleotides and amino acids, respectively. Since generally these random peptides (or nucleic acids, discussed below) are chemically synthesized, they may incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, the library is fully randomized, with no sequence preferences or constants at any position. In a preferred embodiment, the library is biased. That is, some positions within the sequence are either held constant, or are selected from a limited number of possibilities. For example, in a preferred embodiment, the nucleotides or amino acid residues are randomized within a defined class, for example, of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

In a preferred embodiment, the candidate bioactive agents are nucleic acids, as defined above.

As described above generally for proteins, nucleic acid candidate bioactive agents may be naturally occurring nucleic acids, random nucleic acids, or "biased" random nucleic acids. For example, digests of procaryotic or eucaryotic genomes may be used as is outlined above for proteins.

In a preferred embodiment, the candidate bioactive agents are organic chemical moieties, a wide variety of which are available in the literature.

In assays for altering the expression profile of one or more CA genes, after the candidate agent has been added and the cells allowed to incubate for some period of time, the sample containing the target sequences to be analyzed is added to the biochip. If required, the target sequence is prepared using known techniques. For example, the sample may be treated to lyse the cells, using known lysis buffers, electroporation, etc., with purification and/or amplification such as PCR occurring as needed, as will be appreciated by those in the art. For example, an in vitro transcription with labels covalently attached to the nucleosides is done. Generally, the nucleic acids are labeled with a label as defined herein, with biotin-FITC or PE, cy3 and cy5 being particularly preferred.

In a preferred embodiment, the target sequence is labeled with, for example, a fluorescent, chemiluminescent, chemical, or radioactive signal, to provide a means of detecting the target sequence's specific binding to a probe. The label also can be an enzyme, such as, alkaline phosphatase or horseradish peroxidase, which when provided with an appropriate substrate produces a product that can be detected. Alternatively, the label can be a labeled compound or small molecule, such as an enzyme inhibitor, that binds but is not catalyzed or altered by the enzyme. The label also can be a moiety or compound, such as, an epitope tag or biotin which specifically binds to streptavidin.

For the example of biotin, the streptavidin is labeled as described above, thereby, providing a detectable signal for the bound target sequence. As known in the art, unbound labeled streptavidin is removed prior to analysis.

As will be appreciated by those in the art, these assays can be direct hybridization assays or can comprise "sandwich assays", which include the use of multiple probes, as is generally outlined in U.S. Pat. Nos. 5,681,702, 5,597,909, 5,545,730, 5,594,117, 5,591,584, 5,571,670, 5,580,731, 5,571,670, 5,591,584, 5,624,802, 5,635,352, 5,594,118, 5,359,100, 5,124,246 and 5,681,697, all of which are hereby incorporated by reference. In this embodiment, in general, the target nucleic acid is prepared as outlined above, and then added to the biochip comprising a plurality of nucleic acid probes, under conditions that allow the formation of a hybridization complex.

A variety of hybridization conditions may be used in the present invention, including high, moderate and low stringency conditions as outlined above. The assays are generally run under stringency conditions which allows formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc.

These parameters may also be used to control non-specific binding, as is generally outlined in U.S. Pat. No. 5,681,697. Thus it may be desirable to perform certain steps at higher stringency conditions to reduce non-specific binding.

The reactions outlined herein may be accomplished in a variety of ways, as will be appreciated by those in the art. Components of the reaction may be added simultaneously, or sequentially, in any order, with preferred embodiments outlined below. In addition, the reaction may include a variety of other reagents may be included in the assays. These include reagents like salts, buffers, neutral proteins, e.g. albumin, detergents, etc which may be used to facilitate optimal hybridization and detection, and/or reduce non-specific or background interactions. Also reagents that otherwise improve the efficiency of the assay, such as protease inhibitors, nuclease inhibitors, anti-microbial agents, etc., may be used, depending on the sample preparation methods and purity of the target. In addition, either solid phase or solution based (i.e., kinetic PCR) assays may be used.

Once the assay is run, the data is analyzed to determine the expression levels, and changes in expression levels as between states, of individual genes, forming a gene expression profile.

In a preferred embodiment, as for the diagnosis and prognosis applications, having identified the differentially expressed gene(s) or mutated gene(s) important in any one state, screens can be run to alter the expression of the genes individually. That is, screening for modulation of regulation of expression of a single gene can be done. Thus, for example, particularly in the case of target genes whose presence or absence is unique between two states, screening is done for modulators of the target gene expression.

In addition, screens can be done for novel genes that are induced in response to a candidate agent. After identifying a candidate agent based upon its ability to suppress a CA expression pattern leading to a normal expression pattern, or modulate a single CA gene expression profile so as to mimic the expression of the gene from normal tissue, a screen as described above can be performed to identify genes that are specifically modulated in response to the agent. Comparing expression profiles between normal tissue and agent treated CA tissue reveals genes that are not expressed in normal tissue or CA tissue, but are expressed in agent treated tissue. These agent specific sequences can be identified and used by any of the methods described herein for CA genes or proteins. In particular these sequences and the proteins they encode find use in marking or identifying agent treated cells. In addition, antibodies can be raised against the agent induced proteins and used to target novel therapeutics to the treated CA tissue sample.

Thus, in one embodiment, a candidate agent is administered to a population of CA cells, that thus has an associated CA expression profile. By "administration" or "contacting" herein is meant that the candidate agent is added to the cells in such a manner as to allow the agent to act upon the cell, whether by uptake and intracellular action, or by action at the cell surface. In some embodiments, nucleic acid encoding a proteinaceous candidate agent (i.e. a peptide) may be put into a viral construct such as a retroviral construct and added to the cell, such that expression of the peptide agent is accomplished; see PCT US97/01019, hereby expressly incorporated by reference.

Once the candidate agent has been administered to the cells, the cells can be washed if desired and are allowed to incubate under preferably physiological conditions for some period of time. The cells are then harvested and a new gene expression profile is generated, as outlined herein.

Thus, for example, CA tissue may be screened for agents that reduce or suppress the CA phenotype. A change in at least one gene of the expression profile indicates that the agent has an effect on CA activity. By defining such a signature for the CA phenotype, screens for new drugs that alter the phenotype can be devised. With this approach, the drug target need not be known and need not be represented in the original expression screening platform, nor does the level of transcript for the target protein need to change.

In a preferred embodiment, as outlined above, screens may be done on individual genes and gene products (proteins). That is, having identified a particular differentially expressed gene as important in a particular state, screening of modulators of either the expression of the gene or the gene product itself can be done. The gene products of differentially expressed genes are sometimes referred to herein as "CA proteins" or an "CAP". The CAP may be a fragment, or alternatively, be the full length protein to the fragment encoded by the nucleic acids of Table 1 06-001 to 06-343. Preferably, the CAP is a fragment. In another embodiment, the sequences are sequence variants as further described herein.

Preferably, the CAP is a fragment of approximately 14 to 24 amino acids long. More preferably the fragment is a soluble fragment. Preferably, the fragment includes a non-transmembrane region. In a preferred embodiment, the fragment has an N-terminal Cys to aid in solubility. In one embodiment, the c-terminus of the fragment is kept as a free acid and the n-terminus is a free amine to aid in coupling, i.e., to cysteine.

In one embodiment the CA proteins are conjugated to an immunogenic agent as discussed herein. In one embodiment the CA protein is conjugated to BSA.

In a preferred embodiment, screening is done to alter the biological function of the expression product of the CA gene. Again, having identified the importance of a gene in a particular state, screening for agents that bind and/or modulate the biological activity of the gene product can be run as is more fully outlined below.

In a preferred embodiment, screens are designed to first find candidate agents that can bind to CA proteins, and then these agents may be used in assays that evaluate the ability of the candidate agent to modulate the CAP activity and the carcinoma phenotype. Thus, as will be appreciated by those in the art, there are a number of different assays which may be run; binding assays and activity assays.

In a preferred embodiment, binding assays are done. In general, purified or isolated gene product is used; that is, the gene products of one or more CA nucleic acids are made. In general, this is done as is known in the art. For example, antibodies are generated to the protein gene products, and standard immunoassays are run to determine the amount of protein present. Alternatively, cells comprising the CA proteins can be used in the assays.

Thus, in a preferred embodiment, the methods comprise combining a CA protein and a candidate bioactive agent, and determining the binding of the candidate agent to the CA protein. Preferred embodiments utilize the human or mouse CA protein, although other mammalian proteins may also be used, for example for the development of animal models of human disease. In some embodiments, as outlined herein, variant or derivative CA proteins may be used.

Generally, in a preferred embodiment of the methods herein, the CA protein or the candidate agent is non-diffusably bound to an insoluble support having isolated sample receiving areas (e.g. a microtiter plate, an array, etc.). The insoluble supports may be made of any composition to which the compositions can be bound, is readily separated from soluble material, and is otherwise compatible with the overall method of screening. The surface of such supports may be solid or porous and of any convenient shape. Examples of suitable insoluble supports include microtiter plates, arrays, membranes and beads. These are typically made of glass, plastic (e.g., polystyrene), polysaccharides, nylon or nitrocellulose, Teflon™, etc. Microtiter plates and arrays are especially convenient because a large number of assays can be carried out simultaneously, using small amounts of reagents and samples. The particular manner of binding of the composition is not crucial so long as it is compatible with the reagents and overall methods of the invention, maintains the activity of the composition and is nondiffusable. Preferred methods of binding include the use of antibodies (which do not sterically block either the ligand binding site or activation sequence when the protein is bound to the support), direct binding to "sticky" or ionic supports, chemical crosslinking, the synthesis of the protein or agent on the surface, etc. Following binding of the protein or agent, excess unbound material is removed by washing. The sample receiving areas may then be blocked through incubation with bovine serum albumin (BSA), casein or other innocuous protein or other moiety.

In a preferred embodiment, the CA protein is bound to the support, and a candidate bioactive agent is added to the assay. Alternatively, the candidate agent is bound to the support and the CA protein is added. Novel binding agents include specific antibodies, non-natural binding agents identified in screens of chemical libraries, peptide analogs, etc. Of particular interest are screening assays for agents that have a low toxicity for human cells. A wide variety of assays may be used for this purpose, including labeled in vitro protein-protein binding assays, electrophoretic mobility shift assays, immunoassays for protein binding, functional assays (phosphorylation assays, etc.) and the like.

The determination of the binding of the candidate bioactive agent to the CA protein may be done in a number of ways. In a preferred embodiment, the candidate bioactive agent is labeled, and binding determined directly. For example, this may be done by attaching all or a portion of the CA protein to a solid support, adding a labeled candidate agent (for example a fluorescent label), washing off excess reagent, and determining whether the label is present on the solid support. Various blocking and washing steps may be utilized as is known in the art.

By "labeled" herein is meant that the compound is either directly or indirectly labeled with a label which provides a detectable signal, e.g. radioisotope, fluorescers, enzyme, antibodies, particles such as magnetic particles, chemiluminescers, or specific binding molecules, etc. Specific binding molecules include pairs, such as biotin and streptavidin, digoxin and antidigoxin etc. For the specific binding members, the complementary member would normally be labeled with a molecule which provides for detection, in accordance with known procedures, as outlined above. The label can directly or indirectly provide a detectable signal.

In some embodiments, only one of the components is labeled. For example, the proteins (or proteinaceous candidate agents) may be labeled at tyrosine positions using $^{125}$I, or with fluorophores. Alternatively, more than one component may be labeled with different labels; using $^{125}$I for the proteins, for example, and a fluorophor for the candidate agents.

In a preferred embodiment, the binding of the candidate bioactive agent is determined through the use of competitive binding assays. In this embodiment, the competitor is a binding moiety known to bind to the target molecule (i.e. CA protein), such as an antibody, peptide, binding partner, ligand, etc. Under certain circumstances, there may be competitive binding as between the bioactive agent and the binding moiety, with the binding moiety displacing the bioactive agent.

In one embodiment, the candidate bioactive agent is labeled. Either the candidate bioactive agent, or the competitor, or both, is added first to the protein for a time sufficient to allow binding, if present. Incubations may be performed at any temperature which facilitates optimal activity, typically between 4 and 40° C. Incubation periods are selected for optimum activity, but may also be optimized to facilitate rapid high through put screening. Typically between 0.1 and 1 hour will be sufficient. Excess reagent is generally removed or washed away. The second component is then added, and the presence or absence of the labeled component is followed, to indicate binding.

In a preferred embodiment, the competitor is added first, followed by the candidate bioactive agent. Displacement of the competitor is an indication that the candidate bioactive agent is binding to the CA protein and thus is capable of binding to, and potentially modulating, the activity of the CA protein. In this embodiment, either component can be labeled. Thus, for example, if the competitor is labeled, the presence of label in the wash solution indicates displacement by the agent. Alternatively, if the candidate bioactive agent is labeled, the presence of the label on the support indicates displacement.

In an alternative embodiment, the candidate bioactive agent is added first, with incubation and washing, followed by the competitor. The absence of binding by the competitor may indicate that the bioactive agent is bound to the CA protein with a higher affinity. Thus, if the candidate bioactive agent is labeled, the presence of the label on the support, coupled with a lack of competitor binding, may indicate that the candidate agent is capable of binding to the CA protein.

In a preferred embodiment, the methods comprise differential screening to identity bioactive agents that are capable of modulating the activity of the CA proteins. In this embodiment, the methods comprise combining a CA protein and a competitor in a first sample. A second sample comprises a candidate bioactive agent, a CA protein and a competitor. The binding of the competitor is determined for both samples, and a change, or difference in binding between the two samples indicates the presence of an agent capable of binding to the CA protein and potentially modulating its activity. That is, if the binding of the competitor is different in the second sample relative to the first sample, the agent is capable of binding to the CA protein.

Alternatively, a preferred embodiment utilizes differential screening to identify drug candidates that bind to the native CA protein, but cannot bind to modified CA proteins. The structure of the CA protein may be modeled, and used in rational drug design to synthesize agents that interact with that site. Drug candidates that affect CA bioactivity are also identified by screening drugs for the ability to either enhance or reduce the activity of the protein.

Positive controls and negative controls may be used in the assays. Preferably all control and test samples are performed in at least triplicate to obtain statistically significant results. Incubation of all samples is for a time sufficient for the binding of the agent to the protein. Following incubation, all samples are washed free of non-specifically bound material and the amount of bound, generally labeled agent determined. For example, where a radiolabel is employed, the samples may be counted in a scintillation counter to determine the amount of bound compound.

A variety of other reagents may be included in the screening assays. These include reagents like salts, neutral proteins, e.g. albumin, detergents, etc which may be used to facilitate optimal protein-protein binding and/or reduce non-specific or background interactions. Also reagents that otherwise improve the efficiency of the assay, such as protease inhibitors, nuclease inhibitors, anti-microbial agents, etc., may be used. The mixture of components may be added in any order that provides for the requisite binding.

Screening for agents that modulate the activity of CA proteins may also be done. In a preferred embodiment, methods for screening for a bioactive agent capable of modulating the activity of CA proteins comprise the steps of adding a candidate bioactive agent to a sample of CA proteins, as above, and determining an alteration in the biological activity of CA proteins. "Modulating the activity of an CA protein" includes an increase in activity, a decrease in activity, or a change in the type or kind of activity present. Thus, in this embodiment, the candidate agent should both bind to CA proteins (although this may not be necessary), and alter its biological or biochemical activity as defined herein. The methods include both in vitro screening methods, as are generally outlined above, and in vivo screening of cells for alterations in the presence, distribution, activity or amount of CA proteins.

Thus, in this embodiment, the methods comprise combining a CA sample and a candidate bioactive agent, and evaluating the effect on CA activity. By "CA activity" or grammatical equivalents herein is meant one of the CA protein's biological activities, including, but not limited to, its role in tumorigenesis, including cell division, preferably in lymphatic tissue, cell proliferation, tumor growth and transformation of cells. In one embodiment, CA activity includes activation of or by a protein encoded by a nucleic acid of Table 1 06-001 to 06-343. An inhibitor of CA activity is the inhibition of any one or more CA activities.

In a preferred embodiment, the activity of the CA protein is increased; in another preferred embodiment, the activity of the CA protein is decreased. Thus, bioactive agents that are antagonists are preferred in some embodiments, and bioactive agents that are agonists may be preferred in other embodiments.

In a preferred embodiment, the invention provides methods for screening for bioactive agents capable of modulating the activity of a CA protein. The methods comprise adding a candidate bioactive agent, as defined above, to a cell comprising CA proteins. Preferred cell types include almost any cell. The cells contain a recombinant nucleic acid that encodes a CA protein. In a preferred embodiment, a library of candidate agents are tested on a plurality of cells.

In one aspect, the assays are evaluated in the presence or absence or previous or subsequent exposure of physiological signals, for example hormones, antibodies, peptides, antigens, cytokines, growth factors, action potentials, pharmacological agents including chemotherapeutics, radiation, carcinogenics, or other cells (i.e. cell-cell contacts). In another example, the determinations are determined at different stages of the cell cycle process.

In this way, bioactive agents are identified. Compounds with pharmacological activity are able to enhance or interfere with the activity of the CA protein.

In one embodiment, a method of inhibiting carcinoma cancer cell division, is provided. The method comprises administration of a carcinoma cancer inhibitor.

In a preferred embodiment, a method of inhibiting lymphoma carcinoma cell division is provided comprising administration of a lymphoma carcinoma inhibitor.

In another embodiment, a method of inhibiting tumor growth is provided. The method comprises administration of a carcinoma cancer inhibitor. In a particularly preferred embodiment, a method of inhibiting tumor growth in lymphatic tissue is provided comprising administration of a lymphoma inhibitor.

In a further embodiment, methods of treating cells or individuals with cancer are provided. The method comprises administration of a carcinoma cancer inhibitor. Preferably, the carcinoma is a lymphoma carcinoma.

In one embodiment, a carcinoma cancer inhibitor is an antibody as discussed above. In another embodiment, the carcinoma cancer inhibitor is an antisense molecule. Antisense molecules as used herein include antisense or sense oligonucleotides comprising a singe-stranded nucleic acid sequence (either RNA or DNA) capable of binding to target mRNA (sense) or DNA (antisense) sequences for carcinoma cancer molecules. Antisense or sense oligonucleotides, according to the present invention, comprise a fragment generally at least about 14 nucleotides, preferably from about 14 to 30 nucleotides. The ability to derive an antisense or a sense oligonucleotide, based upon a cDNA sequence encoding a given protein is described in, for example, Stein and Cohen, Cancer Res. 48:2659, (1988) and van der Krol et al., BioTechniques 6:958, (1988).

Antisense molecules may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a sense or an antisense oligonucleotide may be introduced into a cell containing the target nucleic acid sequence by formation of an oligonucleotide-lipid complex, as described in WO 90/10448. It is understood that the use of antisense molecules or knock out and knock in models may also be used in screening assays as discussed above, in addition to methods of treatment.

The compounds having the desired pharmacological activity may be administered in a physiologically acceptable carrier to a host, as previously described. The agents may be administered in a variety of ways, orally, parenterally e.g., subcutaneously, intraperitoneally, intravascularly, etc. Depending upon the manner of introduction, the compounds may be formulated in a variety of ways. The concentration of therapeutically active compound in the formulation may vary from about 0.1-100% wgt/vol. The agents may be administered alone or in combination with other treatments, i.e., radiation.

The pharmaceutical compositions can be prepared in various forms, such as granules, tablets, pills, suppositories, capsules, suspensions, salves, lotions and the like. Pharmaceutical grade organic or inorganic carriers and/or diluents suitable for oral and topical use can be used to make up compositions containing the therapeutically-active compounds. Diluents known to the art include aqueous media, vegetable and animal oils and fats. Stabilizing agents, wetting and emulsifying agents, salts for varying the osmotic pressure or buffers for securing an adequate pH value, and skin penetration enhancers can be used as auxiliary agents.

Without being bound by theory, it appears that the various CA sequences are important in carcinomas. Accordingly, disorders based on mutant or variant CA genes may be determined. In one embodiment, the invention provides methods for identifying cells containing variant CA genes comprising determining all or part of the sequence of at least one endogenous CA genes in a cell. As will be appreciated by those in the art, this may be done using any number of sequencing techniques. In a preferred embodiment, the invention provides methods of identifying the CA genotype of an individual comprising determining all or part of the sequence of at least one CA gene of the individual. This is generally done in at least one tissue of the individual, and may include the evaluation of a number of tissues or different samples of the same tissue. The method may include comparing the sequence of the sequenced CA gene to a known CA gene, i.e., a wild-type gene. As will be appreciated by those in the art, alterations in the sequence of some oncogenes can be an indication of either the presence of the disease, or propensity to develop the disease, or prognosis evaluations.

The sequence of all or part of the CA gene can then be compared to the sequence of a known CA gene to determine if any differences exist. This can be done using any number of known homology programs, such as Bestfit, etc. In a preferred embodiment, the presence of a difference in the sequence between the CA gene of the patient and the known CA gene is indicative of a disease state or a propensity for a disease state, as outlined herein.

In a preferred embodiment, the CA genes are used as probes to determine the number of copies of the CA gene in the genome. For example, some cancers exhibit chromosomal deletions or insertions, resulting in an alteration in the copy number of a gene.

In another preferred embodiment CA genes are used as probes to determine the chromosomal location of the CA genes. Information such as chromosomal location finds use in providing a diagnosis or prognosis in particular when chromosomal abnormalities such as translocations, and the like are identified in CA gene loci.

Thus, in one embodiment, methods of modulating CA in cells or organisms are provided. In one embodiment, the methods comprise administering to a cell an anti-CA antibody that reduces or eliminates the biological activity of an endogenous CA protein. Alternatively, the methods comprise administering to a cell or organism a recombinant nucleic acid encoding a CA protein. As will be appreciated by those in the art, this may be accomplished in any number of ways. In a preferred embodiment, for example when the CA sequence is down-regulated in carcinoma, the activity of the CA gene is increased by increasing the amount of CA in the cell, for example by overexpressing the endogenous CA or by administering a gene encoding the CA sequence, using known gene-therapy techniques, for example. In a preferred embodiment, the gene therapy techniques include the incorporation of the exogenous gene using enhanced homologous recombination (EHR), for example as described in PCT/US93/03868, hereby incorporated by reference in its entirety. Alternatively, for example when the CA sequence is up-regulated in carcinoma, the activity of the endogenous CA gene is decreased, for example by the administration of a CA antisense nucleic acid.

In one embodiment, the CA proteins of the present invention may be used to generate polyclonal and monoclonal antibodies to CA proteins, which are useful as described herein. Similarly, the CA proteins can be coupled, using standard technology, to affinity chromatography columns. These columns may then be used to purify CA antibodies. In a preferred embodiment, the antibodies are generated to epitopes unique to a CA protein; that is, the antibodies show little or no cross-reactivity to other proteins. These antibodies find use in a number of applications. For example, the CA antibodies may be coupled to standard affinity chromatography columns and used to purify CA proteins. The antibodies may also be used as blocking polypeptides, as outlined above, since they will specifically bind to the CA protein.

In one embodiment, a therapeutically effective dose of a CA or modulator thereof is administered to a patient. By "therapeutically effective dose" herein is meant a dose that produces the effects for which it is administered. The exact dose will depend on the purpose of the treatment, and will be ascertainable by one skilled in the art using known techniques. As is known in the art, adjustments for CA degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

A "patient" for the purposes of the present invention includes both humans and other animals, particularly mammals, and organisms. Thus the methods are applicable to both human therapy and veterinary applications. In the preferred embodiment the patient is a mammal, and in the most preferred embodiment the patient is human.

The administration of the CA proteins and modulators of the present invention can be done in a variety of ways as discussed above, including, but not limited to, orally, subcutaneously, intravenously, intranasally, transdermally, intraperitoneally, intramuscularly, intrapulmonary, vaginally, rectally, or intraocularly. In some instances, for example, in the treatment of wounds and inflammation, the CA proteins and modulators may be directly applied as a solution or spray.

The pharmaceutical compositions of the present invention comprise a CA protein in a form suitable for administration to a patient. In the preferred embodiment, the pharmaceutical compositions are in a water soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non-toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine.

The pharmaceutical compositions may also include one or more of the following: carrier proteins such as serum albumin; buffers; fillers such as microcrystalline cellulose, lactose, corn and other starches; binding agents; sweeteners and other flavoring agents; coloring agents; and polyethylene glycol. Additives are well known in the art, and are used in a variety of formulations.

In a preferred embodiment, CA proteins and modulators are administered as therapeutic agents, and can be formulated as outlined above. Similarly, CA genes (including both the full-length sequence, partial sequences, or regulatory sequences of the CA coding regions) can be administered in gene therapy applications, as is known in the art. These CA genes can include antisense applications, either as gene therapy (i.e. for incorporation into the genome) or as antisense compositions, as will be appreciated by those in the art.

In a preferred embodiment, CA genes are administered as DNA vaccines, either single genes or combinations of CA genes. Naked DNA vaccines are generally known in the art. Brower, Nature Biotechnology, 16:1304-1305 (1998).

In one embodiment, CA genes of the present invention are used as DNA vaccines. Methods for the use of genes as DNA vaccines are well known to one of ordinary skill in the art, and include placing a CA gene or portion of a CA gene under the control of a promoter for expression in a patient with carcinoma. The CA gene used for DNA vaccines can encode full-length CA proteins, but more preferably encodes portions of the CA proteins including peptides derived from the CA protein. In a preferred embodiment a patient is immunized with a DNA vaccine comprising a plurality of nucleotide sequences derived from a CA gene. Similarly, it is possible to immunize a patient with a plurality of CA genes or portions thereof as defined herein. Without being bound by theory, expression of the polypeptide encoded by the DNA vaccine, cytotoxic T-cells, helper T-cells and antibodies are induced which recognize and destroy or eliminate cells expressing CA proteins.

In a preferred embodiment, the DNA vaccines include a gene encoding an adjuvant molecule with the DNA vaccine. Such adjuvant molecules include cytokines that increase the immunogenic response to the CA polypeptide encoded by the DNA vaccine. Additional or alternative adjuvants are known to those of ordinary skill in the art and find use in the invention.

In another preferred embodiment CA genes find use in generating animal models of carcinomas, particularly lymphoma carcinomas. As is appreciated by one of ordinary skill in the art, when the CA gene identified is repressed or diminished in CA tissue, gene therapy technology wherein antisense RNA directed to the CA gene will also diminish or repress expression of the gene. An animal generated as such serves as an animal model of CA that finds use in screening bioactive drug candidates. Similarly, gene knockout technology, for example as a result of homologous recombination with an appropriate gene targeting vector, will result in the absence of the CA protein. When desired, tissue-specific expression or knockout of the CA protein may be necessary.

It is also possible that the CA protein is overexpressed in carcinoma. As such, transgenic animals can be generated that overexpress the CA protein. Depending on the desired expression level, promoters of various strengths can be employed to express the transgene. Also, the number of copies of the integrated transgene can be determined and compared for a determination of the expression level of the transgene. Animals generated by such methods find use as animal models of CA and are additionally useful in screening for bioactive molecules to treat carcinoma.

The CA nucleic acid sequences of the invention are depicted in Table 1 06-001 to 06-343. The sequences in each Table include genomic sequence, mRNA and protein sequences for both mouse and human. N/A indicates a gene that has been identified, but for which there has not been a name ascribed.

The sequences are found on the accompanying CD-ROM, the contents of which are expressly incorporated herein by reference. The file name is Table 1.txt. The file was created on Feb. 28, 2002 and saved on the CD-ROM on Mar. 1, 2002. The file contains 53,297 Kbytes.

LENGTHY TABLES

The patent contains a lengthy table section. A copy of the table is available in electronic form from the USPTO web site (http://seqdata.uspto.gov/?pageRequest=docDetail&DocID=US07892730B2). An electronic copy of the table will also be available from the USPTO upon request and payment of the fee set forth in 37 CFR 1.19(b)(3).

The names of the mouse and human genes are outlined below.

| | | |
|---|---|---|
| 06-001 | mCG10049 | hCG41676 |
| 06-002 | mCG10078 | hCG19413 |
| 06-003 | mCG10132 | hCG21567 |
| 06-004 | mCG10208 | hCG21073 |
| 06-005 | mCG10215 | hCG37475 |
| 06-006 | mCG10283 | hCG201153 |
| 06-007 | mCG10301 | hCG25637 |
| 06-008 | mCG10339 | hCG36720 |
| 06-009 | mCG10368 | hCG1777139 |
| 06-010 | mCG10474 | hCG1784975 |
| 06-011 | mCG10543 | hCG1776024 |
| 06-012 | mCG10583 | hCG1780788 |
| 06-013 | mCG1062 | hCG28127 |
| 06-014 | mCG10645 | hCG15849 |
| 06-015 | mCG10734 | hCG15249 |
| 06-016 | mCG10776 | hCG28722 |

-continued

| | | |
|---|---|---|
| 06-017 | mCG11034 | hCG26773 |
| 06-018 | mCG11078 | hCG1644496 |
| 06-019 | mCG11119 | hCG27363 |
| 06-020 | mCG11136 | hCG1782215 |
| 06-021 | mCG11291 | hCG1787835 |
| 06-022 | mCG11441 | hCG401177 |
| 06-023 | mCG11471 | hCG40117 |
| 06-024 | mCG11506 | hCG28011 |
| 06-025 | mCG11566 | hCG21793 |
| 06-026 | mCG11814 | hCG1775160 |
| 06-027 | mCG11829 | hCG37570 |
| 06-028 | mCG11914 | hCG1640505 |
| 06-029 | mCG11924 | hCG16317 |
| 06-030 | mCG11959 | hCG24311 |
| 06-031 | mCG1196 | hCG26669 |
| 06-032 | mCG12024 | hCG39093 |
| 06-033 | mCG12068 | hCG1787637 |
| 06-034 | mCG12133 | hCG23625 |
| 06-035 | mCG12182 | hCG40211 |
| 06-036 | mCG12368 | hCG1744883 |
| 06-037 | mCG12523 | hCG23847 |
| 06-038 | mCG12572 | hCG1778483 |
| 06-039 | mCG12663 | hCG37533 |
| 06-040 | mCG12673 | hCG1810774 |
| 06-041 | mCG12706 | hCG1643869 |
| 06-042 | mCG12722 | hCG33130 |
| 06-043 | mCG12724 | hCG33132 |
| 06-044 | mCG12746 | hCG30819 |
| 06-045 | mCG12792 | hCG24510 |
| 06-046 | mCG12872 | hCG23021 |
| 06-047 | mCG12945 | hCG1739154 |
| 06-048 | mCG13023 | hCG20125 |
| 06-049 | mCG13044 | hCG32359 |
| 06-050 | mCG13084 | hCG1735292 |
| 06-051 | mCG13312 | hCG14731 |
| 06-052 | mCG1338 | hCG32977 |
| 06-053 | mCG13395 | hCG22712 |
| 06-054 | mCG13466 | hCG38705 |
| 06-055 | mCG13520 | hCG15674 |
| 06-056 | mCG13636 | hCG36954 |
| 06-057 | mCG13896 | hCG40471 |
| 06-058 | mCG14020 | hCG1732038 |
| 06-059 | mCG14116 | hCG39199 |
| 06-060 | mCG14172 | hCG15529 |
| 06-061 | mCG1422 | hCG24418 |
| 06-062 | mCG14290 | hCG23314 |
| 06-063 | mCG14414 | hCG1641631 |
| 06-064 | mCG14521 | hCG23105 |
| 06-065 | mCG14555 | hCG23727 |
| 06-066 | mCG14611 | hCG38337 |
| 06-067 | mCG14624 | hCG32448 |
| 06-068 | mCG14659 | hCG23908 |
| 06-069 | mCG1468 | hCG32770 |
| 06-070 | mCG14749 | hCG16187 |
| 06-071 | mCG14817 | hCG17311 |
| 06-072 | mCG14883 | hCG1736594 |
| 06-073 | mCG14932 | hCG24749 |
| 06-074 | mCG14989 | hCG1646502 |
| 06-075 | mCG15039 | hCG28572 |
| 06-076 | mCG15044 | hCG27278 |
| 06-077 | mCG15048 | hCG28567 |
| 06-078 | mCG15184 | hCG1783275 |
| 06-079 | mCG15331 | hCG1640186 |
| 06-080 | mCG15379 | hCG1643838 |
| 06-081 | mCG15397 | hCG39530 |
| 06-082 | mCG15498 | hCG15009 |
| 06-083 | mCG15520 | hCG36837 |
| 06-084 | mCG15521 | hCG37331 |
| 06-085 | mCG15594 | hCG15786 |
| 06-086 | mCG15699 | hCG27588 |
| 06-087 | mCG15703 | hCG23995 |
| 06-088 | mCG15868 | hCG19397 |
| 06-089 | mCG15870 | hCG18268 |
| 06-090 | mCG1589 | hCG28214 |
| 06-091 | mCG1596 | hCG28803 |
| 06-092 | mCG15964 | hCG1762872 |
| 06-093 | mCG16052 | hCG15409 |
| 06-094 | mCG16071 | hCG23219 |
| 06-095 | mCG16088 | hCG33697 |
| 06-096 | mCG16239 | hCG21559 |
| 06-097 | mCG16291 | hCG1737652 |
| 06-098 | mCG16365 | hCG1640204 |
| 06-099 | mCG16394 | hCG20537 |
| 06-100 | mCG16401 | hCG20994 |
| 06-101 | mCG1647 | hCG25929 |
| 06-102 | mCG1659 | hCG32809 |
| 06-103 | mCG16601 | hCG17315 |
| 06-104 | mCG16720 | hCG18035 |
| 06-105 | mCG16843 | hCG37968 |
| 06-106 | mCG16845 | hCG37971 |
| 06-107 | mCG16880 | hCG22479 |
| 06-108 | mCG16923 | hCG25643 |
| 06-109 | mCG16959 | hCG25303 |
| 06-110 | mCG16994 | hCG36856 |
| 06-111 | mCG17013 | hCG24994 |
| 06-112 | mCG17035 | hCG1778746 |
| 06-113 | mCG17138 | hCG33187 |
| 06-114 | mCG17164 | hCG40741 |
| 06-115 | mCG17208 | hCG40378 |
| 06-116 | mCG17242 | hCG25680 |
| 06-117 | mCG17259 | hCG19476 |
| 06-118 | mCG17323 | hCG32158 |
| 06-119 | mCG17383 | hCG28354 |
| 06-120 | mCG17557 | hCG99255 |
| 06-121 | mCG17867 | hCG33515 |
| 06-122 | mCG17870 | hCG32959 |
| 06-123 | mCG17886 | hCG20908 |
| 06-124 | mCG17943 | hCG17932 |
| 06-125 | mCG17984 | hCG33404 |
| 06-126 | mCG18016 | hCG17121 |
| 06-127 | mCG18026 | hCG17346 |
| 06-128 | mCG18081 | hCG38701 |
| 06-129 | mCG18084 | hCG39597 |
| 06-130 | mCG18240 | hCG18999 |
| 06-131 | mCG1828 | hCG1640193 |
| 06-132 | mCG18281 | hCG16651 |
| 06-133 | mCG18404 | hCG20204 |
| 06-134 | mCG18525 | hCG15773 |
| 06-135 | mCG18554 | hCG18551 |
| 06-136 | mCG18573 | hCG18549 |
| 06-137 | mCG18577 | hCG28278 |
| 06-138 | mCG18584 | hCG20056 |
| 06-139 | mCG18590 | hCG21253 |
| 06-140 | mCG18632 | hCG19781 |
| 06-141 | mCG1867 | hCG41365 |
| 06-142 | mCG18746 | hCG1780827 |
| 06-143 | mCG18928 | hCG41574 |
| 06-144 | mCG19018 | hCG27894 |
| 06-145 | mCG19046 | hCG40314 |
| 06-146 | mCG19072 | hCG15138 |
| 06-147 | mCG19106 | hCG16291 |
| 06-148 | mCG19156 | hCG27607 |
| 06-149 | mCG19208 | hCG20766 |
| 06-150 | mCG19209 | hCG22243 |
| 06-151 | mCG19250 | hCG27772 |
| 06-152 | mCG19287 | hCG1748307 |
| 06-153 | mCG19337 | hCG28784 |
| 06-154 | mCG19401 | hCG38450 |
| 06-155 | mCG1941 | hCG40854 |
| 06-156 | mCG1961 | hCG40844 |
| 06-157 | mCG19789 | hCG24313 |
| 06-158 | mCG1982 | hCG24071 |
| 06-159 | mCG19885 | hCG26017 |
| 06-160 | mCG19929 | hCG40063 |
| 06-161 | mCG19993 | hCG25375 |
| 06-162 | mCG20206 | hCG27935 |
| 06-163 | mCG20340 | hCG18066 |
| 06-164 | mCG20392 | hCG41562 |
| 06-165 | mCG20408 | hCG15769 |
| 06-166 | mCG20501 | hCG16575 |
| 06-167 | mCG20543 | hCG17361 |
| 06-168 | mCG20544 | hCG22647 |
| 06-169 | mCG20549 | hCG17357 |
| 06-170 | mCG20599 | hCG40952 |
| 06-171 | mCG20647 | hCG37125 |
| 06-172 | mCG20650 | hCG38101 |
| 06-173 | mCG21092 | hCG16326 |
| 06-174 | mCG21183 | hCG32701 |

-continued

| | | |
|---|---|---|
| 06-175 | mCG21200 | hCG17049 |
| 06-176 | mCG21319 | hCG39866 |
| 06-177 | mCG2140 | hCG1723924 |
| 06-178 | mCG21411 | hCG15095 |
| 06-179 | mCG21419 | hCG15331 |
| 06-180 | mCG21446 | hCG14759 |
| 06-181 | mCG21498 | hCG38237 |
| 06-182 | mCG21659 | hCG18576 |
| 06-183 | mCG21733 | hCG40245 |
| 06-184 | mCG21872 | hCG17143 |
| 06-185 | mCG21902 | hCG30014 |
| 06-186 | mCG22056 | hCG40203 |
| 06-187 | mCG22132 | hCG15373 |
| 06-188 | mCG2215 | hCG401221 |
| 06-189 | mCG22161 | hCG1781402 |
| 06-190 | mCG22171 | hCG37949 |
| 06-191 | mCG22175 | hCG1735628 |
| 06-192 | mCG22205 | hCG16145 |
| 06-193 | mCG22245 | hCG15467 |
| 06-194 | mCG22259 | hCG27692 |
| 06-195 | mCG22352 | hCG19724 |
| 06-196 | mCG22397 | hCG21624 |
| 06-197 | mCG22413 | hCG21734 |
| 06-198 | mCG22464 | hCG17117 |
| 06-199 | mCG22467 | hCG17195 |
| 06-200 | mCG22474 | hCG17936 |
| 06-201 | mCG22518 | hCG38672 |
| 06-202 | mCG22537 | hCG1747156 |
| 06-203 | mCG2260 | hCG23472 |
| 06-204 | mCG22656 | hCG20930 |
| 06-205 | mCG22686 | hCG37091 |
| 06-206 | mCG22753 | hCG20786 |
| 06-207 | mCG23380 | hCG27276 |
| 06-208 | mCG23443 | hCG1737521 |
| 06-209 | mCG23445 | hCG16206 |
| 06-210 | mCG2395 | hCG33029 |
| 06-211 | mCG2435 | hCG16501 |
| 06-212 | mCG2468 | hCG16728 |
| 06-213 | mCG2479 | hCG1780031 |
| 06-214 | mCG2484 | hCG1788599 |
| 06-215 | mCG2509 | hCG17286 |
| 06-216 | mCG2574 | hCG1784894 |
| 06-217 | mCG2609 | hCG14997 |
| 06-218 | mCG2622 | hCG1747365 |
| 06-219 | mCG2706 | hCG28763 |
| 06-220 | mCG2708 | hCG28766 |
| 06-221 | mCG2727 | hCG17889 |
| 06-222 | mCG2740 | hCG27644 |
| 06-223 | mCG2943 | hCG40040 |
| 06-224 | mCG3043 | hCG1738334 |
| 06-225 | mCG3264 | hCG29513 |
| 06-226 | mCG3413 | hCG29916 |
| 06-227 | mCG3601 | hCG37990 |
| 06-228 | mCG3698 | hCG20145 |
| 06-229 | mCG3757 | hCG21349 |
| 06-230 | mCG3767 | hCG32368 |
| 06-231 | mCG3774 | hCG21354 |
| 06-232 | mCG3775 | hCG21354 |
| 06-233 | mCG3793 | hCG27352 |
| 06-234 | mCG3824 | hCG27823 |
| 06-235 | mCG3889 | hCG27192 |
| 06-236 | mCG3931 | hCG23145 |
| 06-237 | mCG4010 | hCG1739389 |
| 06-238 | mCG4192 | hCG41911 |
| 06-239 | mCG4251 | hCG1640192 |
| 06-240 | mCG4296 | hCG40093 |
| 06-241 | mCG4317 | hCG28302 |
| 06-242 | mCG4378 | hCG40788 |
| 06-243 | mCG4428 | hCG30155 |
| 06-244 | mCG4463 | hCG21099 |
| 06-245 | mCG4468 | hCG19805 |
| 06-246 | mCG4490 | hCG39740 |
| 06-247 | mCG4492 | hCG39730 |
| 06-248 | mCG4493 | hCG1766501 |
| 06-249 | mCG4638 | hCG27795 |
| 06-250 | mCG4768 | hCG22679 |
| 06-251 | mCG4799 | hCG33122 |
| 06-252 | mCG4860 | hCG22132 |
| 06-253 | mCG4940 | hCG1785738 |
| 06-254 | mCG49939 | hCG22769 |
| 06-255 | mCG5034 | hCG23376 |
| 06-256 | mCG5067 | hCG19082 |
| 06-257 | mCG51010 | hCG21464 |
| 06-258 | mCG51020 | hCG1643989 |
| 06-259 | mCG5113 | hCG1782397 |
| 06-260 | mCG51582 | hCG39434 |
| 06-261 | mCG51664 | hCG28994 |
| 06-262 | mCG5362 | hCG16933 |
| 06-263 | mCG54271 | hCG18129 |
| 06-264 | mCG5429 | hCG38378 |
| 06-265 | mCG5448 | hCG38103 |
| 06-266 | mCG5518 | hCG22355 |
| 06-267 | mCG5530 | hCG22353 |
| 06-268 | mCG5531 | hCG20493 |
| 06-269 | mCG5548 | hCG1779020 |
| 06-270 | mCG5662 | hCG14831 |
| 06-271 | mCG57125 | hCG1742422 |
| 06-272 | mCG5728 | hCG1811271 |
| 06-273 | mCG5738 | hCG37394 |
| 06-274 | mCG5779 | hCG21040 |
| 06-275 | mCG5868 | hCG28297 |
| 06-276 | mCG6000 | hCG1777660 |
| 06-277 | mCG6027 | hCG38622 |
| 06-278 | mCG6056 | hCG37193 |
| 06-279 | mCG6178 | hCG33356 |
| 06-280 | mCG6322 | hCG32986 |
| 06-281 | mCG6388 | hCG38644 |
| 06-282 | mCG6403 | hCG38453 |
| 06-283 | mCG6481 | hGG40757 |
| 06-284 | mCG6500 | hCG14773 |
| 06-285 | mCG6549 | hCG37127 |
| 06-286 | mCG6627 | hCG27461 |
| 06-287 | mCG6631 | hCG29839 |
| 06-288 | mCG66316 | hCG29191 |
| 06-289 | mCG6636 | hCG33210 |
| 06-290 | mCG6875 | hCG32956 |
| 06-291 | mCG6919 | hCG1644194 |
| 06-292 | mCG6945 | hCG14907 |
| 06-293 | mCG6974 | hCG17395 |
| 06-294 | mCG6981 | hCG1735348 |
| 06-295 | mCG7008 | hCG25055 |
| 06-296 | mCG7143 | hCG32521 |
| 06-297 | mCG7189 | hCG1640838 |
| 06-298 | mCG7211 | hCG1781938 |
| 06-299 | mCG7212 | hCG37223 |
| 06-300 | mCG7256 | hCG39345 |
| 06-301 | mCG7264 | hCG39344 |
| 06-302 | mCG7348 | hCG28560 |
| 06-303 | mCG7369 | hCG22856 |
| 06-304 | mCG7522 | hCG32930 |
| 06-305 | mCG7669 | hCG30694 |
| 06-306 | mCG7689 | hCG32392 |
| 06-307 | mCG7785 | hCG24868 |
| 06-308 | mCG7804 | hCG39065 |
| 06-309 | mCG7826 | hCG1735557 |
| 06-310 | mCG7831 | hCG37578 |
| 06-311 | mCG7923 | hGG22125 |
| 06-312 | mCG7927 | hCG20927 |
| 06-313 | mCG7964 | hCG27325 |
| 06-314 | mCG8211 | hCG24168 |
| 06-315 | mCG8306 | hCG18967 |
| 06-316 | mCG8426 | hCG27711 |
| 06-317 | mCG8466 | hCG29605 |
| 06-318 | mCG8527 | hCG34336 |
| 06-319 | mCG8564 | hCG27679 |
| 06-320 | mCG8581 | hCG14605 |
| 06-321 | mCG8584 | hCG15017 |
| 06-322 | mCG8821 | hCG31443 |
| 06-323 | mCG8835 | hCG17175 |
| 06-324 | mCG8893 | hCG19941 |
| 06-325 | mCG8963 | hCG1639824 |
| 06-326 | mCG8993 | hCG34092 |
| 06-327 | mCG9022 | hCG32769 |
| 06-328 | mCG9049 | hCG25130 |
| 06-329 | mCG9061 | hCG37877 |
| 06-330 | mCG9066 | hCG37872 |
| 06-331 | mCG9077 | hCG23504 |
| 06-332 | mCG9223 | hCG15927 |

-continued

| | | |
|---|---|---|
| 06-333 | mCG9253 | hCG22665 |
| 06-334 | mCG9266 | hCG14925 |
| 06-335 | mCG9336 | hCG28203 |
| 06-336 | mCG9393 | hCG16330 |
| 06-337 | mCG9397 | hCG24200 |
| 06-338 | mCG9437 | hCG16805 |
| 06-339 | mCG9440 | hCG401128 |
| 06-340 | mCG9536 | hCG23831 |
| 06-341 | mCG9597 | hCG37835 |
| 06-342 | mCG9808 | hCG30268 |
| 06-343 | mCG9960 | hCG1642754 |

TABLE 2

IDENTIFICATION OF SEQUENCES

| SEQ ID NOS. | SEQUENCES |
|---|---|
| | CANCER GENE: mCG10049/hCG41676 |
| 1. | MOUSE GENOMIC SEQUENCE (mCG10049) |
| 2. | MOUSE mRNA SEQUENCE (mCT10558) |
| 3. | MOUSE PROTEIN SEQUENCE (mCP3178) |
| 4. | HUMAN GENOMIC SEQUENCE (hCG41676) |
| 5. | HUMAN mRNA SEQUENCE (hCT32948) |
| 6. | HUMAN PROTEIN SEQUENCE (hCP51539) |
| | CANCER GENE: mCG10078/hCG19413 |
| 7. | MOUSE GENOMIC SEQUENCE (mCG10078) |
| 8. | MOUSE mRNA SEQUENCE (mCT9894) |
| 9. | MOUSE PROTEIN SEQUENCE (mCP3703) |
| 10. | HUMAN GENOMIC SEQUENCE (hCG19413) |
| 11. | HUMAN mRNA SEQUENCE (hCT10484) |
| 12. | HUMAN PROTEIN SEQUENCE (hCP37142) |
| | CANCER GENE: mCG10132/hCG21567 |
| 13. | MOUSE GENOMIC SEQUENCE (mCG10132) |
| 14. | MOUSE mRNA SEQUENCE (mCT10267) |
| 15. | MOUSE PROTEIN SEQUENCE (mCP19301) |
| 16. | HUMAN GENOMIC SEQUENCE (hCG21567) |
| 17. | HUMAN mRNA SEQUENCE (hCT12659) |
| 18. | HUMAN PROTEIN SEQUENCE (hCP39072) |
| | CANCER GENE: mCG10208/hCG21073 |
| 19. | MOUSE GENOMIC SEQUENCE (mCG10208) |
| 20. | MOUSE mRNA SEQUENCE (mCT10193) |
| 21. | MOUSE PROTEIN SEQUENCE (mCP19207) |
| 22. | HUMAN GENOMIC SEQUENCE (hCG21073) |
| 23. | HUMAN mRNA SEQUENCE (hCT12159) |
| 24. | HUMAN PROTEIN SEQUENCE (hCP38653) |
| | CANCER GENE: mCG10215/hCG37475 |
| 25. | MOUSE GENOMIC SEQUENCE (mCG10215) |
| 26. | MOUSE mRNA SEQUENCE (mCT10069) |
| 27. | MOUSE PROTEIN SEQUENCE (mCP4103) |
| 28. | HUMAN GENOMIC SEQUENCE (hCG37475) |
| 29. | HUMAN mRNA SEQUENCE (hCT28708) |
| 30. | HUMAN PROTEIN SEQUENCE (hCP48631) |
| | CANCER GENE: mCG10283/hCG201153 |
| 31. | MOUSE GENOMIC SEQUENCE (mCG10283) |
| 32. | MOUSE mRNA SEQUENCE (mCT10883) |
| 33. | MOUSE PROTEIN SEQUENCE (mCP15399) |
| 34. | HUMAN GENOMIC SEQUENCE (hCG201153) |
| 35. | HUMAN mRNA SEQUENCE (hCT201155) |
| 36. | HUMAN PROTEIN SEQUENCE (hCP201495) |
| | CANCER GENE: mCG10301/hCG25637 |
| 37. | MOUSE GENOMIC SEQUENCE (mCG10301) |
| 38. | MOUSE mRNA SEQUENCE (mCT10901) |
| 39. | MOUSE PROTEIN SEQUENCE (mCP15440) |
| 40. | HUMAN GENOMIC SEQUENCE (hCG25637) |
| 41. | HUMAN mRNA SEQUENCE (hCT6762) |
| 42. | HUMAN PROTEIN SEQUENCE (hCP42334) |

TABLE 2-continued

IDENTIFICATION OF SEQUENCES

| SEQ ID NOS. | SEQUENCES |
|---|---|
| | CANCER GENE: mCG10339/hCG36720 |
| 43. | MOUSE GENOMIC SEQUENCE (mCG10339) |
| 44. | MOUSE mRNA SEQUENCE (mCT10526) |
| 45. | MOUSE PROTEIN SEQUENCE (mCP5145) |
| 46. | HUMAN GENOMIC SEQUENCE (hCG36720) |
| 47. | HUMAN mRNA SEQUENCE (hCT23561) |
| 48. | HUMAN PROTEIN SEQUENCE (hCP47035) |
| | CANCER GENE: mCG10368/hCG1777139 |
| 49. | MOUSE GENOMIC SEQUENCE (mCG10368) |
| 50. | MOUSE mRNA SEQUENCE (mCT10980) |
| 51. | MOUSE PROTEIN SEQUENCE (mCP 11203) |
| 52. | HUMAN GENOMIC SEQUENCE (hCG1777139) |
| 53. | HUMAN mRNA SEQUENCE (hCT1815886) |
| 54. | HUMAN PROTEIN SEQUENCE (hCP1719532) |
| | CANCER GENE: mCG10474/hCG1784975 |
| 55. | MOUSE GENOMIC SEQUENCE (mCG10474) |
| 56. | MOUSE mRNA SEQUENCE (mCT11063) |
| 57. | MOUSE PROTEIN SEQUENCE (mCP18249) |
| 58. | HUMAN GENOMIC SEQUENCE (hCG1784975) |
| 59. | HUMAN mRNA SEQUENCE (hCT1823965) |
| 60. | HUMAN PROTEIN SEQUENCE (hCP1743817) |
| | CANCER GENE: mCG10543/hCG1776024 |
| 61. | MOUSE GENOMIC SEQUENCE (mCG10543) |
| 62. | MOUSE mRNA SEQUENCE (mCT10637) |
| 63. | MOUSE PROTEIN SEQUENCE (mCP5099) |
| 64. | HUMAN GENOMIC SEQUENCE (hCG1776024) |
| 65. | HUMAN mRNA SEQUENCE (hCT1814713) |
| 66. | HUMAN PROTEIN SEQUENCE (hCP1734062) |
| | CANCER GENE: mCG10583/hCG1780788 |
| 67. | MOUSE GENOMIC SEQUENCE (mCG10583) |
| 68. | MOUSE mRNA SEQUENCE (mCT10746) |
| 69. | MOUSE PROTEIN SEQUENCE (mCP14741) |
| 70. | HUMAN GENOMIC SEQUENCE (hCG1780788) |
| 71. | HUMAN mRNA SEQUENCE (hCT1819630) |
| 72. | HUMAN PROTEIN SEQUENCE (hCP1700014) |
| | CANCER GENE: mCG1062/hCG28127 |
| 73. | MOUSE GENOMIC SEQUENCE (mCG1062) |
| 74. | MOUSE mRNA SEQUENCE (mCT8657) |
| 75. | MOUSE PROTEIN SEQUENCE (mCP7520) |
| 76. | HUMAN GENOMIC SEQUENCE (hCG28127) |
| 77. | HUMAN mRNA SEQUENCE (hCT19273) |
| 78. | HUMAN PROTEIN SEQUENCE (hCP44846) |
| | CANCER GENE: mCG10645/hCG15849 |
| 79. | MOUSE GENOMIC SEQUENCE (mCG10645) |
| 80. | MOUSE mRNA SEQUENCE (mCT10788) |
| 81. | MOUSE PROTEIN SEQUENCE (mCP17009) |
| 82. | HUMAN GENOMIC SEQUENCE (hCG15849) |
| 83. | HUMAN mRNA SEQUENCE (hCT1951536) |
| 84. | HUMAN PROTEIN SEQUENCE (hCP1752924) |
| | CANCER GENE: mCG10734/hCG15249 |
| 85. | MOUSE GENOMIC SEQUENCE (mCG10734) |
| 86. | MOUSE mRNA SEQUENCE (mCT11434) |
| 87. | MOUSE PROTEIN SEQUENCE (mCP17429) |
| 88. | HUMAN GENOMIC SEQUENCE (hCG15249) |
| 89. | HUMAN mRNA SEQUENCE (hCT6270) |
| 90. | HUMAN PROTEIN SEQUENCE (hCP34885) |
| | CANCER GENE: mCG10776/hCG28722 |
| 91. | MOUSE GENOMIC SEQUENCE (mCG10776) |
| 92. | MOUSE mRNA SEQUENCE (mCT11377) |
| 93. | MOUSE PROTEIN SEQUENCE (mCP13457) |
| 94. | HUMAN GENOMIC SEQUENCE (hCG28722) |
| 95. | HUMAN mRNA SEQUENCE (hCT19877) |
| 96. | HUMAN PROTEIN SEQUENCE (hCP44105) |

TABLE 2-continued

IDENTIFICATION OF SEQUENCES

| SEQ ID NOS. | SEQUENCES |
|---|---|
| | CANCER GENE: mCG11034/hCG26773 |
| 97. | MOUSE GENOMIC SEQUENCE (mCG11034) |
| 98. | MOUSE mRNA SEQUENCE (mCT11271) |
| 99. | MOUSE PROTEIN SEQUENCE (mCP11422) |
| 100. | HUMAN GENOMIC SEQUENCE (hCG26773) |
| 101. | HUMAN mRNA SEQUENCE (hCT17905) |
| 102. | HUMAN PROTEIN SEQUENCE (hCP43570) |
| | CANCER GENE: mCG11078/hCG1644496 |
| 103. | MOUSE GENOMIC SEQUENCE (mCG11078) |
| 104. | MOUSE PROTEIN SEQUENCE (mCP14937) |
| 105. | MOUSE mRNA SEQUENCE (mCT11355) |
| 106. | HUMAN GENOMIC SEQUENCE (hCG1644496) |
| 107. | HUMAN mRNA SEQUENCE (hCT1644623) |
| 108. | HUMAN PROTEIN SEQUENCE (hCP1612572) |
| | CANCER GENE: mCG11119/hCG27363 |
| 109. | MOUSE GENOMIC SEQUENCE (mCG11119) |
| 110. | MOUSE mRNA SEQUENCE (mCT11558) |
| 111. | MOUSE PROTEIN SEQUENCE (mCP5417) |
| 112. | HUMAN GENOMIC SEQUENCE (hCG27363) |
| 113. | HUMAN mRNA SEQUENCE (hCT18502) |
| 114. | HUMAN PROTEIN SEQUENCE (hCP42949) |
| | CANCER GENE: mCG11136/hCG1782215 |
| 115. | MOUSE GENOMIC SEQUENCE (mCG11136) |
| 116. | MOUSE mRNA SEQUENCE (mCT11575) |
| 117. | MOUSE PROTEIN SEQUENCE (mCP5488) |
| 118. | HUMAN GENOMIC SEQUENCE (hCG1782215) |
| 119. | HUMAN mRNA SEQUENCE (hCT1821116) |
| 120. | HUMAN PROTEIN SEQUENCE (hCP1734687) |
| | CANCER GENE: mCG11291/hCG1787835 |
| 121. | MOUSE GENOMIC SEQUENCE (mCG11291) |
| 122. | MOUSE mRNA SEQUENCE (mCT11578) |
| 123. | MOUSE PROTEIN SEQUENCE (mCP1456) |
| 124. | HUMAN GENOMIC SEQUENCE (hCG1787835) |
| 125. | HUMAN mRNA SEQUENCE (hCT1826903) |
| 126. | HUMAN PROTEIN SEQUENCE (hCP1729572) |
| | CANCER GENE: mCG11441/hCG401177 |
| 127. | MOUSE GENOMIC SEQUENCE (mCG11441) |
| 128. | MOUSE mRNA SEQUENCE (mCT12183) |
| 129. | MOUSE PROTEIN SEQUENCE (mCP4248) |
| 130. | HUMAN GENOMIC SEQUENCE (hCG401177) |
| 131. | HUMAN mRNA SEQUENCE (hCT401179) |
| 132. | HUMAN PROTEIN SEQUENCE (hCP801112) |
| | CANCER GENE: mCG11471/hCG40117 |
| 133. | MOUSE GENOMIC SEQUENCE (mCG11471) |
| 134. | MOUSE mRNA SEQUENCE (mCT11937) |
| 135. | MOUSE PROTEIN SEQUENCE (mCP14289) |
| 136. | HUMAN GENOMIC SEQUENCE (hCG40117) |
| 137. | HUMAN mRNA SEQUENCE (hCT1825100) |
| 138. | HUMAN PROTEIN SEQUENCE (hCP1735822) |
| | CANCER GENE: mCG11506/hCG28011 |
| 139. | MOUSE GENOMIC SEQUENCE (mCG11506) |
| 140. | MOUSE mRNA SEQUENCE (mCT11734) |
| 141. | MOUSE PROTEIN SEQUENCE (mCP13976) |
| 142. | HUMAN GENOMIC SEQUENCE (hCG28011) |
| 143. | HUMAN mRNA SEQUENCE (hCT19157) |
| 144. | HUMAN PROTEIN SEQUENCE (hCP43537) |
| | CANCER GENE: mCG11566/hCG21793 |
| 145. | MOUSE GENOMIC SEQUENCE (mCG11566) |
| 146. | MOUSE mRNA SEQUENCE (mCT12445) |
| 147. | MOUSE PROTEIN SEQUENCE (mCP5151) |
| 148. | HUMAN GENOMIC SEQUENCE (hCG21793) |
| 149. | HUMAN mRNA SEQUENCE (hCT12886) |
| 150. | HUMAN PROTEIN SEQUENCE (hCP39644) |
| | CANCER GENE: mCG11814/hCG1775160 |
| 151. | MOUSE GENOMIC SEQUENCE (mCG11814) |
| 152. | MOUSE mRNA SEQUENCE (mCT12311) |
| 153. | MOUSE PROTEIN SEQUENCE (mCP2528) |
| 154. | HUMAN GENOMIC SEQUENCE (hCG1775160) |
| 155. | HUMAN mRNA SEQUENCE (hCT1813820) |
| 156. | HUMAN PROTEIN SEQUENCE (hCP1704942) |
| | CANCER GENE: mCG11829/hCG37570 |
| 157. | MOUSE GENOMIC SEQUENCE (mCG11829) |
| 158. | MOUSE mRNA SEQUENCE (mCT12233) |
| 159. | MOUSE PROTEIN SEQUENCE (mCP17336) |
| 160. | HUMAN GENOMIC SEQUENCE (hCG37570) |
| 161. | HUMAN mRNA SEQUENCE (hCT28803) |
| 162. | HUMAN PROTEIN SEQUENCE (hCP48746) |
| | CANCER GENE: mCG11914/hCG1640505 |
| 163. | MOUSE GENOMIC SEQUENCE (mCG11914) |
| 164. | MOUSE mRNA SEQUENCE (mCT12622) |
| 165. | MOUSE PROTEIN SEQUENCE (mCP17406) |
| 166. | HUMAN GENOMIC SEQUENCE (hCG1640505) |
| 167. | HUMAN mRNA SEQUENCE (hCT1640632) |
| 168. | HUMAN PROTEIN SEQUENCE (hCP1619848) |
| | CANCER GENE: mCG11924/hCG16317 |
| 169. | MOUSE GENOMIC SEQUENCE (mCG11924) |
| 170. | MOUSE mRNA SEQUENCE (mCT14543) |
| 171. | MOUSE PROTEIN SEQUENCE (mCP16061) |
| 172. | HUMAN GENOMIC SEQUENCE (hCG16317) |
| 173. | HUMAN mRNA SEQUENCE (hCT7353) |
| 174. | HUMAN PROTEIN SEQUENCE (hCP33574) |
| | CANCER GENE: mCG11959/hCG24311 |
| 175. | MOUSE GENOMIC SEQUENCE (mCG11959) |
| 176. | MOUSE mRNA SEQUENCE (mCT14675) |
| 177. | MOUSE PROTEIN SEQUENCE (mCP1817) |
| 178. | HUMAN GENOMIC SEQUENCE (hCG24311) |
| 179. | HUMAN mRNA SEQUENCE (hCT15425) |
| 180. | HUMAN PROTEIN SEQUENCE (hCP41558) |
| | CANCER GENE: mCG1196/hCG26669 |
| 181. | MOUSE GENOMIC SEQUENCE (mCG1196) |
| 182. | MOUSE mRNA SEQUENCE (mCT8240) |
| 183. | MOUSE PROTEIN SEQUENCE (mCP10249) |
| 184. | HUMAN GENOMIC SEQUENCE (hCG26669) |
| 185. | HUMAN mRNA SEQUENCE (hCT17801) |
| 186. | HUMAN PROTEIN SEQUENCE (hCP46069) |
| | CANCER GENE: mCG12024/hCG39093 |
| 187. | MOUSE GENOMIC SEQUENCE (mCG12024) |
| 188. | MOUSE mRNA SEQUENCE (mCT12525) |
| 189. | MOUSE PROTEIN SEQUENCE (mCP7959) |
| 190. | HUMAN GENOMIC SEQUENCE (hCG39093) |
| 191. | HUMAN mRNA SEQUENCE (hCT30340) |
| 192. | HUMAN PROTEIN SEQUENCE (hCP50417) |
| | CANCER GENE: mCG12068/hCG1787637 |
| 193. | MOUSE GENOMIC SEQUENCE (mCG12068) |
| 194. | MOUSE mRNA SEQUENCE (mCT12684) |
| 195. | MOUSE PROTEIN SEQUENCE (mCP6907) |
| 196. | HUMAN GENOMIC SEQUENCE (hCG1787637) |
| 197. | HUMAN mRNA SEQUENCE (hCT1826701) |
| 198. | HUMAN PROTEIN SEQUENCE (hCP1705462) |
| | CANCER GENE: mCG12133/hCG23625 |
| 199. | MOUSE GENOMIC SEQUENCE (mCG12133) |
| 200. | MOUSE mRNA SEQUENCE (mCT16612) |
| 201. | MOUSE PROTEIN SEQUENCE (mCP7634) |
| 202. | HUMAN GENOMIC SEQUENCE (hCG23625) |
| 203. | HUMAN mRNA SEQUENCE (hCT14732) |
| 204. | HUMAN PROTEIN SEQUENCE (hCP40974) |

TABLE 2-continued

IDENTIFICATION OF SEQUENCES

| SEQ ID NOS. | SEQUENCES |
|---|---|
| | CANCER GENE: mCG12182/hCG40211 |
| 205. | MOUSE GENOMIC SEQUENCE (mCG12182) |
| 206. | MOUSE mRNA SEQUENCE (mCT16772) |
| 207. | MOUSE PROTEIN SEQUENCE (mCP5424) |
| 208. | HUMAN GENOMIC SEQUENCE (hCG40211) |
| 209. | HUMAN mRNA SEQUENCE (hCT31465) |
| 210. | HUMAN PROTEIN SEQUENCE (hCP49961) |
| | CANCER GENE: mCG12368/hCG1744883 |
| 211. | MOUSE GENOMIC SEQUENCE (mCG12368) |
| 212. | MOUSE mRNA SEQUENCE (mCT16089) |
| 213. | MOUSE PROTEIN SEQUENCE (mCP18849) |
| 214. | HUMAN GENOMIC SEQUENCE (hCG1744883) |
| 215. | HUMAN mRNA SEQUENCE (hCT1783124) |
| 216. | HUMAN PROTEIN SEQUENCE (hCP1717267) |
| | CANCER GENE: mCG12523/hCG23847 |
| 217. | MOUSE GENOMIC SEQUENCE (mCG12523) |
| 218. | MOUSE mRNA SEQUENCE (mCT13425) |
| 219. | MOUSE PROTEIN SEQUENCE (mCP10914) |
| 220. | HUMAN GENOMIC SEQUENCE (hCG23847) |
| 221. | HUMAN mRNA SEQUENCE (hCT14959) |
| 222. | HUMAN PROTEIN SEQUENCE (hCP41235) |
| | CANCER GENE: mCG12572/hCG1778483 |
| 223. | MOUSE GENOMIC SEQUENCE (mCG12572) |
| 224. | MOUSE mRNA SEQUENCE (mCT13299) |
| 225. | MOUSE PROTEIN SEQUENCE (mCP8821) |
| 226. | HUMAN GENOMIC SEQUENCE (hCG1778483) |
| 227. | HUMAN mRNA SEQUENCE (hCT1817254) |
| 228. | HUMAN PROTEIN SEQUENCE (hCP1742619) |
| | CANCER GENE: mCG12663/hCG37533 |
| 229. | MOUSE GENOMIC SEQUENCE (mCG12663) |
| 230. | MOUSE mRNA SEQUENCE (mCT13571) |
| 231. | MOUSE PROTEIN SEQUENCE (mCP23112) |
| 232. | HUMAN GENOMIC SEQUENCE (hCG37533) |
| 233. | HUMAN mRNA SEQUENCE (hCT28766) |
| 234. | HUMAN PROTEIN SEQUENCE (hCP48812) |
| | CANCER GENE: mCG12673/hCG1810774 |
| 235. | MOUSE GENOMIC SEQUENCE (mCG12673) |
| 236. | MOUSE mRNA SEQUENCE (mCT13354) |
| 237. | MOUSE PROTEIN SEQUENCE (mCP14021) |
| 238. | HUMAN GENOMIC SEQUENCE (hCG1810774) |
| 239. | HUMAN mRNA SEQUENCE (hCT1950049) |
| 240. | HUMAN PROTEIN SEQUENCE (hCP1767062) |
| | CANCER GENE: mCG12706/hCG1643869 |
| 241. | MOUSE GENOMIC SEQUENCE (mCG12706) |
| 242. | MOUSE mRNA SEQUENCE (mCT13403) |
| 243. | MOUSE PROTEIN SEQUENCE (mCP5983) |
| 244. | HUMAN GENOMIC SEQUENCE (hCG1643869) |
| 245. | HUMAN mRNA SEQUENCE (hCT1643996) |
| 246. | HUMAN PROTEIN SEQUENCE (hCP1635124) |
| | CANCER GENE: mCG12722/hCG33130 |
| 247. | MOUSE GENOMIC SEQUENCE (mCG12722) |
| 248. | MOUSE mRNA SEQUENCE (mCT13363) |
| 249. | MOUSE PROTEIN SEQUENCE (mCP18789) |
| 250. | HUMAN GENOMIC SEQUENCE (hCG33130) |
| 251. | HUMAN mRNA SEQUENCE (hCT24323) |
| 252. | HUMAN PROTEIN SEQUENCE (hCP46493) |
| | CANCER GENE: mCG12724/hCG33132 |
| 253. | MOUSE GENOMIC SEQUENCE (mCG12724) |
| 254. | MOUSE mRNA SEQUENCE (mCT13365) |
| 255. | MOUSE PROTEIN SEQUENCE (mCP18786) |
| 256. | HUMAN GENOMIC SEQUENCE (hCG33132) |
| 257. | HUMAN mRNA SEQUENCE (hCT24325) |
| 258. | HUMAN PROTEIN SEQUENCE (hCP46495) |
| | CANCER GENE: mCG12746/hCG30819 |
| 259. | MOUSE GENOMIC SEQUENCE (mCG12746) |
| 260. | MOUSE mRNA SEQUENCE (mCT13463) |
| 261. | MOUSE PROTEIN SEQUENCE (mCP18800) |
| 262. | HUMAN GENOMIC SEQUENCE (hCG30819) |
| 263. | HUMAN mRNA SEQUENCE (hCT21993) |
| 264. | HUMAN PROTEIN SEQUENCE (hCP44970) |
| | CANCER GENE: mCG12792/hCG24510 |
| 265. | MOUSE GENOMIC SEQUENCE (mCG12792) |
| 266. | MOUSE mRNA SEQUENCE (mCT13497) |
| 267. | MOUSE PROTEIN SEQUENCE (mCP8770) |
| 268. | HUMAN GENOMIC SEQUENCE (hCG24510) |
| 269. | HUMAN mRNA SEQUENCE (hCT15627) |
| 270. | HUMAN PROTEIN SEQUENCE (hCP41693) |
| | CANCER GENE: mCG12872/hCG23021 |
| 271. | MOUSE GENOMIC SEQUENCE (mCG12872) |
| 272. | MOUSE mRNA SEQUENCE (mCT13522) |
| 273. | MOUSE PROTEIN SEQUENCE (mCP21017) |
| 274. | HUMAN GENOMIC SEQUENCE (hCG23021) |
| 275. | HUMAN mRNA SEQUENCE (hCT14123) |
| 276. | HUMAN PROTEIN SEQUENCE (hCP40456) |
| | CANCER GENE: mCG12945/hCG1739154 |
| 277. | MOUSE GENOMIC SEQUENCE (mCG12945) |
| 278. | MOUSE mRNA SEQUENCE (mCT13581) |
| 279. | MOUSE PROTEIN SEQUENCE (mCP16226) |
| 280. | HUMAN GENOMIC SEQUENCE (hCG1739154) |
| 281. | HUMAN mRNA SEQUENCE (hCT1777235) |
| 282. | HUMAN PROTEIN SEQUENCE (hCP1732635) |
| | CANCER GENE: mCG13023/hCG20125 |
| 283. | MOUSE GENOMIC SEQUENCE (mCG13023) |
| 284. | MOUSE mRNA SEQUENCE (mCT13768) |
| 285. | MOUSE PROTEIN SEQUENCE (mCP22537) |
| 286. | HUMAN GENOMIC SEQUENCE (hCG20125) |
| 287. | HUMAN mRNA SEQUENCE (hCT11196) |
| 288. | HUMAN PROTEIN SEQUENCE (hCP37863) |
| | CANCER GENE: mCG13044/hCG32359 |
| 289. | MOUSE GENOMIC SEQUENCE (mCG13044) |
| 290. | MOUSE mRNA SEQUENCE (mCT11876) |
| 291. | MOUSE PROTEIN SEQUENCE (mCP2702) |
| 292. | HUMAN GENOMIC SEQUENCE (hCG32359) |
| 293. | HUMAN mRNA SEQUENCE (hCT1950129) |
| 294. | HUMAN PROTEIN SEQUENCE (hCP1751147) |
| | CANCER GENE: mCG13084/hCG1735292 |
| 295. | MOUSE GENOMIC SEQUENCE (mCG13084) |
| 296. | MOUSE mRNA SEQUENCE (mCT12008) |
| 297. | MOUSE PROTEIN SEQUENCE (mCP11724) |
| 298. | HUMAN GENOMIC SEQUENCE (hCG1735292) |
| 299. | HUMAN mRNA SEQUENCE (hCT1773283) |
| 300. | HUMAN PROTEIN SEQUENCE (hCP1745220) |
| | CANCER GENE: mCG13312/hCG14731 |
| 301. | MOUSE GENOMIC SEQUENCE (mCG13312) |
| 302. | MOUSE mRNA SEQUENCE (mCT11850) |
| 303. | MOUSE PROTEIN SEQUENCE (mCP17747) |
| 304. | HUMAN GENOMIC SEQUENCE (hCG14731) |
| 305. | HUMAN mRNA SEQUENCE (hCT5752) |
| 306. | HUMAN PROTEIN SEQUENCE (hCP33220) |
| | CANCER GENE: mCG1338/hCG32977 |
| 307. | MOUSE GENOMIC SEQUENCE (mCG1338) |
| 308. | MOUSE mRNA SEQUENCE (mCT8784) |
| 309. | MOUSE PROTEIN SEQUENCE (mCP13373) |
| 310. | HUMAN GENOMIC SEQUENCE (hCG32977) |
| 311. | HUMAN mRNA SEQUENCE (hCT24169) |
| 312. | HUMAN PROTEIN SEQUENCE (hCP46322) |

TABLE 2-continued

IDENTIFICATION OF SEQUENCES

| SEQ ID NOS. | SEQUENCES |
|---|---|
| | CANCER GENE: mCG13395/hCG22712 |
| 313. | MOUSE GENOMIC SEQUENCE (mCG13395) |
| 314. | MOUSE mRNA SEQUENCE (mCT11881) |
| 315. | MOUSE PROTEIN SEQUENCE (mCP7649) |
| 316. | HUMAN GENOMIC SEQUENCE (hCG22712) |
| 317. | HUMAN mRNA SEQUENCE (hCT13810) |
| 318. | HUMAN PROTEIN SEQUENCE (hCP40157) |
| | CANCER GENE: mCG13466/hCG38705 |
| 319. | MOUSE GENOMIC SEQUENCE (mCG13466) |
| 320. | MOUSE mRNA SEQUENCE (mCT11497) |
| 321. | MOUSE PROTEIN SEQUENCE (mCP16741) |
| 322. | HUMAN GENOMIC SEQUENCE (hCG38705) |
| 323. | HUMAN mRNA SEQUENCE (hCT29949) |
| 324. | HUMAN PROTEIN SEQUENCE (hCP48563) |
| | CANCER GENE: mCG13520/hCG15674 |
| 325. | MOUSE GENOMIC SEQUENCE (mCG13520) |
| 326. | MOUSE mRNA SEQUENCE (mCT14620) |
| 327. | MOUSE PROTEIN SEQUENCE (mCP3864) |
| 328. | HUMAN GENOMIC SEQUENCE (hCG15674) |
| 329. | HUMAN mRNA SEQUENCE (hCT6699) |
| 330. | HUMAN PROTEIN SEQUENCE (hCP34668) |
| | CANCER GENE: mCG13636/hCG36954 |
| 331. | MOUSE GENOMIC SEQUENCE (mCG13636) |
| 332. | MOUSE mRNA SEQUENCE (mCT16287) |
| 333. | MOUSE PROTEIN SEQUENCE (mCP12701) |
| 334. | HUMAN GENOMIC SEQUENCE (hCG36954) |
| 335. | HUMAN mRNA SEQUENCE (hCT1827782) |
| 336. | HUMAN PROTEIN SEQUENCE (hCP1698519) |
| | CANCER GENE: mCG13896/hCG40471 |
| 337. | MOUSE GENOMIC SEQUENCE (mCG13896) |
| 338. | MOUSE mRNA SEQUENCE (mCT18237) |
| 339. | MOUSE PROTEIN SEQUENCE (mCP18847) |
| 340. | HUMAN GENOMIC SEQUENCE (hCG40471) |
| 341. | HUMAN mRNA SEQUENCE (hCT1958638) |
| 342. | HUMAN PROTEIN SEQUENCE (hCP1766706) |
| | CANCER GENE: mCG14020/hCG1732038 |
| 343. | MOUSE GENOMIC SEQUENCE (mCG14020) |
| 344. | MOUSE mRNA SEQUENCE (mCT19128) |
| 345. | MOUSE PROTEIN SEQUENCE (mCP10814) |
| 346. | HUMAN GENOMIC SEQUENCE (hCG1732038) |
| 347. | HUMAN mRNA SEQUENCE (hCT1769897) |
| 348. | HUMAN PROTEIN SEQUENCE (hCP1741666) |
| | CANCER GENE: mCG14116/hCG39199 |
| 349. | MOUSE GENOMIC SEQUENCE (mCG14116) |
| 350. | MOUSE mRNA SEQUENCE (mCT19570) |
| 351. | MOUSE PROTEIN SEQUENCE (mCP16557) |
| 352. | HUMAN GENOMIC SEQUENCE (hCG39199) |
| 353. | HUMAN mRNA SEQUENCE (hCT30448) |
| 354. | HUMAN PROTEIN SEQUENCE (hCP49026) |
| | CANCER GENE: mCG14172/hCG15529 |
| 355. | MOUSE GENOMIC SEQUENCE (mCG14172) |
| 356. | MOUSE mRNA SEQUENCE (mCT12571) |
| 357. | MOUSE PROTEIN SEQUENCE (mCP16881) |
| 358. | HUMAN GENOMIC SEQUENCE (hCG15529) |
| 359. | HUMAN mRNA SEQUENCE (hCT6554) |
| 360. | HUMAN PROTEIN SEQUENCE (hCP33393) |
| | CANCER GENE: mCG1422/hCG24418 |
| 361. | MOUSE GENOMIC SEQUENCE (mCG1422) |
| 362. | MOUSE mRNA SEQUENCE (mCT8441) |
| 363. | MOUSE PROTEIN SEQUENCE (mCP14824) |
| 364. | HUMAN GENOMIC SEQUENCE (hCG24418) |
| 365. | HUMAN mRNA SEQUENCE (hCT15535) |
| 366. | HUMAN PROTEIN SEQUENCE (hCP41649) |

TABLE 2-continued

IDENTIFICATION OF SEQUENCES

| SEQ ID NOS. | SEQUENCES |
|---|---|
| | CANCER GENE: mCG14290/hCG23314 |
| 367. | MOUSE GENOMIC SEQUENCE (mCG14290) |
| 368. | MOUSE mRNA SEQUENCE (mCT15414) |
| 369. | MOUSE PROTEIN SEQUENCE (mCP12312) |
| 370. | HUMAN GENOMIC SEQUENCE (hCG23314) |
| 371. | HUMAN mRNA SEQUENCE (hCT14420) |
| 372. | HUMAN PROTEIN SEQUENCE (hCP42485) |
| | CANCER GENE: mCG14414/hCG1641631 |
| 373. | MOUSE GENOMIC SEQUENCE (mCG14414) |
| 374. | MOUSE mRNA SEQUENCE (mCT16804) |
| 375. | MOUSE PROTEIN SEQUENCE (mCP17423) |
| 376. | HUMAN GENOMIC SEQUENCE (hCG1641631) |
| 377. | HUMAN mRNA SEQUENCE (hCT1641758) |
| 378. | HUMAN PROTEIN SEQUENCE (hCP1624000) |
| | CANCER GENE: mCG14521/hCG23105 |
| 379. | MOUSE GENOMIC SEQUENCE (mCG14521) |
| 380. | MOUSE mRNA SEQUENCE (mCT18340) |
| 381. | MOUSE PROTEIN SEQUENCE (mCP7400) |
| 382. | HUMAN GENOMIC SEQUENCE (hCG23105) |
| 383. | HUMAN mRNA SEQUENCE (hCT14209) |
| 384. | HUMAN PROTEIN SEQUENCE (hCP40550) |
| | CANCER GENE: mCG14555/hCG23727 |
| 385. | MOUSE GENOMIC SEQUENCE (mCG14555) |
| 386. | MOUSE mRNA SEQUENCE (mCT18260) |
| 387. | MOUSE PROTEIN SEQUENCE (mCP2400) |
| 388. | HUMAN GENOMIC SEQUENCE (hCG23727) |
| 389. | HUMAN mRNA SEQUENCE (hCT14839) |
| 390. | HUMAN PROTEIN SEQUENCE (hCP41563) |
| | CANCER GENE: mCG14611/hCG38337 |
| 391. | MOUSE GENOMIC SEQUENCE (mCG14611) |
| 392. | MOUSE mRNA SEQUENCE (mCT19379) |
| 393. | MOUSE PROTEIN SEQUENCE (mCP5898) |
| 394. | HUMAN GENOMIC SEQUENCE (hCG38337) |
| 395. | HUMAN mRNA SEQUENCE (hCT29578) |
| 396. | HUMAN PROTEIN SEQUENCE (hCP48239) |
| | CANCER GENE: mCG14624/hCG32448 |
| 397. | MOUSE GENOMIC SEQUENCE (mCG14624) |
| 398. | MOUSE mRNA SEQUENCE (mCT19082) |
| 399. | MOUSE PROTEIN SEQUENCE (mCP7195) |
| 400. | HUMAN GENOMIC SEQUENCE (hCG32448) |
| 401. | HUMAN mRNA SEQUENCE (hCT1958762) |
| 402. | HUMAN PROTEIN SEQUENCE (hCP1762529) |
| | CANCER GENE: mCG14659/hCG23908 |
| 403. | MOUSE GENOMIC SEQUENCE (mCG14659) |
| 404. | MOUSE mRNA SEQUENCE (mCT19290) |
| 405. | MOUSE PROTEIN SEQUENCE (mCP22629) |
| 406. | HUMAN GENOMIC SEQUENCE (hCG23908) |
| 407. | HUMAN mRNA SEQUENCE (hCT15021) |
| 408. | HUMAN PROTEIN SEQUENCE (hCP41309) |
| | CANCER GENE: mCG1468/hCG32770 |
| 409. | MOUSE GENOMIC SEQUENCE (mCG1468) |
| 410. | MOUSE mRNA SEQUENCE (mCT8256) |
| 411. | MOUSE PROTEIN SEQUENCE (mCP14101) |
| 412. | HUMAN GENOMIC SEQUENCE (hCG32770) |
| 413. | HUMAN mRNA SEQUENCE (hCT23961) |
| 414. | HUMAN PROTEIN SEQUENCE (hCP46106) |
| | CANCER GENE: mCG14749/hCG16187 |
| 415. | MOUSE GENOMIC SEQUENCE (mCG14749) |
| 416. | MOUSE mRNA SEQUENCE (mCT19814) |
| 417. | MOUSE PROTEIN SEQUENCE (mCP21367) |
| 418. | HUMAN GENOMIC SEQUENCE (hCG16187) |
| 419. | HUMAN mRNA SEQUENCE (hCT7219) |
| 420. | HUMAN PROTEIN SEQUENCE (hCP33910) |

TABLE 2-continued

IDENTIFICATION OF SEQUENCES

| SEQ ID NOS. | SEQUENCES |
|---|---|
| | CANCER GENE: mCG14817/hCG17311 |
| 421. | MOUSE GENOMIC SEQUENCE (mCG14817) |
| 422. | MOUSE mRNA SEQUENCE (mCT20556) |
| 423. | MOUSE PROTEIN SEQUENCE (mCP3529) |
| 424. | HUMAN GENOMIC SEQUENCE (hCG17311) |
| 425. | HUMAN mRNA SEQUENCE (hCT8361) |
| 426. | HUMAN PROTEIN SEQUENCE (hCP34118) |
| | CANCER GENE: mCG14883/hCG1736594 |
| 427. | MOUSE GENOMIC SEQUENCE (mCG14883) |
| 428. | MOUSE mRNA SEQUENCE (mCT20678) |
| 429. | MOUSE PROTEIN SEQUENCE (mCP13935) |
| 430. | HUMAN GENOMIC SEQUENCE (hCG1736594) |
| 431. | HUMAN mRNA SEQUENCE (hCT1774609) |
| 432. | HUMAN PROTEIN SEQUENCE (hCP1717577) |
| | CANCER GENE: mCG14932/hCG24749 |
| 433. | MOUSE GENOMIC SEQUENCE (mCG14932) |
| 434. | MOUSE mRNA SEQUENCE (mCT21048) |
| 435. | MOUSE PROTEIN SEQUENCE (mCP14256) |
| 436. | HUMAN GENOMIC SEQUENCE (hCG24749) |
| 437. | HUMAN mRNA SEQUENCE (hCT15869) |
| 438. | HUMAN PROTEIN SEQUENCE (hCP41876) |
| | CANCER GENE: mCG14989/hCG1646502 |
| 439. | MOUSE GENOMIC SEQUENCE (mCG14989) |
| 440. | MOUSE mRNA SEQUENCE (mCT21342) |
| 441. | MOUSE PROTEIN SEQUENCE (mCP16457) |
| 442. | HUMAN GENOMIC SEQUENCE (hCG1646502) |
| 443. | HUMAN mRNA SEQUENCE (hCT1646629) |
| 444. | HUMAN PROTEIN SEQUENCE (hCP1641181) |
| | CANCER GENE: mCG15039/hCG28572 |
| 445. | MOUSE GENOMIC SEQUENCE (mCG15039) |
| 446. | MOUSE mRNA SEQUENCE (mCT12903) |
| 447. | MOUSE PROTEIN SEQUENCE (mCP18813) |
| 448. | HUMAN GENOMIC SEQUENCE (hCG28572) |
| 449. | HUMAN mRNA SEQUENCE (hCT19726) |
| 450. | HUMAN PROTEIN SEQUENCE (hCP44008) |
| | CANCER GENE: mCG15044/hCG27278 |
| 451. | MOUSE GENOMIC SEQUENCE (mCG15044) |
| 452. | MOUSE mRNA SEQUENCE (mCT12890) |
| 453. | MOUSE PROTEIN SEQUENCE (mCP18960) |
| 454. | HUMAN GENOMIC SEQUENCE (hCG27278) |
| 455. | HUMAN mRNA SEQUENCE (hCT18416) |
| 456. | HUMAN PROTEIN SEQUENCE (hCP43286) |
| | CANCER GENE: mCG15048/hCG28567 |
| 457. | MOUSE GENOMIC SEQUENCE (mCG15048) |
| 458. | MOUSE mRNA SEQUENCE (mCT12877) |
| 459. | MOUSE PROTEIN SEQUENCE (mCP18885) |
| 460. | HUMAN GENOMIC SEQUENCE (hCG28567) |
| 461. | HUMAN mRNA SEQUENCE (hCT1814688) |
| 462. | HUMAN PROTEIN SEQUENCE (hCP1741102) |
| | CANCER GENE: mCG15184/hCG1783275 |
| 463. | MOUSE GENOMIC SEQUENCE (mCG15184) |
| 464. | MOUSE mRNA SEQUENCE (mCT14470) |
| 465. | MOUSE PROTEIN SEQUENCE (mCP17972) |
| 466. | HUMAN GENOMIC SEQUENCE (hCG1783275) |
| 467. | HUMAN mRNA SEQUENCE (hCT1822211) |
| 468. | HUMAN PROTEIN SEQUENCE (hCP1709817) |
| | CANCER GENE: mCG15331/hCG1640186 |
| 469. | MOUSE GENOMIC SEQUENCE (mCG15331) |
| 470. | MOUSE mRNA SEQUENCE (mCT15478) |
| 471. | MOUSE PROTEIN SEQUENCE (mCP20056) |
| 472. | HUMAN GENOMIC SEQUENCE (hCG1640186) |
| 473. | HUMAN mRNA SEQUENCE (hCT1640313) |
| 474. | HUMAN PROTEIN SEQUENCE (hCP1643394) |
| | CANCER GENE: mCG15379/hCG1643838 |
| 475. | MOUSE GENOMIC SEQUENCE (mCG15379) |
| 476. | MOUSE mRNA SEQUENCE (mCT10709) |
| 477. | MOUSE PROTEIN SEQUENCE (mCP23575) |
| 478. | HUMAN GENOMIC SEQUENCE (hCG1643838) |
| 479. | HUMAN mRNA SEQUENCE (hCT1643965) |
| 480. | HUMAN PROTEIN SEQUENCE (hCP1604810) |
| | CANCER GENE: mCG15397/hCG39530 |
| 481. | MOUSE GENOMIC SEQUENCE (mCG15397) |
| 482. | MOUSE mRNA SEQUENCE (mCT15954) |
| 483. | MOUSE PROTEIN SEQUENCE (mCP5676) |
| 484. | HUMAN GENOMIC SEQUENCE (hCG39530) |
| 485. | HUMAN mRNA SEQUENCE (hCT30781) |
| 486. | HUMAN PROTEIN SEQUENCE (hCP49320) |
| | CANCER GENE: mCG15498/hCG15009 |
| 487. | MOUSE GENOMIC SEQUENCE (mCG15498) |
| 488. | MOUSE mRNA SEQUENCE (mCT17826) |
| 489. | MOUSE PROTEIN SEQUENCE (mCP18112) |
| 490. | HUMAN GENOMIC SEQUENCE (hCG15009) |
| 491. | HUMAN mRNA SEQUENCE (hCT6030) |
| 492. | HUMAN PROTEIN SEQUENCE (hCP35899) |
| | CANCER GENE: mCG15520/hCG36837 |
| 493. | MOUSE GENOMIC SEQUENCE (mCG15520) |
| 494. | MOUSE mRNA SEQUENCE (mCT17722) |
| 495. | MOUSE PROTEIN SEQUENCE (mCP20948) |
| 496. | HUMAN GENOMIC SEQUENCE (hCG36837) |
| 497. | HUMAN mRNA SEQUENCE (hCT1950131) |
| 498. | HUMAN PROTEIN SEQUENCE (hCP1763610) |
| | CANCER GENE: mCG15521/hCG37331 |
| 499. | MOUSE GENOMIC SEQUENCE (mCG15521) |
| 500. | MOUSE mRNA SEQUENCE (mCT17719) |
| 501. | MOUSE PROTEIN SEQUENCE (mCP20949) |
| 502. | HUMAN GENOMIC SEQUENCE (hCG37331) |
| 503. | HUMAN mRNA SEQUENCE (hCT28564) |
| 504. | HUMAN PROTEIN SEQUENCE (hCP47335) |
| | CANCER GENE: mCG15594/hCG15786 |
| 505. | MOUSE GENOMIC SEQUENCE (mCG15594) |
| 506. | MOUSE mRNA SEQUENCE (mCT18732) |
| 507. | MOUSE PROTEIN SEQUENCE (mCP23704) |
| 508. | HUMAN GENOMIC SEQUENCE (hCG15786) |
| 509. | HUMAN mRNA SEQUENCE (hCT6815) |
| 510. | HUMAN PROTEIN SEQUENCE (hCP34293) |
| | CANCER GENE: mCG15699/hCG27588 |
| 511. | MOUSE GENOMIC SEQUENCE (mCG15699) |
| 512. | MOUSE mRNA SEQUENCE (mCT18581) |
| 513. | MOUSE PROTEIN SEQUENCE (mCP7304) |
| 514. | HUMAN GENOMIC SEQUENCE (hCG27588) |
| 515. | HUMAN mRNA SEQUENCE (hCT18729) |
| 516. | HUMAN PROTEIN SEQUENCE (hCP43155) |
| | CANCER GENE: mCG15703/hCG23995 |
| 517. | MOUSE GENOMIC SEQUENCE (mCG15703) |
| 518. | MOUSE mRNA SEQUENCE (mCT19437) |
| 519. | MOUSE PROTEIN SEQUENCE (mCP2310) |
| 520. | HUMAN GENOMIC SEQUENCE (hCG23995) |
| 521. | HUMAN mRNA SEQUENCE (hCT15109) |
| 522. | HUMAN PROTEIN SEQUENCE (hCP41355) |
| | CANCER GENE: mCG15868/hCG19397 |
| 523. | MOUSE GENOMIC SEQUENCE (mCG15868) |
| 524. | MOUSE mRNA SEQUENCE (mCT12593) |
| 525. | MOUSE PROTEIN SEQUENCE (mCP15102) |
| 526. | HUMAN GENOMIC SEQUENCE (hCG19397) |
| 527. | HUMAN mRNA SEQUENCE (hCT10466) |
| 528. | HUMAN PROTEIN SEQUENCE (hCP37122) |

TABLE 2-continued

IDENTIFICATION OF SEQUENCES

| SEQ ID NOS. | SEQUENCES |
|---|---|
| | CANCER GENE: mCG15870/hCG18268 |
| 529. | MOUSE GENOMIC SEQUENCE (mCG15870) |
| 530. | MOUSE mRNA SEQUENCE (mCT12595) |
| 531. | MOUSE PROTEIN SEQUENCE (mCP15106) |
| 532. | HUMAN GENOMIC SEQUENCE (hCG18268) |
| 533. | HUMAN mRNA SEQUENCE (hCT9326) |
| 534. | HUMAN PROTEIN SEQUENCE (hCP36124) |
| | CANCER GENE: mCG1589/hCG28214 |
| 535. | MOUSE GENOMIC SEQUENCE (mCG1589) |
| 536. | MOUSE mRNA SEQUENCE (mCT8415) |
| 537. | MOUSE PROTEIN SEQUENCE (mCP13496) |
| 538. | HUMAN GENOMIC SEQUENCE (hCG28214) |
| 539. | HUMAN mRNA SEQUENCE (hCT19362) |
| 540. | HUMAN PROTEIN SEQUENCE (hCP44085) |
| | CANCER GENE: mCG1596/hCG28803 |
| 541. | MOUSE GENOMIC SEQUENCE (mCG1596) |
| 542. | MOUSE mRNA SEQUENCE (mCT8422) |
| 543. | MOUSE PROTEIN SEQUENCE (mCP13477) |
| 544. | HUMAN GENOMIC SEQUENCE (hCG28803) |
| 545. | HUMAN mRNA SEQUENCE (hCT19958) |
| 546. | HUMAN PROTEIN SEQUENCE (hCP44159) |
| | CANCER GENE: mCG15964/hCG1762872 |
| 547. | MOUSE GENOMIC SEQUENCE (mCG15964) |
| 548. | MOUSE mRNA SEQUENCE (mCT14238) |
| 549. | MOUSE PROTEIN SEQUENCE (mCP21067) |
| 550. | HUMAN GENOMIC SEQUENCE (hCG1762872) |
| 551. | HUMAN mRNA SEQUENCE (hCT1801372) |
| 552. | HUMAN PROTEIN SEQUENCE (hCP1720579) |
| | CANCER GENE: mCG16052/hCG15409 |
| 553. | MOUSE GENOMIC SEQUENCE (mCG16052) |
| 554. | MOUSE mRNA SEQUENCE (mCT15245) |
| 555. | MOUSE PROTEIN SEQUENCE (mCP8454) |
| 556. | HUMAN GENOMIC SEQUENCE (hCG15409) |
| 557. | HUMAN mRNA SEQUENCE (hCT6431) |
| 558. | HUMAN PROTEIN SEQUENCE (hCP35788) |
| | CANCER GENE: mCG16071/hCG23219 |
| 559. | MOUSE GENOMIC SEQUENCE (mCG16071) |
| 560. | MOUSE mRNA SEQUENCE (mCT15608) |
| 561. | MOUSE PROTEIN SEQUENCE (mCP22427) |
| 562. | HUMAN GENOMIC SEQUENCE (hCG23219) |
| 563. | HUMAN mRNA SEQUENCE (hCT14324) |
| 564. | HUMAN PROTEIN SEQUENCE (hCP40628) |
| | CANCER GENE: mCG16088/hCG33697 |
| 565. | MOUSE GENOMIC SEQUENCE (mCG16088) |
| 566. | MOUSE mRNA SEQUENCE (mCT15460) |
| 567. | MOUSE PROTEIN SEQUENCE (mCP22413) |
| 568. | HUMAN GENOMIC SEQUENCE (hCG33697) |
| 569. | HUMAN mRNA SEQUENCE (hCT1686732) |
| 570. | HUMAN PROTEIN SEQUENCE (hCP1689982) |
| | CANCER GENE: mCG16239/hCG21559 |
| 571. | MOUSE GENOMIC SEQUENCE (mCG16239) |
| 572. | MOUSE mRNA SEQUENCE (mCT16666) |
| 573. | MOUSE PROTEIN SEQUENCE (mCP12669) |
| 574. | HUMAN GENOMIC SEQUENCE (hCG21559) |
| 575. | HUMAN mRNA SEQUENCE (hCT12651) |
| 576. | HUMAN PROTEIN SEQUENCE (hCP39092) |
| | CANCER GENE: mCG16291/hCG1737652 |
| 577. | MOUSE GENOMIC SEQUENCE (mCG16291) |
| 578. | MOUSE mRNA SEQUENCE (mCT17032) |
| 579. | MOUSE PROTEIN SEQUENCE (mCP21575) |
| 580. | HUMAN GENOMIC SEQUENCE (hCG1737652) |
| 581. | HUMAN mRNA SEQUENCE (hCT1775695) |
| 582. | HUMAN PROTEIN SEQUENCE (hCP1712193) |
| | CANCER GENE: mCG16365/hCG1640204 |
| 583. | MOUSE GENOMIC SEQUENCE (mCG16365) |
| 584. | MOUSE mRNA SEQUENCE (mCT17616) |
| 585. | MOUSE PROTEIN SEQUENCE (mCP8330) |
| 586. | HUMAN GENOMIC SEQUENCE (hCG1640204) |
| 587. | HUMAN mRNA SEQUENCE (hCT1640331) |
| 588. | HUMAN PROTEIN SEQUENCE (hCP1627012) |
| | CANCER GENE: mCG16394/hCG20537 |
| 589. | MOUSE GENOMIC SEQUENCE (mCG16394) |
| 590. | MOUSE mRNA SEQUENCE (mCT17518) |
| 591. | MOUSE PROTEIN SEQUENCE (mCP4839) |
| 592. | HUMAN GENOMIC SEQUENCE (hCG20537) |
| 593. | HUMAN mRNA SEQUENCE (hCT11616) |
| 594. | HUMAN PROTEIN SEQUENCE (hCP38217) |
| | CANCER GENE: mCG16401/hCG20994 |
| 595. | MOUSE GENOMIC SEQUENCE (mCG16401) |
| 596. | MOUSE mRNA SEQUENCE (mCT17724) |
| 597. | MOUSE PROTEIN SEQUENCE (mCP3126) |
| 598. | HUMAN GENOMIC SEQUENCE (hCG20994) |
| 599. | HUMAN mRNA SEQUENCE (hCT12078) |
| 600. | HUMAN PROTEIN SEQUENCE (hCP38844) |
| | CANCER GENE: mCG1647/hCG25929 |
| 601. | MOUSE GENOMIC SEQUENCE (mCG1647) |
| 602. | MOUSE mRNA SEQUENCE (mCT7922) |
| 603. | MOUSE PROTEIN SEQUENCE (mCP21806) |
| 604. | HUMAN GENOMIC SEQUENCE (hCG25929) |
| 605. | HUMAN mRNA SEQUENCE (hCT17057) |
| 606. | HUMAN PROTEIN SEQUENCE (hCP42506) |
| | CANCER GENE: mCG1659/hCG32809 |
| 607. | MOUSE GENOMIC SEQUENCE (mCG1659) |
| 608. | MOUSE mRNA SEQUENCE (mCT8196) |
| 609. | MOUSE PROTEIN SEQUENCE (mCP21822) |
| 610. | HUMAN GENOMIC SEQUENCE (hCG32809) |
| 611. | HUMAN mRNA SEQUENCE (hCT24001) |
| 612. | HUMAN PROTEIN SEQUENCE (hCP46172) |
| | CANCER GENE: mCG16601/hCG17315 |
| 613. | MOUSE GENOMIC SEQUENCE (mCG16601) |
| 614. | MOUSE mRNA SEQUENCE (mCT19044) |
| 615. | MOUSE PROTEIN SEQUENCE (mCP8830) |
| 616. | HUMAN GENOMIC SEQUENCE (hCG17315) |
| 617. | HUMAN mRNA SEQUENCE (hCT8365) |
| 618. | HUMAN PROTEIN SEQUENCE (hCP34268) |
| | CANCER GENE: mCG16720/hCG18035 |
| 619. | MOUSE GENOMIC SEQUENCE (mCG16720) |
| 620. | MOUSE mRNA SEQUENCE (mCT12987) |
| 621. | MOUSE PROTEIN SEQUENCE (mCP8906) |
| 622. | HUMAN GENOMIC SEQUENCE (hCG18035) |
| 623. | HUMAN mRNA SEQUENCE (hCT9090) |
| 624. | HUMAN PROTEIN SEQUENCE (hCP36078) |
| | CANCER GENE: mCG16843/hCG37968 |
| 625. | MOUSE GENOMIC SEQUENCE (mCG16843) |
| 626. | MOUSE mRNA SEQUENCE (mCT14357) |
| 627. | MOUSE PROTEIN SEQUENCE (mCP9711) |
| 628. | HUMAN GENOMIC SEQUENCE (hCG37968) |
| 629. | HUMAN mRNA SEQUENCE (hCT29205) |
| 630. | HUMAN PROTEIN SEQUENCE (hCP47985) |
| | CANCER GENE: mCG16845/hCG37971 |
| 631. | MOUSE GENOMIC SEQUENCE (mCG16845) |
| 632. | MOUSE mRNA SEQUENCE (mCT14351) |
| 633. | MOUSE PROTEIN SEQUENCE (mCP9550) |
| 634. | HUMAN GENOMIC SEQUENCE (hCG37971) |
| 635. | HUMAN mRNA SEQUENCE (hCT29208) |
| 636. | HUMAN PROTEIN SEQUENCE (hCP47989) |

TABLE 2-continued

IDENTIFICATION OF SEQUENCES

| SEQ ID NOS. | SEQUENCES |
|---|---|
| | CANCER GENE: mCG16880/hCG22479 |
| 637. | MOUSE GENOMIC SEQUENCE (mCG16880) |
| 638. | MOUSE mRNA SEQUENCE (mCT14257) |
| 639. | MOUSE PROTEIN SEQUENCE (mCP16563) |
| 640. | HUMAN GENOMIC SEQUENCE (hCG22479) |
| 641. | HUMAN mRNA SEQUENCE (hCT13576) |
| 642. | HUMAN PROTEIN SEQUENCE (hCP39968) |
| | CANCER GENE: mCG16923/hCG25643 |
| 643. | MOUSE GENOMIC SEQUENCE (mCG16923) |
| 644. | MOUSE mRNA SEQUENCE (mCT14870) |
| 645. | MOUSE PROTEIN SEQUENCE (mCP15343) |
| 646. | HUMAN GENOMIC SEQUENCE (hCG25643) |
| 647. | HUMAN mRNA SEQUENCE (hCT16768) |
| 648. | HUMAN PROTEIN SEQUENCE (hCP42329) |
| | CANCER GENE: mCG16959/hCG25303 |
| 649. | MOUSE GENOMIC SEQUENCE (mCG16959) |
| 650. | MOUSE mRNA SEQUENCE (mCT14701) |
| 651. | MOUSE PROTEIN SEQUENCE (mCP12909) |
| 652. | HUMAN GENOMIC SEQUENCE (hCG25303) |
| 653. | HUMAN mRNA SEQUENCE (hCT16428) |
| 654. | HUMAN PROTEIN SEQUENCE (hCP42229) |
| | CANCER GENE: mCG16994/hCG36856 |
| 655. | MOUSE GENOMIC SEQUENCE (mCG16994) |
| 656. | MOUSE mRNA SEQUENCE (mCT15290) |
| 657. | MOUSE PROTEIN SEQUENCE (mCP12482) |
| 658. | HUMAN GENOMIC SEQUENCE (hCG36856) |
| 659. | HUMAN mRNA SEQUENCE (hCT28086) |
| 660. | HUMAN PROTEIN SEQUENCE (hCP47065) |
| | CANCER GENE: mCG17013/hCG24994 |
| 661. | MOUSE GENOMIC SEQUENCE (mCG17013) |
| 662. | MOUSE mRNA SEQUENCE (mCT15957) |
| 663. | MOUSE PROTEIN SEQUENCE (mCP4389) |
| 664. | HUMAN GENOMIC SEQUENCE (hCG24994) |
| 665. | HUMAN mRNA SEQUENCE (hCT16115) |
| 666. | HUMAN PROTEIN SEQUENCE (hCP42010) |
| | CANCER GENE: mCG17035/hCG1778746 |
| 667. | MOUSE GENOMIC SEQUENCE (mCG17035) |
| 668. | MOUSE mRNA SEQUENCE (mCT15983) |
| 669. | MOUSE PROTEIN SEQUENCE (mCP4460) |
| 670. | HUMAN GENOMIC SEQUENCE (hCG1778746) |
| 671. | HUMAN mRNA SEQUENCE (hCT1817524) |
| 672. | HUMAN PROTEIN SEQUENCE (hCP1725406) |
| | CANCER GENE: mCG17138/hCG33187 |
| 673. | MOUSE GENOMIC SEQUENCE (mCG17138) |
| 674. | MOUSE mRNA SEQUENCE (mCT16443) |
| 675. | MOUSE PROTEIN SEQUENCE (mCP12938) |
| 676. | HUMAN GENOMIC SEQUENCE (hCG33187) |
| 677. | HUMAN mRNA SEQUENCE (hCT24380) |
| 678. | HUMAN PROTEIN SEQUENCE (hCP46555) |
| | CANCER GENE: mCG17164/hCG40741 |
| 679. | MOUSE GENOMIC SEQUENCE (mCG17164) |
| 680. | MOUSE mRNA SEQUENCE (mCT16512) |
| 681. | MOUSE PROTEIN SEQUENCE (mCP1077) |
| 682. | HUMAN GENOMIC SEQUENCE (hCG40741) |
| 683. | HUMAN mRNA SEQUENCE (hCT32001) |
| 684. | HUMAN PROTEIN SEQUENCE (hCP50502) |
| | CANCER GENE: mCG17208/hCG40378 |
| 685. | MOUSE GENOMIC SEQUENCE (mCG17208) |
| 686. | MOUSE mRNA SEQUENCE (mCT16566) |
| 687. | MOUSE PROTEIN SEQUENCE (mCP5428) |
| 688. | HUMAN GENOMIC SEQUENCE (hCG40378) |
| 689. | HUMAN mRNA SEQUENCE (hCT1820899) |
| 690. | HUMAN PROTEIN SEQUENCE (hCP1735072) |
| | CANCER GENE: mCG17242/hCG25680 |
| 691. | MOUSE GENOMIC SEQUENCE (mCG17242) |
| 692. | MOUSE mRNA SEQUENCE (mCT12837) |
| 693. | MOUSE PROTEIN SEQUENCE (mCP17611) |
| 694. | HUMAN GENOMIC SEQUENCE (hCG25680) |
| 695. | HUMAN mRNA SEQUENCE (hCT16805) |
| 696. | HUMAN PROTEIN SEQUENCE (hCP42378) |
| | CANCER GENE: mCG17259/hCG19476 |
| 697. | MOUSE GENOMIC SEQUENCE (mCG17259) |
| 698. | MOUSE mRNA SEQUENCE (mCT16960) |
| 699. | MOUSE PROTEIN SEQUENCE (mCP13878) |
| 700. | HUMAN GENOMIC SEQUENCE (hCG19476) OK |
| 701. | HUMAN mRNA SEQUENCE (hCT10546) |
| 702. | HUMAN PROTEIN SEQUENCE (hCP37525) |
| | CANCER GENE: mCG17323/hCG32158 |
| 703. | MOUSE GENOMIC SEQUENCE (mCG17323) |
| 704. | MOUSE mRNA SEQUENCE (mCT17574) |
| 705. | MOUSE PROTEIN SEQUENCE (mCP9792) |
| 706. | HUMAN GENOMIC SEQUENCE (hCG32158) |
| 707. | HUMAN mRNA SEQUENCE (hCT23346) |
| 708. | HUMAN PROTEIN SEQUENCE (hCP46392) |
| | CANCER GENE: mCG17383/hCG28354 |
| 709. | MOUSE GENOMIC SEQUENCE (mCG17383) |
| 710. | MOUSE mRNA SEQUENCE (mCT18403) |
| 711. | MOUSE PROTEIN SEQUENCE (mCP18722) |
| 712. | HUMAN GENOMIC SEQUENCE (hCG28354) |
| 713. | HUMAN mRNA SEQUENCE (hCT19506) |
| 714. | HUMAN PROTEIN SEQUENCE (hCP43838) |
| | CANCER GENE: mCG17557/hCG99255 |
| 715. | MOUSE GENOMIC SEQUENCE (mCG17557) |
| 716. | MOUSE mRNA SEQUENCE (mCT14213) |
| 717. | MOUSE PROTEIN SEQUENCE (mCP17279) |
| 718. | HUMAN GENOMIC SEQUENCE (hCG99255) |
| 719. | HUMAN mRNA SEQUENCE (hCT1950804) |
| 720. | HUMAN PROTEIN SEQUENCE (hCP1764431) |
| | CANCER GENE: mCG17867/hCG33515 |
| 721. | MOUSE GENOMIC SEQUENCE (mCG17867) |
| 722. | MOUSE mRNA SEQUENCE (mCT16792) |
| 723. | MOUSE PROTEIN SEQUENCE (mCP6346) |
| 724. | HUMAN GENOMIC SEQUENCE (hCG33515) |
| 725. | HUMAN mRNA SEQUENCE (hCT24713) |
| 726. | HUMAN PROTEIN SEQUENCE (hCP46767) |
| | CANCER GENE: mCG17870/hCG32959 |
| 727. | MOUSE GENOMIC SEQUENCE (mCG17870) |
| 728. | MOUSE mRNA SEQUENCE (mCT16795) |
| 729. | MOUSE PROTEIN SEQUENCE (mCP6341) |
| 730. | HUMAN GENOMIC SEQUENCE (hCG32959) |
| 731. | HUMAN mRNA SEQUENCE (hCT24151) |
| 732. | HUMAN PROTEIN SEQUENCE (hCP46769) |
| | CANCER GENE: mCG17886/hCG20908 |
| 733. | MOUSE GENOMIC SEQUENCE (mCG17886) |
| 734. | MOUSE mRNA SEQUENCE (mCT16809) |
| 735. | MOUSE PROTEIN SEQUENCE (mCP15214) |
| 736. | HUMAN GENOMIC SEQUENCE (hCG20908) |
| 737. | HUMAN mRNA SEQUENCE (hCT11990) |
| 738. | HUMAN PROTEIN SEQUENCE (hCP40309) |
| | CANCER GENE: mCG17943/hCG17932 |
| 739. | MOUSE GENOMIC SEQUENCE (mCG17943) |
| 740. | MOUSE mRNA SEQUENCE (mCT17820) |
| 741. | MOUSE PROTEIN SEQUENCE (mCP12846) |
| 742. | HUMAN GENOMIC SEQUENCE (hCG17932) |
| 743. | HUMAN mRNA SEQUENCE (hCT8986) |
| 744. | HUMAN PROTEIN SEQUENCE (hCP36538) |

TABLE 2-continued

IDENTIFICATION OF SEQUENCES

| SEQ ID NOS. | SEQUENCES |
|---|---|
| | CANCER GENE: mCG17984/hCG33404 |
| 745. | MOUSE GENOMIC SEQUENCE (mCG17984) |
| 746. | MOUSE mRNA SEQUENCE (mCT18062) |
| 747. | MOUSE PROTEIN SEQUENCE (mCP22360) |
| 748. | HUMAN GENOMIC SEQUENCE (hCG33404) |
| 749. | HUMAN mRNA SEQUENCE (hCT24598) |
| 750. | HUMAN PROTEIN SEQUENCE (hCP46712) |
| | CANCER GENE: mCG18016/hCG17121 |
| 751. | MOUSE GENOMIC SEQUENCE (mCG18016) |
| 752. | MOUSE mRNA SEQUENCE (mCT18967) |
| 753. | MOUSE PROTEIN SEQUENCE (mCP8856) |
| 754. | HUMAN GENOMIC SEQUENCE (hCG17121) |
| 755. | HUMAN mRNA SEQUENCE (hCT8169) |
| 756. | HUMAN PROTEIN SEQUENCE (hCP36778) |
| | CANCER GENE: mCG18026/hCG17346 |
| 757. | MOUSE GENOMIC SEQUENCE (mCG18026) |
| 758. | MOUSE mRNA SEQUENCE (mCT18976) |
| 759. | MOUSE PROTEIN SEQUENCE (mCP8941) |
| 760. | HUMAN GENOMIC SEQUENCE (hCG17346) |
| 761. | HUMAN mRNA SEQUENCE (hCT8396) |
| 762. | HUMAN PROTEIN SEQUENCE (hCP33988) |
| | CANCER GENE: mCG18081/hCG38701 |
| 763. | MOUSE GENOMIC SEQUENCE (mCG18081) |
| 764. | MOUSE mRNA SEQUENCE (mCT19515) |
| 765. | MOUSE PROTEIN SEQUENCE (mCP17668) |
| 766. | HUMAN GENOMIC SEQUENCE (hCG38701) |
| 767. | HUMAN mRNA SEQUENCE (hCT29945) |
| 768. | HUMAN PROTEIN SEQUENCE (hCP48559) |
| | CANCER GENE: mCG18084/hCG39597 |
| 769. | MOUSE GENOMIC SEQUENCE (mCG18084) |
| 770. | MOUSE mRNA SEQUENCE (mCT19672) |
| 771. | MOUSE PROTEIN SEQUENCE (mCP9465) |
| 772. | HUMAN GENOMIC SEQUENCE (hCG39597) |
| 773. | HUMAN mRNA SEQUENCE (hCT30849) |
| 774. | HUMAN PROTEIN SEQUENCE (hCP51029) |
| | CANCER GENE: mCG18240/hCG18999 |
| 775. | MOUSE GENOMIC SEQUENCE (mCG18240) |
| 776. | MOUSE mRNA SEQUENCE (mCT12803) |
| 777. | MOUSE PROTEIN SEQUENCE (mCP15553) |
| 778. | HUMAN GENOMIC SEQUENCE (hCG18999) |
| 779. | HUMAN mRNA SEQUENCE (hCT10064) |
| 780. | HUMAN PROTEIN SEQUENCE (hCP37164) |
| | CANCER GENE: mCG1828/hCG1640193 |
| 781. | MOUSE GENOMIC SEQUENCE (mCG1828) |
| 782. | MOUSE mRNA SEQUENCE (mCT7778) |
| 783. | MOUSE PROTEIN SEQUENCE (mCP20760) |
| 784. | HUMAN GENOMIC SEQUENCE (hCG1640193) |
| 785. | HUMAN mRNA SEQUENCE (hCT1640320) |
| 786. | HUMAN PROTEIN SEQUENCE (hCP1630135) |
| | CANCER GENE: mCG18281/hCG16651 |
| 787. | MOUSE GENOMIC SEQUENCE (mCG18281) |
| 788. | MOUSE mRNA SEQUENCE (mCT12157) |
| 789. | MOUSE PROTEIN SEQUENCE (mCP1250) |
| 790. | HUMAN GENOMIC SEQUENCE (hCG16651) |
| 791. | HUMAN mRNA SEQUENCE (hCT7691) |
| 792. | HUMAN PROTEIN SEQUENCE (hCP37038) |
| | CANCER GENE: mCG18404/hCG20204 |
| 793. | MOUSE GENOMIC SEQUENCE (mCG18404) |
| 794. | MOUSE mRNA SEQUENCE (mCT11039) |
| 795. | MOUSE PROTEIN SEQUENCE (mCP9566) |
| 796. | HUMAN GENOMIC SEQUENCE (hCG20204) |
| 797. | HUMAN mRNA SEQUENCE (hCT11279) |
| 798. | HUMAN PROTEIN SEQUENCE (hCP37942) |
| | CANCER GENE: mCG18525/hCG15773 |
| 799. | MOUSE GENOMIC SEQUENCE (mCG18525) |
| 800. | MOUSE mRNA SEQUENCE (mCT14781) |
| 801. | MOUSE PROTEIN SEQUENCE (mCP23199) |
| 802. | HUMAN GENOMIC SEQUENCE (hCG15773) |
| 803. | HUMAN mRNA SEQUENCE (hCT6802) |
| 804. | HUMAN PROTEIN SEQUENCE (hCP35354) |
| | CANCER GENE: mCG18554/hCG18551 |
| 805. | MOUSE GENOMIC SEQUENCE (mCG18554) |
| 806. | MOUSE mRNA SEQUENCE (mCT14744) |
| 807. | MOUSE PROTEIN SEQUENCE (mCP19483) |
| 808. | HUMAN GENOMIC SEQUENCE (hCG18551) |
| 809. | HUMAN mRNA SEQUENCE (hCT1950575) |
| 810. | HUMAN PROTEIN SEQUENCE (hCP1752475) |
| | CANCER GENE: mCG18573/hCG18549 |
| 811. | MOUSE GENOMIC SEQUENCE (mCG18573) |
| 812. | MOUSE mRNA SEQUENCE (mCT14853) |
| 813. | MOUSE PROTEIN SEQUENCE (mCP19435) |
| 814. | HUMAN GENOMIC SEQUENCE (hCG18549) |
| 815. | HUMAN mRNA SEQUENCE (hCT1950572) |
| 816. | HUMAN PROTEIN SEQUENCE (hCP1766593) |
| | CANCER GENE: mCG18577/hCG28278 |
| 817. | MOUSE GENOMIC SEQUENCE (mCG18577) |
| 818. | MOUSE mRNA SEQUENCE (mCT14857) |
| 819. | MOUSE PROTEIN SEQUENCE (mCP19656) |
| 820. | HUMAN GENOMIC SEQUENCE (hCG28278) |
| 821. | HUMAN mRNA SEQUENCE (hCT19426) |
| 822. | HUMAN PROTEIN SEQUENCE (hCP43771) |
| | CANCER GENE: mCG18584/hCG20056 |
| 823. | MOUSE GENOMIC SEQUENCE (mCG18584) |
| 824. | MOUSE mRNA SEQUENCE (mCT14726) |
| 825. | MOUSE PROTEIN SEQUENCE (mCP7085) |
| 826. | HUMAN GENOMIC SEQUENCE (hCG20056) |
| 827. | HUMAN mRNA SEQUENCE (hCT11129) |
| 828. | HUMAN PROTEIN SEQUENCE (hCP38832) |
| | CANCER GENE: mCG18590/hCG21253 |
| 829. | MOUSE GENOMIC SEQUENCE (mCG18590) |
| 830. | MOUSE mRNA SEQUENCE (mCT14732) |
| 831. | MOUSE PROTEIN SEQUENCE (mCP7070) |
| 832. | HUMAN GENOMIC SEQUENCE (hCG21253) |
| 833. | HUMAN mRNA SEQUENCE (hCT12340) |
| 834. | HUMAN PROTEIN SEQUENCE (hCP38816) |
| | CANCER GENE: mCG18632/hCG19781 |
| 835. | MOUSE GENOMIC SEQUENCE (mCG18632) |
| 836. | MOUSE mRNA SEQUENCE (mCT14990) |
| 837. | MOUSE PROTEIN SEQUENCE (mCP5574) |
| 838. | HUMAN GENOMIC SEQUENCE (hCG19781) |
| 839. | HUMAN mRNA SEQUENCE (hCT10853) |
| 840. | HUMAN PROTEIN SEQUENCE (hCP37496) |
| | CANCER GENE: mCG1867/hCG41365 |
| 841. | MOUSE GENOMIC SEQUENCE (mCG1867) |
| 842. | MOUSE mRNA SEQUENCE (mCT8103) |
| 843. | MOUSE PROTEIN SEQUENCE (mCP8903) |
| 844. | HUMAN GENOMIC SEQUENCE (hCG41365) |
| 845. | HUMAN mRNA SEQUENCE (hCT1952548) |
| 846. | HUMAN PROTEIN SEQUENCE (hCP1751079) |
| | CANCER GENE: mCG18746/hCG1780827 |
| 847. | MOUSE GENOMIC SEQUENCE (mCG18746) |
| 848. | MOUSE mRNA SEQUENCE (mCT15145) |
| 849. | MOUSE PROTEIN SEQUENCE (mCP19420) |
| 850. | HUMAN GENOMIC SEQUENCE (hCG1780827) |
| 851. | HUMAN mRNA SEQUENCE (hCT1819672) |
| 852. | HUMAN PROTEIN SEQUENCE (hCP1699110) |

TABLE 2-continued

IDENTIFICATION OF SEQUENCES

| SEQ ID NOS. | SEQUENCES |
|---|---|
| | CANCER GENE: mCG18928/hCG41574 |
| 853. | MOUSE GENOMIC SEQUENCE (mCG18928) |
| 854. | MOUSE mRNA SEQUENCE (mCT16310) |
| 855. | MOUSE PROTEIN SEQUENCE (mCP9514) |
| 856. | HUMAN GENOMIC SEQUENCE (hCG41574) |
| 857. | HUMAN mRNA SEQUENCE (hCT32846) |
| 858. | HUMAN PROTEIN SEQUENCE (hCP51438) |
| | CANCER GENE: mCG19018/hCG27894 |
| 859. | MOUSE GENOMIC SEQUENCE (mCG19018) |
| 860. | MOUSE mRNA SEQUENCE (mCT16908) |
| 861. | MOUSE PROTEIN SEQUENCE (mCP1516) |
| 862. | HUMAN GENOMIC SEQUENCE (hCG27894) |
| 863. | HUMAN mRNA SEQUENCE (hCT19037) |
| 864. | HUMAN PROTEIN SEQUENCE (hCP43456) |
| | CANCER GENE: mCG19046/hCG40314 |
| 865. | MOUSE GENOMIC SEQUENCE (mCG19046) |
| 866. | MOUSE mRNA SEQUENCE (mCT16990) |
| 867. | MOUSE PROTEIN SEQUENCE (mCP16883) |
| 868. | HUMAN GENOMIC SEQUENCE (hCG40314) |
| 869. | HUMAN mRNA SEQUENCE (hCT31569) |
| 870. | HUMAN PROTEIN SEQUENCE (hCP50078) |
| | CANCER GENE: mCG19072/hCG15138 |
| 871. | MOUSE GENOMIC SEQUENCE (mCG19072) |
| 872. | MOUSE mRNA SEQUENCE (mCT17004) |
| 873. | MOUSE PROTEIN SEQUENCE (mCP8457) |
| 874. | HUMAN GENOMIC SEQUENCE (hCG15138) |
| 875. | HUMAN mRNA SEQUENCE (hCT6159) |
| 876. | HUMAN PROTEIN SEQUENCE (hCP33301) |
| | CANCER GENE: mCG19106/hCG16291 |
| 877. | MOUSE GENOMIC SEQUENCE (mCG19106) |
| 878. | MOUSE mRNA SEQUENCE (mCT18122) |
| 879. | MOUSE PROTEIN SEQUENCE (mCP2823) |
| 880. | HUMAN GENOMIC SEQUENCE (hCG16291) |
| 881. | HUMAN mRNA SEQUENCE (hCT7327) |
| 882. | HUMAN PROTEIN SEQUENCE (hCP35582) |
| | CANCER GENE: mCG19156/hCG27607 |
| 883. | MOUSE GENOMIC SEQUENCE (mCG19156) |
| 884. | MOUSE mRNA SEQUENCE (mCT17748) |
| 885. | MOUSE PROTEIN SEQUENCE (mCP14606) |
| 886. | HUMAN GENOMIC SEQUENCE (hCG27607) |
| 887. | HUMAN mRNA SEQUENCE (hCT1952652) |
| 888. | HUMAN PROTEIN SEQUENCE (hCP1763679) |
| | CANCER GENE: mCG19208/hCG20766 |
| 889. | MOUSE GENOMIC SEQUENCE (mCG19208) |
| 890. | MOUSE mRNA SEQUENCE (mCT17801) |
| 891. | MOUSE PROTEIN SEQUENCE (mCP3161) |
| 892. | HUMAN GENOMIC SEQUENCE (hCG20766) |
| 893. | HUMAN mRNA SEQUENCE (hCT11846) |
| 894. | HUMAN PROTEIN SEQUENCE (hCP39739) |
| | CANCER GENE: mCG19209/hCG22243 |
| 895. | MOUSE GENOMIC SEQUENCE (mCG19209) |
| 896. | MOUSE mRNA SEQUENCE (mCT17802) |
| 897. | MOUSE PROTEIN SEQUENCE (mCP3189) |
| 898. | HUMAN GENOMIC SEQUENCE (hCG22243) |
| 899. | HUMAN mRNA SEQUENCE (hCT13336) |
| 900. | HUMAN PROTEIN SEQUENCE (hCP39738) |
| | CANCER GENE: mCG19250/hCG27772 |
| 901. | MOUSE GENOMIC SEQUENCE (mCG19250) |
| 902. | MOUSE mRNA SEQUENCE (mCT18452) |
| 903. | MOUSE PROTEIN SEQUENCE (mCP22058) |
| 904. | HUMAN GENOMIC SEQUENCE (hCG27772) |
| 905. | HUMAN mRNA SEQUENCE (hCT18914) |
| 906. | HUMAN PROTEIN SEQUENCE (hCP43333) |

TABLE 2-continued

IDENTIFICATION OF SEQUENCES

| SEQ ID NOS. | SEQUENCES |
|---|---|
| | CANCER GENE: mCG19287/hCG1748307 |
| 907. | MOUSE GENOMIC SEQUENCE (mCG19287) |
| 908. | MOUSE mRNA SEQUENCE (mCT18854) |
| 909. | MOUSE PROTEIN SEQUENCE (mCP22301) |
| 910. | HUMAN GENOMIC SEQUENCE (hCG1748307) |
| 911. | HUMAN mRNA SEQUENCE (hCT1786681) |
| 912. | HUMAN PROTEIN SEQUENCE (hCP1732005) |
| | CANCER GENE: mCG19337/hCG28784 |
| 913. | MOUSE GENOMIC SEQUENCE (mCG19337) |
| 914. | MOUSE mRNA SEQUENCE (mCT18618) |
| 915. | MOUSE PROTEIN SEQUENCE (mCP15257) |
| 916. | HUMAN GENOMIC SEQUENCE (hCG28784) |
| 917. | HUMAN mRNA SEQUENCE (hCT19939) |
| 918. | HUMAN PROTEIN SEQUENCE (hCP44152) |
| | CANCER GENE: mCG19401/hCG38450 |
| 919. | MOUSE GENOMIC SEQUENCE (mCG19401) |
| 920. | MOUSE mRNA SEQUENCE (mCT18996) |
| 921. | MOUSE PROTEIN SEQUENCE (mCP17117) |
| 922. | HUMAN GENOMIC SEQUENCE (hCG38450) |
| 923. | HUMAN mRNA SEQUENCE (hCT29693) |
| 924. | HUMAN PROTEIN SEQUENCE (hCP48354) |
| | CANCER GENE: mCG1941/hCG40854 |
| 925. | MOUSE GENOMIC SEQUENCE (mCG1941) |
| 926. | MOUSE mRNA SEQUENCE (mCT8323) |
| 927. | MOUSE PROTEIN SEQUENCE (mCP9809) |
| 928. | HUMAN GENOMIC SEQUENCE (hCG40854) |
| 929. | HUMAN mRNA SEQUENCE (hCT32121) |
| 930. | HUMAN PROTEIN SEQUENCE (hCP50646) |
| | CANCER GENE: mCG1961/hCG40844 |
| 931. | MOUSE GENOMIC SEQUENCE (mCG1961) |
| 932. | MOUSE mRNA SEQUENCE (mCT8343) |
| 933. | MOUSE PROTEIN SEQUENCE (mCP9806) |
| 934. | HUMAN GENOMIC SEQUENCE (hCG40844) |
| 935. | HUMAN mRNA SEQUENCE (hCT1686451) |
| 936. | HUMAN PROTEIN SEQUENCE (hCP1689977) |
| | CANCER GENE: mCG19789/hCG24313 |
| 937. | MOUSE GENOMIC SEQUENCE (mCG19789) |
| 938. | MOUSE mRNA SEQUENCE (mCT22538) |
| 939. | MOUSE PROTEIN SEQUENCE (mCP9116) |
| 940. | HUMAN GENOMIC SEQUENCE (hCG24313) |
| 941. | HUMAN mRNA SEQUENCE (hCT15427) |
| 942. | HUMAN PROTEIN SEQUENCE (hCP41584) |
| | CANCER GENE: mCG1982/hCG24071 |
| 943. | MOUSE GENOMIC SEQUENCE (mCG1982) |
| 944. | MOUSE mRNA SEQUENCE (mCT1158) |
| 945. | MOUSE PROTEIN SEQUENCE (mCP5141) |
| 946. | HUMAN GENOMIC SEQUENCE (hCG24071) |
| 947. | HUMAN mRNA SEQUENCE (hCT15185) |
| 948. | HUMAN PROTEIN SEQUENCE (hCP41406) |
| | CANCER GENE: mCG19885/hCG26017 |
| 949. | MOUSE GENOMIC SEQUENCE (mCG19885) |
| 950. | MOUSE mRNA SEQUENCE (mCT17661) |
| 951. | MOUSE PROTEIN SEQUENCE (mCP14589) |
| 952. | HUMAN GENOMIC SEQUENCE (hCG26017) |
| 953. | HUMAN mRNA SEQUENCE (hCTI7145) |
| 954. | HUMAN PROTEIN SEQUENCE (hCP42562) |
| | CANCER GENE: mCG19929/hCG40063 |
| 955. | MOUSE GENOMIC SEQUENCE (mCG19929) |
| 956. | MOUSE mRNA SEQUENCE (mCT17877) |
| 957. | MOUSE PROTEIN SEQUENCE (mCP23084) |
| 958. | HUMAN GENOMIC SEQUENCE (hCG40063) |
| 959. | HUMAN mRNA SEQUENCE (hCT1823066) |
| 960. | HUMAN PROTEIN SEQUENCE (hCP1707933) |

TABLE 2-continued

IDENTIFICATION OF SEQUENCES

| SEQ ID NOS. | SEQUENCES |
|---|---|
| | CANCER GENE: mCG19993/hCG25375 |
| 961. | MOUSE GENOMIC SEQUENCE (mCG19993) |
| 962. | MOUSE mRNA SEQUENCE (mCT18155) |
| 963. | MOUSE PROTEIN SEQUENCE (mCP14222) |
| 964. | HUMAN GENOMIC SEQUENCE (hCG25375) |
| 965. | HUMAN mRNA SEQUENCE (hCT16500) |
| 966. | HUMAN PROTEIN SEQUENCE (hCP42262) |
| | CANCER GENE: mCG20206/hCG27935 |
| 967. | MOUSE GENOMIC SEQUENCE (mCG20206) |
| 968. | MOUSE mRNA SEQUENCE (mCT19895) |
| 969. | MOUSE PROTEIN SEQUENCE (mCP23593) |
| 970. | HUMAN GENOMIC SEQUENCE (hCG27935) |
| 971. | HUMAN mRNA SEQUENCE (hCT19078) |
| 972. | HUMAN PROTEIN SEQUENCE (hCP43550) |
| | CANCER GENE: mCG20340/hCG18066 |
| 973. | MOUSE GENOMIC SEQUENCE (mCG20340) |
| 974. | MOUSE mRNA SEQUENCE (mCT20192) |
| 975. | MOUSE PROTEIN SEQUENCE (mCP17648) |
| 976. | HUMAN GENOMIC SEQUENCE (hCG18066) |
| 977. | HUMAN mRNA SEQUENCE (hCT9121) |
| 978. | HUMAN PROTEIN SEQUENCE (hCP35943) |
| | CANCER GENE: mCG20392/hCG41562 |
| 979. | MOUSE GENOMIC SEQUENCE (mCG20392) |
| 980. | MOUSE mRNA SEQUENCE (mCT20937) |
| 981. | MOUSE PROTEIN SEQUENCE (mCP13103) |
| 982. | HUMAN GENOMIC SEQUENCE (hCG41562) |
| 983. | HUMAN mRNA SEQUENCE (hCT32834) |
| 984. | HUMAN PROTEIN SEQUENCE (hCP51417) |
| | CANCER GENE: mCG20408/hCG15769 |
| 985. | MOUSE GENOMIC SEQUENCE (mCG20408) |
| 986. | MOUSE mRNA SEQUENCE (mCT21077) |
| 987. | MOUSE PROTEIN SEQUENCE (mCP23696) |
| 988. | HUMAN GENOMIC SEQUENCE (hCG15769) |
| 989. | HUMAN mRNA SEQUENCE (hCT6798) |
| 990. | HUMAN PROTEIN SEQUENCE (hCP34326) |
| | CANCER GENE: mCG20501/hCG16575 |
| 991. | MOUSE GENOMIC SEQUENCE (mCG20501) |
| 992. | MOUSE mRNA SEQUENCE (mCT22294) |
| 993. | MOUSE PROTEIN SEQUENCE (mCP23389) |
| 994. | HUMAN GENOMIC SEQUENCE (hCG16575) |
| 995. | HUMAN mRNA SEQUENCE (hCT7612) |
| 996. | HUMAN PROTEIN SEQUENCE (hCP34651) |
| | CANCER GENE: mCG20543/hCG17361 |
| 997. | MOUSE GENOMIC SEQUENCE (mCG20543) |
| 998. | MOUSE mRNA SEQUENCE (mCT21892) |
| 999. | MOUSE PROTEIN SEQUENCE (mCP10453) |
| 1000. | HUMAN GENOMIC SEQUENCE (hCG17361) |
| 1001. | HUMAN mRNA SEQUENCE (hCT8411) |
| 1002. | HUMAN PROTEIN SEQUENCE (hCP34192) |
| | CANCER GENE: mCG20544/hCG22647 |
| 1003. | MOUSE GENOMIC SEQUENCE (mCG20544) |
| 1004. | MOUSE mRNA SEQUENCE (mCT21893) |
| 1005. | MOUSE PROTEIN SEQUENCE (mCP10423) |
| 1006. | HUMAN GENOMIC SEQUENCE (hCG22647) |
| 1007. | HUMAN mRNA SEQUENCE (hCT13744) |
| 1008. | HUMAN PROTEIN SEQUENCE (hCP40084) |
| | CANCER GENE: mCG20549/hCG17357 |
| 1009. | MOUSE GENOMIC SEQUENCE (mCG20549) |
| 1010. | MOUSE mRNA SEQUENCE (mCT21898) |
| 1011. | MOUSE PROTEIN SEQUENCE (mCP10442) |
| 1012. | HUMAN GENOMIC SEQUENCE (hCG17357) |
| 1013. | HUMAN mRNA SEQUENCE (hCT8407) |
| 1014. | HUMAN PROTEIN SEQUENCE (hCP34188) |
| | CANCER GENE: mCG20599/hCG40952 |
| 1015. | MOUSE GENOMIC SEQUENCE (mCG20599) |
| 1016. | MOUSE mRNA SEQUENCE (mCT22020) |
| 1017. | MOUSE PROTEIN SEQUENCE (mCP9456) |
| 1018. | HUMAN GENOMIC SEQUENCE (hCG40952) |
| 1019. | HUMAN mRNA SEQUENCE (hCT32220) |
| 1020. | HUMAN PROTEIN SEQUENCE (hCP50752) |
| | CANCER GENE: mCG20647/hCG37125 |
| 1021. | MOUSE GENOMIC SEQUENCE (mCG20647) |
| 1022. | MOUSE mRNA SEQUENCE (mCT22233) |
| 1023. | MOUSE PROTEIN SEQUENCE (mCP5967) |
| 1024. | HUMAN GENOMIC SEQUENCE (hCG37125) |
| 1025. | HUMAN mRNA SEQUENCE (hCT28355) |
| 1026. | HUMAN PROTEIN SEQUENCE (hCP47821) |
| | CANCER GENE: mCG20650/hCG38101 |
| 1027. | MOUSE GENOMIC SEQUENCE (mCG20650) |
| 1028. | MOUSE mRNA SEQUENCE (mCT22578) |
| 1029. | MOUSE PROTEIN SEQUENCE (mCP5887) |
| 1030. | HUMAN GENOMIC SEQUENCE (hCG38101) |
| 1031. | HUMAN mRNA SEQUENCE (hCT29338) |
| 1032. | HUMAN PROTEIN SEQUENCE (hCP48033) |
| | CANCER GENE: mCG21092/hCG16326 |
| 1033. | MOUSE GENOMIC SEQUENCE (mCG21092) |
| 1034. | MOUSE mRNA SEQUENCE (mCT20021) |
| 1035. | MOUSE PROTEIN SEQUENCE (mCP14767) |
| 1036. | HUMAN GENOMIC SEQUENCE (hCG16326) |
| 1037. | HUMAN mRNA SEQUENCE (hCT7362) |
| 1038. | HUMAN PROTEIN SEQUENCE (hCP34078) |
| | CANCER GENE: mCG21183/hCG32701 |
| 1039. | MOUSE GENOMIC SEQUENCE (mCG21183) |
| 1040. | MOUSE mRNA SEQUENCE (mCT21009) |
| 1041. | MOUSE PROTEIN SEQUENCE (mCP22191) |
| 1042. | HUMAN GENOMIC SEQUENCE (hCG32701) |
| 1043. | HUMAN mRNA SEQUENCE (hCT23891) |
| 1044. | HUMAN PROTEIN SEQUENCE (hCP45986) |
| | CANCER GENE: mCG21200/hCG17049 |
| 1045. | MOUSE GENOMIC SEQUENCE (mCG21200) |
| 1046. | MOUSE mRNA SEQUENCE (mCT20361) |
| 1047. | MOUSE PROTEIN SEQUENCE (mCP16931) |
| 1048. | HUMAN GENOMIC SEQUENCE (hCG17049) |
| 1049. | HUMAN mRNA SEQUENCE (hCT8096) |
| 1050. | HUMAN PROTEIN SEQUENCE (hCP34372) |
| | CANCER GENE: mCG21319/hCG39866 |
| 1051. | MOUSE GENOMIC SEQUENCE (mCG21319) |
| 1052. | MOUSE mRNA SEQUENCE (mCT21706) |
| 1053. | MOUSE PROTEIN SEQUENCE (mCP9747) |
| 1054. | HUMAN GENOMIC SEQUENCE (hCG39866) |
| 1055. | HUMAN mRNA SEQUENCE (hCT31118) |
| 1056. | HUMAN PROTEIN SEQUENCE (hCP49649) |
| | CANCER GENE: mCG2140/hCG1723924 |
| 1057. | MOUSE GENOMIC SEQUENCE (mCG2140) |
| 1058. | MOUSE mRNA SEQUENCE (mCT8480) |
| 1059. | MOUSE PROTEIN SEQUENCE (mCP18923) |
| 1060. | HUMAN GENOMIC SEQUENCE (hCG1723924) |
| 1061. | HUMAN mRNA SEQUENCE (hCT1850193) |
| 1062. | HUMAN PROTEIN SEQUENCE (hCP1720717) |
| | CANCER GENE: mCG21411/hCG15095 |
| 1063. | MOUSE GENOMIC SEQUENCE (mCG21411) |
| 1064. | MOUSE mRNA SEQUENCE (mCT21965) |
| 1065. | MOUSE PROTEIN SEQUENCE (mCP20781) |
| 1066. | HUMAN GENOMIC SEQUENCE (hCG15095) |
| 1067. | HUMAN mRNA SEQUENCE (hCT6116) |
| 1068. | HUMAN PROTEIN SEQUENCE (hCP34831) |

TABLE 2-continued

IDENTIFICATION OF SEQUENCES

| SEQ ID NOS. | SEQUENCES |
|---|---|
| | CANCER GENE: mCG21419/hCG15331 |
| 1069. | MOUSE GENOMIC SEQUENCE (mCG21419) |
| 1070. | MOUSE mRNA SEQUENCE (mCT21971) |
| 1071. | MOUSE PROTEIN SEQUENCE (mCP20826) |
| 1072. | HUMAN GENOMIC SEQUENCE (hCG15331) |
| 1073. | HUMAN mRNA SEQUENCE (hCT6353) |
| 1074. | HUMAN PROTEIN SEQUENCE (hCP35780) |
| | CANCER GENE: mCG21446/hCG14759 |
| 1075. | MOUSE GENOMIC SEQUENCE (mCG21446) |
| 1076. | MOUSE mRNA SEQUENCE (mCT22143) |
| 1077. | MOUSE PROTEIN SEQUENCE (mCP16097) |
| 1078. | HUMAN GENOMIC SEQUENCE (hCG14759) |
| 1079. | HUMAN mRNA SEQUENCE (hCT5780) |
| 1080. | HUMAN PROTEIN SEQUENCE (hCP33254) |
| | CANCER GENE: mCG21498/hCG38237 |
| 1081. | MOUSE GENOMIC SEQUENCE (mCG21498) |
| 1082. | MOUSE mRNA SEQUENCE (mCT15384) |
| 1083. | MOUSE PROTEIN SEQUENCE (mCP11030) |
| 1084. | HUMAN GENOMIC SEQUENCE (hCG38237) |
| 1085. | HUMAN mRNA SEQUENCE (hCT29477) |
| 1086. | HUMAN PROTEIN SEQUENCE (hCP48130) |
| | CANCER GENE: mCG21659/hCG18576 |
| 1087. | MOUSE GENOMIC SEQUENCE (mCG21659) |
| 1088. | MOUSE mRNA SEQUENCE (mCT19951) |
| 1089. | MOUSE PROTEIN SEQUENCE (mCP15815) |
| 1090. | HUMAN GENOMIC SEQUENCE (hCG18576) |
| 1091. | HUMAN mRNA SEQUENCE (hCT9635) |
| 1092. | HUMAN PROTEIN SEQUENCE (hCP36377) |
| | CANCER GENE: mCG21733/hCG40245 |
| 1093. | MOUSE GENOMIC SEQUENCE (mCG21733) |
| 1094. | MOUSE mRNA SEQUENCE (mCT20681) |
| 1095. | MOUSE PROTEIN SEQUENCE (mCP19793) |
| 1096. | HUMAN GENOMIC SEQUENCE (hCG40245) |
| 1097. | HUMAN mRNA SEQUENCE (hCT31498) |
| 1098. | HUMAN PROTEIN SEQUENCE (hCP50028) |
| | CANCER GENE: mCG21872/hCG17143 |
| 1099. | MOUSE GENOMIC SEQUENCE (mCG21872) |
| 1100. | MOUSE mRNA SEQUENCE (mCT21839) |
| 1101. | MOUSE PROTEIN SEQUENCE (mCP18614) |
| 1102. | HUMAN GENOMIC SEQUENCE (hCG17143) |
| 1103. | HUMAN mRNA SEQUENCE (hCT8191) |
| 1104. | HUMAN PROTEIN SEQUENCE (hCP34482) |
| | CANCER GENE: mCG21902/hCG30014 |
| 1105. | MOUSE GENOMIC SEQUENCE (mCG21902) |
| 1106. | MOUSE mRNA SEQUENCE (mCT22359) |
| 1107. | MOUSE PROTEIN SEQUENCE (mCP23428) |
| 1108. | HUMAN GENOMIC SEQUENCE (hCG30014) |
| 1109. | HUMAN mRNA SEQUENCE (hCT21181) |
| 1110. | HUMAN PROTEIN SEQUENCE (hCP44697) |
| | CANCER GENE: mCG22056/hCG40203 |
| 1111. | MOUSE GENOMIC SEQUENCE (mCG22056) |
| 1112. | MOUSE mRNA SEQUENCE (mCT22792) |
| 1113. | MOUSE PROTEIN SEQUENCE (mCP13158) |
| 1114. | HUMAN GENOMIC SEQUENCE (hCG40203) |
| 1115. | HUMAN mRNA SEQUENCE (hCT31457) |
| 1116. | HUMAN PROTEIN SEQUENCE (hCP50001) |
| | CANCER GENE: mCG22132/hCG15373 |
| 1117. | MOUSE GENOMIC SEQUENCE (mCG22132) |
| 1118. | MOUSE mRNA SEQUENCE (mCT23888) |
| 1119. | MOUSE PROTEIN SEQUENCE (mCP7739) |
| 1120. | HUMAN GENOMIC SEQUENCE (hCG15373) |
| 1121. | HUMAN mRNA SEQUENCE (hCT6395) |
| 1122. | HUMAN PROTEIN SEQUENCE (hCP35254) |
| | CANCER GENE: mCG2215/hCG401221 |
| 1123. | MOUSE GENOMIC SEQUENCE (mCG2215) |
| 1124. | MOUSE mRNA SEQUENCE (mCT1626) |
| 1125. | MOUSE PROTEIN SEQUENCE (mCP17313) |
| 1126. | HUMAN GENOMIC SEQUENCE (hCG401221) |
| 1127. | HUMAN mRNA SEQUENCE (hCT401225) |
| 1128. | HUMAN PROTEIN SEQUENCE (hCP801144) |
| | CANCER GENE: mCG22161/hCG1781402 |
| 1129. | MOUSE GENOMIC SEQUENCE (mCG22161) |
| 1130. | MOUSE mRNA SEQUENCE (mCT20255) |
| 1131. | MOUSE PROTEIN SEQUENCE (mCP2942) |
| 1132. | HUMAN GENOMIC SEQUENCE (hCG1781402) |
| 1133. | HUMAN mRNA SEQUENCE (hCT1820269) |
| 1134. | HUMAN PROTEIN SEQUENCE (hCP1718580) |
| | CANCER GENE: mCG22171/hCG37949 |
| 1135. | MOUSE GENOMIC SEQUENCE (mCG22171) |
| 1136. | MOUSE mRNA SEQUENCE (mCT19935) |
| 1137. | MOUSE PROTEIN SEQUENCE (mCP21795) |
| 1138. | HUMAN GENOMIC SEQUENCE (hCG37949) |
| 1139. | HUMAN mRNA SEQUENCE (hCT29185) |
| 1140. | HUMAN PROTEIN SEQUENCE (hCP47881) |
| | CANCER GENE: mCG22175/hCG1735628 |
| 1141. | MOUSE GENOMIC SEQUENCE (mCG22175) |
| 1142. | MOUSE mRNA SEQUENCE (mCT20599) |
| 1143. | MOUSE PROTEIN SEQUENCE (mCP21804) |
| 1144. | HUMAN GENOMIC SEQUENCE (hCG1735628) |
| 1145. | HUMAN mRNA SEQUENCE (hCT1773627) |
| 1146. | HUMAN PROTEIN SEQUENCE (hCP1730899) |
| | CANCER GENE: mCG22205/hCG16145 |
| 1147. | MOUSE GENOMIC SEQUENCE (mCG22205) |
| 1148. | MOUSE mRNA SEQUENCE (mCT20638) |
| 1149. | MOUSE PROTEIN SEQUENCE (mCP2261) |
| 1150. | HUMAN GENOMIC SEQUENCE (hCG16145) |
| 1151. | HUMAN mRNA SEQUENCE (hCT5796) |
| 1152. | HUMAN PROTEIN SEQUENCE (hCP35596) |
| | CANCER GENE: mCG22245/hCG15467 |
| 1153. | MOUSE GENOMIC SEQUENCE (mCG22245) |
| 1154. | MOUSE mRNA SEQUENCE (mCT21201) |
| 1155. | MOUSE PROTEIN SEQUENCE (mCP17263) |
| 1156. | HUMAN GENOMIC SEQUENCE (hCG15467) |
| 1157. | HUMAN mRNA SEQUENCE (hCT1952272) |
| 1158. | HUMAN PROTEIN SEQUENCE (hCP1751324) |
| | CANCER GENE: mCG22259/hCG27692 |
| 1159. | MOUSE GENOMIC SEQUENCE (mCG22259) |
| 1160. | MOUSE mRNA SEQUENCE (mCT20705) |
| 1161. | MOUSE PROTEIN SEQUENCE (mCP14816) |
| 1162. | HUMAN GENOMIC SEQUENCE (hCG27692) |
| 1163. | HUMAN mRNA SEQUENCE (hCT18834) |
| 1164. | HUMAN PROTEIN SEQUENCE (hCP43255) |
| | CANCER GENE: mCG22352/hCG19724 |
| 1165. | MOUSE GENOMIC SEQUENCE (mCG22352) |
| 1166. | MOUSE mRNA SEQUENCE (mCT21719) |
| 1167. | MOUSE PROTEIN SEQUENCE (mCP3415) |
| 1168. | HUMAN GENOMIC SEQUENCE (hCG19724) |
| 1169. | HUMAN mRNA SEQUENCE (hCT10796) |
| 1170. | HUMAN PROTEIN SEQUENCE (hCP38730) |
| | CANCER GENE: mCG22397/hCG21624 |
| 1171. | MOUSE GENOMIC SEQUENCE (mCG22397) |
| 1172. | MOUSE mRNA SEQUENCE (mCT22492) |
| 1173. | MOUSE PROTEIN SEQUENCE (mCP10498) |
| 1174. | HUMAN GENOMIC SEQUENCE (hCG21624) |
| 1175. | HUMAN mRNA SEQUENCE (hCT1686293) |
| 1176. | HUMAN PROTEIN SEQUENCE (hCP1690086) |

TABLE 2-continued

IDENTIFICATION OF SEQUENCES

| SEQ ID NOS. | SEQUENCES |
|---|---|
| | CANCER GENE: mCG22413/hCG21734 |
| 1177. | MOUSE GENOMIC SEQUENCE (mCG22413) |
| 1178. | MOUSE mRNA SEQUENCE (mCT22509) |
| 1179. | MOUSE PROTEIN SEQUENCE (mCP10494) |
| 1180. | HUMAN GENOMIC SEQUENCE (hCG21734) |
| 1181. | HUMAN mRNA SEQUENCE (hCT12827) |
| 1182. | HUMAN PROTEIN SEQUENCE (hCP39228) |
| | CANCER GENE: mCG22464/hCG17117 |
| 1183. | MOUSE GENOMIC SEQUENCE (mCG22464) |
| 1184. | MOUSE mRNA SEQUENCE (mCT22319) |
| 1185. | MOUSE PROTEIN SEQUENCE (mCP11320) |
| 1186. | HUMAN GENOMIC SEQUENCE (hCG17117) |
| 1187. | HUMAN mRNA SEQUENCE (hCT1953974) |
| 1188. | HUMAN PROTEIN SEQUENCE (hCP1765761) |
| | CANCER GENE: mCG22467/hCG17195 |
| 1189. | MOUSE GENOMIC SEQUENCE (mCG22467) |
| 1190. | MOUSE mRNA SEQUENCE (mCT22321) |
| 1191. | MOUSE PROTEIN SEQUENCE (mCP11315) |
| 1192. | HUMAN GENOMIC SEQUENCE (hCG17195) |
| 1193. | HUMAN mRNA SEQUENCE (hCT1955454) |
| 1194. | HUMAN PROTEIN SEQUENCE (hCP1765759) |
| | CANCER GENE: mCG22474/hCG17936 |
| 1195. | MOUSE GENOMIC SEQUENCE (mCG22474) |
| 1196. | MOUSE mRNA SEQUENCE (mCT22330) |
| 1197. | MOUSE PROTEIN SEQUENCE (mCP11335) |
| 1198. | HUMAN GENOMIC SEQUENCE (hCG17936) |
| 1199. | HUMAN mRNA SEQUENCE (hCT8990) |
| 1200. | HUMAN PROTEIN SEQUENCE (hCP33893) |
| | CANCER GENE: mCG22518/hCG38672 |
| 1201. | MOUSE GENOMIC SEQUENCE (mCG22518) |
| 1202. | MOUSE mRNA SEQUENCE (mCT22818) |
| 1203. | MOUSE PROTEIN SEQUENCE (mCP15759) |
| 1204. | HUMAN GENOMIC SEQUENCE (hCG38672) |
| 1205. | HUMAN mRNA SEQUENCE (hCT29916) |
| 1206. | HUMAN PROTEIN SEQUENCE (hCP48498) |
| | CANCER GENE: mCG22537/hCG1747156 |
| 1207. | MOUSE GENOMIC SEQUENCE (mCG22537) |
| 1208. | MOUSE mRNA SEQUENCE (mCT22933) |
| 1209. | MOUSE PROTEIN SEQUENCE (mCP10415) |
| 1210. | HUMAN GENOMIC SEQUENCE (hCG1747156) |
| 1211. | HUMAN mRNA SEQUENCE (hCT1785481) |
| 1212. | HUMAN PROTEIN SEQUENCE (hCP1738978) |
| | CANCER GENE: mCG2260/hCG23472 |
| 1213. | MOUSE GENOMIC SEQUENCE (mCG2260) |
| 1214. | MOUSE mRNA SEQUENCE (mCT1669) |
| 1215. | MOUSE PROTEIN SEQUENCE (mCP13569) |
| 1216. | HUMAN GENOMIC SEQUENCE (hCG23472) |
| 1217. | HUMAN mRNA SEQUENCE (hCT1823706) |
| 1218. | HUMAN PROTEIN SEQUENCE (hCP1721278) |
| | CANCER GENE: mCG22656/hCG20930 |
| 1219. | MOUSE GENOMIC SEQUENCE (mCG22656) |
| 1220. | MOUSE mRNA SEQUENCE (mCT21511) |
| 1221. | MOUSE PROTEIN SEQUENCE (mCP10653) |
| 1222. | HUMAN GENOMIC SEQUENCE (hCG20930) |
| 1223. | HUMAN mRNA SEQUENCE (hCT12011) |
| 1224. | HUMAN PROTEIN SEQUENCE (hCP38543) |
| | CANCER GENE: mCG22686/hCG37091 |
| 1225. | MOUSE GENOMIC SEQUENCE (mCG22686) |
| 1226. | MOUSE mRNA SEQUENCE (mCT21599) |
| 1227. | MOUSE PROTEIN SEQUENCE (mCP21078) |
| 1228. | HUMAN GENOMIC SEQUENCE (hCG37091) |
| 1229. | HUMAN mRNA SEQUENCE (hCT28321) |
| 1230. | HUMAN PROTEIN SEQUENCE (hCP47795) |
| | CANCER GENE: mCG22753/hCG20786 |
| 1231. | MOUSE GENOMIC SEQUENCE (mCG22753) |
| 1232. | MOUSE mRNA SEQUENCE (mCT23686) |
| 1233. | MOUSE PROTEIN SEQUENCE (mCP4643) |
| 1234. | HUMAN GENOMIC SEQUENCE (hCG20786) |
| 1235. | HUMAN mRNA SEQUENCE (hCT11866) |
| 1236. | HUMAN PROTEIN SEQUENCE (hCP38416) |
| | CANCER GENE: mCG23380/hCG27276 |
| 1237. | MOUSE GENOMIC SEQUENCE (mCG23380) |
| 1238. | MOUSE mRNA SEQUENCE (mCT23205) |
| 1239. | MOUSE PROTEIN SEQUENCE (mCP1348) |
| 1240. | HUMAN GENOMIC SEQUENCE (hCG27276) |
| 1241. | HUMAN mRNA SEQUENCE (hCT18414) |
| 1242. | HUMAN PROTEIN SEQUENCE (hCP44262) |
| | CANCER GENE: mCG23443/hCG1737521 |
| 1243. | MOUSE GENOMIC SEQUENCE (mCG23443) |
| 1244. | MOUSE mRNA SEQUENCE (mCT23318) |
| 1245. | MOUSE PROTEIN SEQUENCE (mCP12949) |
| 1246. | HUMAN GENOMIC SEQUENCE (hCG1737521) |
| 1247. | HUMAN mRNA SEQUENCE (hCT1775561) |
| 1248. | HUMAN PROTEIN SEQUENCE (hCP1715933) |
| | CANCER GENE: mCG23445/hCG16206 |
| 1249. | MOUSE GENOMIC SEQUENCE (mCG23445) |
| 1250. | MOUSE mRNA SEQUENCE (mCT23312) |
| 1251. | MOUSE PROTEIN SEQUENCE (mCP22701) |
| 1252. | HUMAN GENOMIC SEQUENCE (hCG16206) |
| 1253. | HUMAN mRNA SEQUENCE (hCT7238) |
| 1254. | HUMAN PROTEIN SEQUENCE (hCP35274) |
| | CANCER GENE: mCG2395/hCG33029 |
| 1255. | MOUSE GENOMIC SEQUENCE (mCG2395) |
| 1256. | MOUSE mRNA SEQUENCE (mCT1612) |
| 1257. | MOUSE PROTEIN SEQUENCE (mCP22401) |
| 1258. | HUMAN GENOMIC SEQUENCE (hCG33029) |
| 1259. | HUMAN mRNA SEQUENCE (hCT24222) |
| 1260. | HUMAN PROTEIN SEQUENCE (hCP46383) |
| | CANCER GENE: mCG2435/hCG16501 |
| 1261. | MOUSE GENOMIC SEQUENCE (mCG2435) |
| 1262. | MOUSE mRNA SEQUENCE (mCT1434) |
| 1263. | MOUSE PROTEIN SEQUENCE (mCP23075) |
| 1264. | HUMAN GENOMIC SEQUENCE (hCG16501) |
| 1265. | HUMAN mRNA SEQUENCE (hCT7539) |
| 1266. | HUMAN PROTEIN SEQUENCE (hCP34596) |
| | CANCER GENE: mCG2468/hCG16728 |
| 1267. | MOUSE GENOMIC SEQUENCE (mCG2468) |
| 1268. | MOUSE mRNA SEQUENCE (mCT1547) |
| 1269. | MOUSE PROTEIN SEQUENCE (mCP15074) |
| 1270. | HUMAN GENOMIC SEQUENCE (hCG16728) |
| 1271. | HUMAN mRNA SEQUENCE (hCT7769) |
| 1272. | HUMAN PROTEIN SEQUENCE (hCP34634) |
| | CANCER GENE: mCG2479/hCG1780031 |
| 1273. | MOUSE GENOMIC SEQUENCE (mCG2479) |
| 1274. | MOUSE mRNA SEQUENCE (mCT1532) |
| 1275. | MOUSE PROTEIN SEQUENCE (mCP15071) |
| 1276. | HUMAN GENOMIC SEQUENCE (hCG1780031) |
| 1277. | HUMAN mRNA SEQUENCE (hCT1818854) |
| 1278. | HUMAN PROTEIN SEQUENCE (hCP1727062) |
| | CANCER GENE: mCG2484/hCG1788599 |
| 1279. | MOUSE GENOMIC SEQUENCE (mCG2484) |
| 1280. | MOUSE mRNA SEQUENCE (mCT1596) |
| 1281. | MOUSE PROTEIN SEQUENCE (mCP15131) |
| 1282. | HUMAN GENOMIC SEQUENCE (hCG1788599) |
| 1283. | HUMAN mRNA SEQUENCE (hCT1827788) |
| 1284. | HUMAN PROTEIN SEQUENCE (hCP1698554) |

TABLE 2-continued

IDENTIFICATION OF SEQUENCES

| SEQ ID NOS. | SEQUENCES |
|---|---|
| | CANCER GENE: mCG2509/hCG17286 |
| 1285. | MOUSE GENOMIC SEQUENCE (mCG2509) |
| 1286. | MOUSE mRNA SEQUENCE (mCT1337) |
| 1287. | MOUSE PROTEIN SEQUENCE (mCP15079) |
| 1288. | HUMAN GENOMIC SEQUENCE (hCG17286) |
| 1289. | HUMAN mRNA SEQUENCE (hCT8336) |
| 1290. | HUMAN PROTEIN SEQUENCE (hCP34736) |
| | CANCER GENE: mCG2574/hCG1784894 |
| 1291. | MOUSE GENOMIC SEQUENCE (mCG2574) |
| 1292. | MOUSE mRNA SEQUENCE (mCT1974) |
| 1293. | MOUSE PROTEIN SEQUENCE (mCP1949) |
| 1294. | HUMAN GENOMIC SEQUENCE (hCG1784894) |
| 1295. | HUMAN mRNA SEQUENCE (hCT1823882) |
| 1296. | HUMAN PROTEIN SEQUENCE (hCP1743768) |
| | CANCER GENE: mCG2609/hCG14997 |
| 1297. | MOUSE GENOMIC SEQUENCE (mCG2609) |
| 1298. | MOUSE mRNA SEQUENCE (mCT1719) |
| 1299. | MOUSE PROTEIN SEQUENCE (mCP10212) |
| 1300. | HUMAN GENOMIC SEQUENCE (hCG14997) |
| 1301. | HUMAN mRNA SEQUENCE (hCT6018) |
| 1302. | HUMAN PROTEIN SEQUENCE (hCP35459) |
| | CANCER GENE: mCG2622/hCG1747365 |
| 1303. | MOUSE GENOMIC SEQUENCE (mCG2622) |
| 1304. | MOUSE mRNA SEQUENCE (mCT1718) |
| 1305. | MOUSE PROTEIN SEQUENCE (mCP10161) |
| 1306. | HUMAN GENOMIC SEQUENCE (hCG1747365) |
| 1307. | HUMAN mRNA SEQUENCE (hCT1785697) |
| 1308. | HUMAN PROTEIN SEQUENCE (hCP1706674) |
| | CANCER GENE: mCG2706/hCG28763 |
| 1309. | MOUSE GENOMIC SEQUENCE (mCG2706) |
| 1310. | MOUSE mRNA SEQUENCE (mCT2181) |
| 1311. | MOUSE PROTEIN SEQUENCE (mCP15287) |
| 1312. | HUMAN GENOMIC SEQUENCE (hCG28763) |
| 1313. | HUMAN mRNA SEQUENCE (hCT19918) |
| 1314. | HUMAN PROTEIN SEQUENCE (hCP44127) |
| | CANCER GENE: mCG2708/hCG28766 |
| 1315. | MOUSE GENOMIC SEQUENCE (mCG2708) |
| 1316. | MOUSE mRNA SEQUENCE (mCT2183) |
| 1317. | MOUSE PROTEIN SEQUENCE (mCP15222) |
| 1318. | HUMAN GENOMIC SEQUENCE (hCG28766) |
| 1319. | HUMAN mRNA SEQUENCE (hCT19921) |
| 1320. | HUMAN PROTEIN SEQUENCE (hCP44130) |
| | CANCER GENE: mCG2727/hCG17889 |
| 1321. | MOUSE GENOMIC SEQUENCE (mCG2727) |
| 1322. | MOUSE mRNA SEQUENCE (mCT7005) |
| 1323. | MOUSE PROTEIN SEQUENCE (mCP17408) |
| 1324. | HUMAN GENOMIC SEQUENCE (hCG17889) |
| 1325. | HUMAN mRNA SEQUENCE (hCT1955643) |
| 1326. | HUMAN PROTEIN SEQUENCE (hCP1761482) |
| | CANCER GENE: mCG2740/hCG27644 |
| 1327. | MOUSE GENOMIC SEQUENCE (mCG2740) |
| 1328. | MOUSE mRNA SEQUENCE (mCT1844) |
| 1329. | MOUSE PROTEIN SEQUENCE (mCP15248) |
| 1330. | HUMAN GENOMIC SEQUENCE (hCG27644) |
| 1331. | HUMAN mRNA SEQUENCE (hCT18785) |
| 1332. | HUMAN PROTEIN SEQUENCE (hCP44293) |
| | CANCER GENE: mCG2943/hCG40040 |
| 1333. | MOUSE GENOMIC SEQUENCE (mCG2943) |
| 1334. | MOUSE mRNA SEQUENCE (mCT1378) |
| 1335. | MOUSE PROTEIN SEQUENCE (mCP11134) |
| 1336. | HUMAN GENOMIC SEQUENCE (hCG40040) |
| 1337. | HUMAN mRNA SEQUENCE (hCT31293) |
| 1338. | HUMAN PROTEIN SEQUENCE (hCP49803) |
| | CANCER GENE: mCG3043/hCG1738334 |
| 1339. | MOUSE GENOMIC SEQUENCE (mCG3043) |
| 1340. | MOUSE mRNA SEQUENCE (mCT2186) |
| 1341. | MOUSE PROTEIN SEQUENCE (mCP15235) |
| 1342. | HUMAN GENOMIC SEQUENCE (hCG1738334) |
| 1343. | HUMAN mRNA SEQUENCE (hCT1776398) |
| 1344. | HUMAN PROTEIN SEQUENCE (hCP1713151) |
| | CANCER GENE: mCG3264/hCG29513 |
| 1345. | MOUSE GENOMIC SEQUENCE (mCG3264) |
| 1346. | MOUSE mRNA SEQUENCE (mCT2390) |
| 1347. | MOUSE PROTEIN SEQUENCE (mCP10872) |
| 1348. | HUMAN GENOMIC SEQUENCE (hCG29513) |
| 1349. | HUMAN mRNA SEQUENCE (hCT20677) |
| 1350. | HUMAN PROTEIN SEQUENCE (hCP44507) |
| | CANCER GENE: mCG3413/hCG29916 |
| 1351. | MOUSE GENOMIC SEQUENCE (mCG3413) |
| 1352. | MOUSE mRNA SEQUENCE (mCT2539) |
| 1353. | MOUSE PROTEIN SEQUENCE (mCP7559) |
| 1354. | HUMAN GENOMIC SEQUENCE (hCG29916) |
| 1355. | HUMAN mRNA SEQUENCE (hCT1950711) |
| 1356. | HUMAN PROTEIN SEQUENCE (hCP1767168) |
| | CANCER GENE: mCG3601/hCG37990 |
| 1357. | MOUSE GENOMIC SEQUENCE (mCG3601) |
| 1358. | MOUSE mRNA SEQUENCE (mCT3067) |
| 1359. | MOUSE PROTEIN SEQUENCE (mCP1756) |
| 1360. | HUMAN GENOMIC SEQUENCE (hCG37990) |
| 1361. | HUMAN mRNA SEQUENCE (hCT1951562) |
| 1362. | HUMAN PROTEIN SEQUENCE (hCP1767307) |
| | CANCER GENE: mCG3698/hCG20145 |
| 1363. | MOUSE GENOMIC SEQUENCE (mCG3698) |
| 1364. | MOUSE mRNA SEQUENCE (mCT2813) |
| 1365. | MOUSE PROTEIN SEQUENCE (mCP19988) |
| 1366. | HUMAN GENOMIC SEQUENCE (hCG20145) |
| 1367. | HUMAN mRNA SEQUENCE (hCT11220) |
| 1368. | HUMAN PROTEIN SEQUENCE (hCP37850) |
| | CANCER GENE: mCG3757/hCG21349 |
| 1369. | MOUSE GENOMIC SEQUENCE (mCG3757) |
| 1370. | MOUSE mRNA SEQUENCE (mCT1505) |
| 1371. | MOUSE PROTEIN SEQUENCE (mCP6689) |
| 1372. | HUMAN GENOMIC SEQUENCE (hCG21349) |
| 1373. | HUMAN mRNA SEQUENCE (hCT12437) |
| 1374. | HUMAN PROTEIN SEQUENCE (hCP38909) |
| | CANCER GENE: mCG3767/hCG32368 |
| 1375. | MOUSE GENOMIC SEQUENCE (mCG3767) |
| 1376. | MOUSE mRNA SEQUENCE (mCT1502) |
| 1377. | MOUSE PROTEIN SEQUENCE (mCP6695) |
| 1378. | HUMAN GENOMIC SEQUENCE (hCG32368) |
| 1379. | HUMAN mRNA SEQUENCE (hCT23556) |
| 1380. | HUMAN PROTEIN SEQUENCE (hCP45892) |
| | CANCER GENE: mCG3774/hCG21354 |
| 1381. | MOUSE GENOMIC SEQUENCE (mCG3774) |
| 1382. | MOUSE mRNA SEQUENCE (mCT1490) |
| 1383. | MOUSE PROTEIN SEQUENCE (mCP6690) |
| 1384. | HUMAN GENOMIC SEQUENCE (hCG21354) |
| 1385. | HUMAN mRNA SEQUENCE (hCT12442) |
| 1386. | HUMAN PROTEIN SEQUENCE (hCP38903) |
| | CANCER GENE: mCG3775/hCG21354 |
| 1387. | MOUSE GENOMIC SEQUENCE (mCG3775) |
| 1388. | MOUSE mRNA SEQUENCE (mCT1491) |
| 1389. | MOUSE PROTEIN SEQUENCE (mCP6703) |
| 1390. | HUMAN GENOMIC SEQUENCE (hCG21354) |
| 1391. | HUMAN mRNA SEQUENCE (hCT12442) |
| 1392. | HUMAN PROTEIN SEQUENCE (hCP38903) |

TABLE 2-continued

IDENTIFICATION OF SEQUENCES

| SEQ ID NOS. | SEQUENCES |
|---|---|
| | CANCER GENE: mCG3793/hCG27352 |
| 1393. | MOUSE GENOMIC SEQUENCE (mCG3793) |
| 1394. | MOUSE mRNA SEQUENCE (mCT2635) |
| 1395. | MOUSE PROTEIN SEQUENCE (mCP23581) |
| 1396. | HUMAN GENOMIC SEQUENCE (hCG27352) |
| 1397. | HUMAN mRNA SEQUENCE (hCT18491) |
| 1398. | HUMAN PROTEIN SEQUENCE (hCP42955) |
| | CANCER GENE: mCG3824/hCG27823 |
| 1399. | MOUSE GENOMIC SEQUENCE (mCG3824) |
| 1400. | MOUSE mRNA SEQUENCE (mCT1988) |
| 1401. | MOUSE PROTEIN SEQUENCE (mCP22560) |
| 1402. | HUMAN GENOMIC SEQUENCE (hCG27823) |
| 1403. | HUMAN mRNA SEQUENCE (hCT18965) |
| 1404. | HUMAN PROTEIN SEQUENCE (hCP43375) |
| | CANCER GENE: mCG3889/hCG27192 |
| 1405. | MOUSE GENOMIC SEQUENCE (mCG3889) |
| 1406. | MOUSE mRNA SEQUENCE (mCT2598) |
| 1407. | MOUSE PROTEIN SEQUENCE (mCP11982) |
| 1408. | HUMAN GENOMIC SEQUENCE (hCG27192) |
| 1409. | HUMAN mRNA SEQUENCE (hCT1686652) |
| 1410. | HUMAN PROTEIN SEQUENCE (hCP1690976) |
| | CANCER GENE: mCG3931/hCG23145 |
| 1411. | MOUSE GENOMIC SEQUENCE (mCG3931) |
| 1412. | MOUSE mRNA SEQUENCE (mCT2920) |
| 1413. | MOUSE PROTEIN SEQUENCE (mCP21768) |
| 1414. | HUMAN GENOMIC SEQUENCE (hCG23145) |
| 1415. | HUMAN mRNA SEQUENCE (hCT14250) |
| 1416. | HUMAN PROTEIN SEQUENCE (hCP41724) |
| | CANCER GENE: mCG4010/hCG1739389 |
| 1417. | MOUSE GENOMIC SEQUENCE (mCG4010) |
| 1418. | MOUSE mRNA SEQUENCE (mCT2836) |
| 1419. | MOUSE PROTEIN SEQUENCE (mCP14449) |
| 1420. | HUMAN GENOMIC SEQUENCE (hCG1739389) |
| 1421. | HUMAN mRNA SEQUENCE (hCT1777478) |
| 1422. | HUMAN PROTEIN SEQUENCE (hCP1729056) |
| | CANCER GENE: mCG4192/hCG41911 |
| 1423. | MOUSE GENOMIC SEQUENCE (mCG4192) |
| 1424. | MOUSE mRNA SEQUENCE (mCT3038) |
| 1425. | MOUSE PROTEIN SEQUENCE (mCP12251) |
| 1426. | HUMAN GENOMIC SEQUENCE (hCG41911) |
| 1427. | HUMAN mRNA SEQUENCE (hCT33187) |
| 1428. | HUMAN PROTEIN SEQUENCE (hCP51743) |
| | CANCER GENE: mCG4251/hCG1640192 |
| 1429. | MOUSE GENOMIC SEQUENCE (mCG4251) |
| 1430. | MOUSE mRNA SEQUENCE (mCT2936) |
| 1431. | MOUSE PROTEIN SEQUENCE (mCP6497) |
| 1432. | HUMAN GENOMIC SEQUENCE (hCG1640192) |
| 1433. | HUMAN mRNA SEQUENCE (hCT1640319) |
| 1434. | HUMAN PROTEIN SEQUENCE (hCP1640057) |
| | CANCER GENE: mCG4296/hCG40093 |
| 1435. | MOUSE GENOMIC SEQUENCE (mCG4296) |
| 1436. | MOUSE mRNA SEQUENCE (mCT3280) |
| 1437. | MOUSE PROTEIN SEQUENCE (mCP5252) |
| 1438. | HUMAN GENOMIC SEQUENCE (hCG40093) |
| 1439. | HUMAN mRNA SEQUENCE (hCT31347) |
| 1440. | HUMAN PROTEIN SEQUENCE (hCP49868) |
| | CANCER GENE: mCG4317/hCG28302 |
| 1441. | MOUSE GENOMIC SEQUENCE (mCG4317) |
| 1442. | MOUSE mRNA SEQUENCE (mCT3354) |
| 1443. | MOUSE PROTEIN SEQUENCE (mCP18759) |
| 1444. | HUMAN GENOMIC SEQUENCE (hCG28302) |
| 1445. | HUMAN tnRNA SEQUENCE (hCT19451) |
| 1446. | HUMAN PROTEIN SEQUENCE (hCP43793) |

TABLE 2-continued

IDENTIFICATION OF SEQUENCES

| SEQ ID NOS. | SEQUENCES |
|---|---|
| | CANCER GENE: mCG4378/hCG40788 |
| 1447. | MOUSE GENOMIC SEQUENCE (mCG4378) |
| 1448. | MOUSE mRNA SEQUENCE (mCT3175) |
| 1449. | MOUSE PROTEIN SEQUENCE (mCP7522) |
| 1450. | HUMAN GENOMIC SEQUENCE (hCG40788) |
| 1451. | HUMAN mRNA SEQUENCE (hCT32053) |
| 1452. | HUMAN PROTEIN SEQUENCE (hCP50543) |
| | CANCER GENE: mCG4428/hCG30155 |
| 1453. | MOUSE GENOMIC SEQUENCE (mCG4428) |
| 1454. | MOUSE mRNA SEQUENCE (mCT2763) |
| 1455. | MOUSE PROTEIN SEQUENCE (mCP5816) |
| 1456. | HUMAN GENOMIC SEQUENCE (hCG30155) |
| 1457. | HUMAN mRNA SEQUENCE (hCT21322) |
| 1458. | HUMAN PROTEIN SEQUENCE (hCP44763) |
| | CANCER GENE: mCG4463/hCG21099 |
| 1459. | MOUSE GENOMIC SEQUENCE (mCG4463) |
| 1460. | MOUSE mRNA SEQUENCE (mCT2560) |
| 1461. | MOUSE PROTEIN SEQUENCE (mCP3694) |
| 1462. | HUMAN GENOMIC SEQUENCE (hCG21099) |
| 1463. | HUMAN mRNA SEQUENCE (hCT12185) |
| 1464. | HUMAN PROTEIN SEQUENCE (hCP38657) |
| | CANCER GENE: mCG4468/hCG19805 |
| 1465. | MOUSE GENOMIC SEQUENCE (mCG4468) |
| 1466. | MOUSE mRNA SEQUENCE (mCT2554) |
| 1467. | MOUSE PROTEIN SEQUENCE (mCP3698) |
| 1468. | HUMAN GENOMIC SEQUENCE (hCG19805) |
| 1469. | HUMAN mRNA SEQUENCE (hCT10877) |
| 1470. | HUMAN PROTEIN SEQUENCE (hCP38655) |
| | CANCER GENE: mCG4490/hCG39740 |
| 1471. | MOUSE GENOMIC SEQUENCE (mCG4490) |
| 1472. | MOUSE mRNA SEQUENCE (mCT3571) |
| 1473. | MOUSE PROTEIN SEQUENCE (mCP1578) |
| 1474. | HUMAN GENOMIC SEQUENCE (hCG39740) |
| 1475. | HUMAN mRNA SEQUENCE (hCT30992) |
| 1476. | HUMAN PROTEIN SEQUENCE (hCP49525) |
| | CANCER GENE: mCG4492/hCG39730 |
| 1477. | MOUSE GENOMIC SEQUENCE (mCG4492) |
| 1478. | MOUSE mRNA SEQUENCE (mCT3573) |
| 1479. | MOUSE PROTEIN SEQUENCE (mCP1586) |
| 1480. | HUMAN GENOMIC SEQUENCE (hCG39730) |
| 1481. | HUMAN mRNA SEQUENCE (hCT30982) |
| 1482. | HUMAN PROTEIN SEQUENCE (hCP49524) |
| | CANCER GENE: mCG4493/hCG1766501 |
| 1483. | MOUSE GENOMIC SEQUENCE (mCG4493) |
| 1484. | MOUSE mRNA SEQUENCE (mCT3574) |
| 1485. | MOUSE PROTEIN SEQUENCE (mCP1591) |
| 1486. | HUMAN GENOMIC SEQUENCE (hCG1766501) |
| 1487. | HUMAN mRNA SEQUENCE (hCT1805006) |
| 1488. | HUMAN PROTEIN SEQUENCE (hCP1716988) |
| | CANCER GENE: mCG4638/hCG27795 |
| 1489. | MOUSE GENOMIC SEQUENCE (mCG4638) |
| 1490. | MOUSE mRNA SEQUENCE (mCT3972) |
| 1491. | MOUSE PROTEIN SEQUENCE (mCP2223) |
| 1492. | HUMAN GENOMIC SEQUENCE (hCG27795) |
| 1493. | HUMAN mRNA SEQUENCE (hCT18937) |
| 1494. | HUMAN PROTEIN SEQUENCE (hCP43343) |
| | CANCER GENE: mCG4768/hCG22679 |
| 1495. | MOUSE GENOMIC SEQUENCE (mCG4768) |
| 1496. | MOUSE mRNA SEQUENCE (mCT3966) |
| 1497. | MOUSE PROTEIN SEQUENCE (mCP19192) |
| 1498. | HUMAN GENOMIC SEQUENCE (hCG22679) |
| 1499. | HUMAN mRNA SEQUENCE (hCT13777) |
| 1500. | HUMAN PROTEIN SEQUENCE (hCP40139) |

TABLE 2-continued
IDENTIFICATION OF SEQUENCES

| SEQ ID NOS. | SEQUENCES |
|---|---|
| | CANCER GENE: mCG4799/hCG33122 |
| 1501. | MOUSE GENOMIC SEQUENCE (mCG4799) |
| 1502. | MOUSE mRNA SEQUENCE (mCT4081) |
| 1503. | MOUSE PROTEIN SEQUENCE (mCP5240) |
| 1504. | HUMAN GENOMIC SEQUENCE (hCG33122) |
| 1505. | HUMAN mRNA SEQUENCE (hCT24315) |
| 1506. | HUMAN PROTEIN SEQUENCE (hCP46484) |
| | CANCER GENE: mCG4860/hCG22132 |
| 1507. | MOUSE GENOMIC SEQUENCE (mCG4860) |
| 1508. | MOUSE mRNA SEQUENCE (mCT3531) |
| 1509. | MOUSE PROTEIN SEQUENCE (mCP2173) |
| 1510. | HUMAN GENOMIC SEQUENCE (hCG22132) |
| 1511. | HUMAN mRNA SEQUENCE (hCT13225) |
| 1512. | HUMAN PROTEIN SEQUENCE (hCP39660) |
| | CANCER GENE: mCG4940/hCG1785738 |
| 1513. | MOUSE GENOMIC SEQUENCE (mCG4940) |
| 1514. | MOUSE mRNA SEQUENCE (mCT3631) |
| 1515. | MOUSE PROTEIN SEQUENCE (mCP3111) |
| 1516. | HUMAN GENOMIC SEQUENCE (hCG1785738) |
| 1517. | HUMAN mRNA SEQUENCE (hCT1824756) |
| 1518. | HUMAN PROTEIN SEQUENCE (hCP1735762) |
| | CANCER GENE: mCG49939/hCG22769 |
| 1519. | MOUSE GENOMIC SEQUENCE (mCG49939) |
| 1520. | MOUSE mRNA SEQUENCE (mCT50122) |
| 1521. | MOUSE PROTEIN SEQUENCE (mCP36914) |
| 1522. | HUMAN GENOMIC SEQUENCE (hCG22769) |
| 1523. | HUMAN mRNA SEQUENCE (hCT13867) |
| 1524. | HUMAN PROTEIN SEQUENCE (hCP40198) |
| | CANCER GENE: mCG5034/hCG23376 |
| 1525. | MOUSE GENOMIC SEQUENCE (mCG5034) |
| 1526. | MOUSE mRNA SEQUENCE (mCT3881) |
| 1527. | MOUSE PROTEIN SEQUENCE (mCP12076) |
| 1528. | HUMAN GENOMIC SEQUENCE (hCG23376) |
| 1529. | HUMAN mRNA SEQUENCE (hCT14483) |
| 1530. | HUMAN PROTEIN SEQUENCE (hCP40870) |
| | CANCER GENE: mCG5067/hCG19082 |
| 1531. | MOUSE GENOMIC SEQUENCE (mCG5067) |
| 1532. | MOUSE mRNA SEQUENCE (mCT4206) |
| 1533. | MOUSE PROTEIN SEQUENCE (mCP17436) |
| 1534. | HUMAN GENOMIC SEQUENCE (hCG19082) |
| 1535. | HUMAN mRNA SEQUENCE (hCT10147) |
| 1536. | HUMAN PROTEIN SEQUENCE (hCP36703) |
| | CANCER GENE: mCG51010/hCG21464 |
| 1537. | MOUSE GENOMIC SEQUENCE (mCG51010) |
| 1538. | MOUSE mRNA SEQUENCE (mCT51193) |
| 1539. | MOUSE PROTEIN SEQUENCE (mCP24980) |
| 1540. | HUMAN GENOMIC SEQUENCE (hCG21464) |
| 1541. | HUMAN mRNA SEQUENCE (hCT12553) |
| 1542. | HUMAN PROTEIN SEQUENCE (hCP39015) |
| | CANCER GENE: mCG51020/hCG1643989 |
| 1543. | MOUSE GENOMIC SEQUENCE (mCG51020) |
| 1544. | MOUSE mRNA SEQUENCE (mCT51203) |
| 1545. | MOUSE PROTEIN SEQUENCE (mCP28400) |
| 1546. | HUMAN GENOMIC SEQUENCE (hCG1643989) |
| 1547. | HUMAN mRNA SEQUENCE (hCT1644116) |
| 1548. | HUMAN PROTEIN SEQUENCE (hCP1635986) |
| | CANCER GENE: mCG5113/hCG1782397 |
| 1549. | MOUSE GENOMIC SEQUENCE (mCG5113) |
| 1550. | MOUSE mRNA SEQUENCE (mCT3569) |
| 1551. | MOUSE PROTEIN SEQUENCE (mCP8371) |
| 1552. | HUMAN GENOMIC SEQUENCE (hCG1782397) |
| 1553. | HUMAN mRNA SEQUENCE (hCT1821307) |
| 1554. | HUMAN PROTEIN SEQUENCE (hCP1703807) |
| | CANCER GENE: mCG51582/hCG39434 |
| 1555. | MOUSE GENOMIC SEQUENCE (mCG51582) |
| 1556. | MOUSE mRNA SEQUENCE (mCT51765) |
| 1557. | MOUSE PROTEIN SEQUENCE (mCP31229) |
| 1558. | HUMAN GENOMIC SEQUENCE (hCG39434) |
| 1559. | HUMAN mRNA SEQUENCE (hCT30685) |
| 1560. | HUMAN PROTEIN SEQUENCE (hCP49277) |
| | CANCER GENE: mCG51664/hCG28994 |
| 1561. | MOUSE GENOMIC SEQUENCE (mCG51664) |
| 1562. | MOUSE mRNA SEQUENCE (mCT51847) |
| 1563. | MOUSE PROTEIN SEQUENCE (mCP30940) |
| 1564. | HUMAN GENOMIC SEQUENCE (hCG28994) |
| 1565. | HUMAN mRNA SEQUENCE (hCT20153) |
| 1566. | HUMAN PROTEIN SEQUENCE (hCP44268) |
| | CANCER GENE: mCG5362/hCG16933 |
| 1567. | MOUSE GENOMIC SEQUENCE (mCG5362) |
| 1568. | MOUSE mRNA SEQUENCE (mCT4753) |
| 1569. | MOUSE PROTEIN SEQUENCE (mCP11339) |
| 1570. | HUMAN GENOMIC SEQUENCE (hCG16933) |
| 1571. | HUMAN mRNA SEQUENCE (hCT7976) |
| 1572. | HUMAN PROTEIN SEQUENCE (hCP33890) |
| | CANCER GENE: mCG54271/hCG18129 |
| 1573. | MOUSE GENOMIC SEQUENCE (mCG54271) |
| 1574. | MOUSE mRNA SEQUENCE (mCT54454) |
| 1575. | MOUSE PROTEIN SEQUENCE (mCP36490) |
| 1576. | HUMAN GENOMIC SEQUENCE (hCG18129) |
| 1577. | HUMAN mRNA SEQUENCE (hCT9184) |
| 1578. | HUMAN PROTEIN SEQUENCE (hCP36049) |
| | CANCER GENE: mCG5429/hCG38378 |
| 1579. | MOUSE GENOMIC SEQUENCE (mCG5429) |
| 1580. | MOUSE mRNA SEQUENCE (mCT4198) |
| 1581. | MOUSE PROTEIN SEQUENCE (mCP5869) |
| 1582. | HUMAN GENOMIC SEQUENCE (hCG38378) |
| 1583. | HUMAN mRNA SEQUENCE (hCT29619) |
| 1584. | HUMAN PROTEIN SEQUENCE (hCP48301) |
| | CANCER GENE: mCG5448/hCG38103 |
| 1585. | MOUSE GENOMIC SEQUENCE (mCG5448) |
| 1586. | MOUSE mRNA SEQUENCE (mCT4173) |
| 1587. | MOUSE PROTEIN SEQUENCE (mCP5974) |
| 1588. | HUMAN GENOMIC SEQUENCE (hCG38103) |
| 1589. | HUMAN mRNA SEQUENCE (hCT29339) |
| 1590. | HUMAN PROTEIN SEQUENCE (hCP48041) |
| | CANCER GENE: mCG5518/hCG22355 |
| 1591. | MOUSE GENOMIC SEQUENCE (mCG5518 |
| 1592. | MOUSE mRNA SEQUENCE (mCT4373) |
| 1593. | MOUSE PROTEIN SEQUENCE (mCP3274) |
| 1594. | HUMAN GENOMIC SEQUENCE (hCG22355) |
| 1595. | HUMAN mRNA SEQUENCE (hCT13449) |
| 1596. | HUMAN PROTEIN SEQUENCE (hCP39839) |
| | CANCER GENE: mCG5530/hCG22353 |
| 1597. | MOUSE GENOMIC SEQUENCE (mCG5530) |
| 1598. | MOUSE mRNA SEQUENCE (mCT4367) |
| 1599. | MOUSE PROTEIN SEQUENCE (mCP3095) |
| 1600. | HUMAN GENOMIC SEQUENCE (hCG22353) |
| 1601. | HUMAN mRNA SEQUENCE (hCT13447) |
| 1602. | HUMAN PROTEIN SEQUENCE (hCP39837) |
| | CANCER GENE: mCG5531/hCG20493 |
| 1603. | MOUSE GENOMIC SEQUENCE (mCG5531) |
| 1604. | MOUSE mRNA SEQUENCE (mCT4361) |
| 1605. | MOUSE PROTEIN SEQUENCE (mCP3277) |
| 1606. | HUMAN GENOMIC SEQUENCE (hCG20493) |
| 1607. | HUMAN mRNA SEQUENCE (hCT13441) |
| 1608. | HUMAN PROTEIN SEQUENCE (hCP39842) |

TABLE 2-continued

IDENTIFICATION OF SEQUENCES

| SEQ ID NOS. | SEQUENCES |
|---|---|
| | CANCER GENE: mCG5548/hCG1779020 |
| 1609. | MOUSE GENOMIC SEQUENCE (mCG5548) |
| 1610. | MOUSE mRNA SEQUENCE (mCT4831) |
| 1611. | MOUSE PROTEIN SEQUENCE (mCP6232) |
| 1612. | HUMAN GENOMIC SEQUENCE (hCG1779020) |
| 1613. | HUMAN mRNA SEQUENCE (hCT1817821) |
| 1614. | HUMAN PROTEIN SEQUENCE (hCP1711875) |
| | CANCER GENE: mCG5662/hCG14831 |
| 1615. | MOUSE GENOMIC SEQUENCE (mCG5662) |
| 1616. | MOUSE mRNA SEQUENCE (mCT5106) |
| 1617. | MOUSE PROTEIN SEQUENCE (mCP2831) |
| 1618. | HUMAN GENOMIC SEQUENCE (hCG14831) |
| 1619. | HUMAN mRNA SEQUENCE (hCT1954392) |
| 1620. | HUMAN PROTEIN SEQUENCE (hCP1764868) |
| | CANCER GENE: mCG57125/hCG1742422 |
| 1621. | MOUSE GENOMIC SEQUENCE (mCG57125) |
| 1622. | MOUSE mRNA SEQUENCE (mCT57308) |
| 1623. | MOUSE PROTEIN SEQUENCE (mCP31688) |
| 1624. | HUMAN GENOMIC SEQUENCE (hCG1742422) |
| 1625. | HUMAN mRNA SEQUENCE (hCT1780585) |
| 1626. | HUMAN PROTEIN SEQUENCE (hCP1704804) |
| | CANCER GENE: mCG5728/hCG1811271 |
| 1627. | MOUSE GENOMIC SEQUENCE (mCG5728) |
| 1628. | MOUSE mRNA SEQUENCE (mCT5307) |
| 1629. | MOUSE PROTEIN SEQUENCE (mCP22455) |
| 1630. | HUMAN GENOMIC SEQUENCE (hCG1811271) |
| 1631. | HUMAN mRNA SEQUENCE (hCT1951996) |
| 1632. | HUMAN PROTEIN SEQUENCE (hCP1751951) |
| | CANCER GENE: mCG5738/hCG37394 |
| 1633. | MOUSE GENOMIC SEQUENCE (mCG5738) |
| 1634. | MOUSE mRNA SEQUENCE (mCT5149) |
| 1635. | MOUSE PROTEIN SEQUENCE (mCP11789) |
| 1636. | HUMAN GENOMIC SEQUENCE (hCG37394) |
| 1637. | HUMAN mRNA SEQUENCE (hCT1950688) |
| 1638. | HUMAN PROTEIN SEQUENCE (hCP1764248) |
| | CANCER GENE: mCG5779/hCG21040 |
| 1639. | MOUSE GENOMIC SEQUENCE (mCG5779) |
| 1640. | MOUSE mRNA SEQUENCE (mCT4807) |
| 1641. | MOUSE PROTEIN SEQUENCE (mCP5664) |
| 1642. | HUMAN GENOMIC SEQUENCE (hCG21040) |
| 1643. | HUMAN mRNA SEQUENCE (hCT12126) |
| 1644. | HUMAN PROTEIN SEQUENCE (hCP45937) |
| | CANCER GENE: mCG5868/hCG28297 |
| 1645. | MOUSE GENOMIC SEQUENCE (mCG5868) |
| 1646. | MOUSE mRNA SEQUENCE (mCT4586) |
| 1647. | MOUSE PROTEIN SEQUENCE (mCP1369) |
| 1648. | HUMAN GENOMIC SEQUENCE (hCG28297) |
| 1649. | HUMAN mRNA SEQUENCE (hCT19445) |
| 1650. | HUMAN PROTEIN SEQUENCE (hCP45156) |
| | CANCER GENE: mCG6000/hCG1777660 |
| 1651. | MOUSE GENOMIC SEQUENCE (mCG6000) |
| 1652. | MOUSE mRNA SEQUENCE (mCT4635) |
| 1653. | MOUSE PROTEIN SEQUENCE (mCP9274) |
| 1654. | HUMAN GENOMIC SEQUENCE (hCG1777660) |
| 1655. | HUMAN mRNA SEQUENCE (hCT1816404) |
| 1656. | HUMAN PROTEIN SEQUENCE (hCP1711146) |
| | CANCER GENE: mCG6027/hCG38622 |
| 1657. | MOUSE GENOMIC SEQUENCE (mCG6027) |
| 1658. | MOUSE mRNA SEQUENCE (mCT4725) |
| 1659. | MOUSE PROTEIN SEQUENCE (mCP21553) |
| 1660. | HUMAN GENOMIC SEQUENCE (hCG38622) |
| 1661. | HUMAN mRNA SEQUENCE (hCT1952786) |
| 1662. | HUMAN PROTEIN SEQUENCE (hCP1762380) |
| | CANCER GENE: mCG6056/hCG37193 |
| 1663. | MOUSE GENOMIC SEQUENCE (mCG6056) |
| 1664. | MOUSE mRNA SEQUENCE (mCT5154) |
| 1665. | MOUSE PROTEIN SEQUENCE (mCP10360) |
| 1666. | HUMAN GENOMIC SEQUENCE (hCG37193) |
| 1667. | HUMAN mRNA SEQUENCE (hCT28423) |
| 1668. | HUMAN PROTEIN SEQUENCE (hCP48388) |
| | CANCER GENE: mCG6178/hCG33356 |
| 1669. | MOUSE GENOMIC SEQUENCE (mCG6178) |
| 1670. | MOUSE mRNA SEQUENCE (mCT5450) |
| 1671. | MOUSE PROTEIN SEQUENCE (mCP12373) |
| 1672. | HUMAN GENOMIC SEQUENCE (hCG33356) |
| 1673. | HUMAN mRNA SEQUENCE (hCT24551) |
| 1674. | HUMAN PROTEIN SEQUENCE (hCP46689) |
| | CANCER GENE: mCG6322/hCG32986 |
| 1675. | MOUSE GENOMIC SEQUENCE (mCG6322) |
| 1676. | MOUSE mRNA SEQUENCE (mCT5536) |
| 1677. | MOUSE PROTEIN SEQUENCE (mCP16472) |
| 1678. | HUMAN GENOMIC SEQUENCE (hCG32986) |
| 1679. | HUMAN mRNA SEQUENCE (hCT24178) |
| 1680. | HUMAN PROTEIN SEQUENCE (hCP46302) |
| | CANCER GENE: mCG6388/hCG38644 |
| 1681. | MOUSE GENOMIC SEQUENCE (mCG6388) |
| 1682. | MOUSE mRNA SEQUENCE (mCT5698) |
| 1683. | MOUSE PROTEIN SEQUENCE (mCP20186) |
| 1684. | HUMAN GENOMIC SEQUENCE (hCG38644) |
| 1685. | HUMAN mRNA SEQUENCE (hCT29887) |
| 1686. | HUMAN PROTEIN SEQUENCE (hCP48469) |
| | CANCER GENE: mCG6403/hCG38453 |
| 1687. | MOUSE GENOMIC SEQUENCE (mCG6403) |
| 1688. | MOUSE mRNA SEQUENCE (mCT5643) |
| 1689. | MOUSE PROTEIN SEQUENCE (mCP20171) |
| 1690. | HUMAN GENOMIC SEQUENCE (hCG38453) |
| 1691. | HUMAN mRNA SEQUENCE (hCT29696) |
| 1692. | HUMAN PROTEIN SEQUENCE (hCP48358) |
| | CANCER GENE: mCG6481/hCG40757 |
| 1693. | MOUSE GENOMIC SEQUENCE (mCG6481) |
| 1694. | MOUSE mRNA SEQUENCE (mCT5786) |
| 1695. | MOUSE PROTEIN SEQUENCE (mCP18415) |
| 1696. | HUMAN GENOMIC SEQUENCE (hCG40757) |
| 1697. | HUMAN mRNA SEQUENCE (hCT32019) |
| 1698. | HUMAN PROTEIN SEQUENCE (hCP50491) |
| | CANCER GENE: mCG6500/hCG14773 |
| 1699. | MOUSE GENOMIC SEQUENCE (mCG6500) |
| 1700. | MOUSE mRNA SEQUENCE (mCT5731) |
| 1701. | MOUSE PROTEIN SEQUENCE (mCP16037) |
| 1702. | HUMAN GENOMIC SEQUENCE (hCG14773) |
| 1703. | HUMAN mRNA SEQUENCE (hCT5794) |
| 1704. | HUMAN PROTEIN SEQUENCE (hCP35369) |
| | CANCER GENE: mCG6549/hCG37127 |
| 1705. | MOUSE GENOMIC SEQUENCE (mCG6549) |
| 1706. | MOUSE mRNA SEQUENCE (mCT6076) |
| 1707. | MOUSE PROTEIN SEQUENCE (mCP6001) |
| 1708. | HUMAN GENOMIC SEQUENCE (hCG37127) |
| 1709. | HUMAN mRNA SEQUENCE (hCT1950762) |
| 1710. | HUMAN PROTEIN SEQUENCE (hCP1767501) |
| | CANCER GENE: mCG6627/hCG27461 |
| 1711. | MOUSE GENOMIC SEQUENCE (mCG6627) |
| 1712. | MOUSE mRNA SEQUENCE (mCT4944) |
| 1713. | MOUSE PROTEIN SEQUENCE (mCP18836) |
| 1714. | HUMAN GENOMIC SEQUENCE (hCG27461) |
| 1715. | HUMAN mRNA SEQUENCE (hCT18601) |
| 1716. | HUMAN PROTEIN SEQUENCE (hCP43032) |

TABLE 2-continued

IDENTIFICATION OF SEQUENCES

| SEQ ID NOS. | SEQUENCES |
|---|---|
| | CANCER GENE: mCG6631/hCG29839 |
| 1717. | MOUSE GENOMIC SEQUENCE (mCG6631) |
| 1718. | MOUSE mRNA SEQUENCE (mCT4941) |
| 1719. | MOUSE PROTEIN SEQUENCE (mCP18882) |
| 1720. | HUMAN GENOMIC SEQUENCE (hCG29839) |
| 1721. | HUMAN mRNA SEQUENCE (hCT21006) |
| 1722. | HUMAN PROTEIN SEQUENCE (hCP44613) |
| | CANCER GENE: mCG66316/hCG29191 |
| 1723. | MOUSE GENOMIC SEQUENCE (mCG66316) |
| 1724. | MOUSE mRNA SEQUENCE (mCT66499) |
| 1725. | MOUSE PROTEIN SEQUENCE (mCP40302) |
| 1726. | HUMAN GENOMIC SEQUENCE (hCG29191) |
| 1727. | HUMAN mRNA SEQUENCE (hCT1951169) |
| 1728. | HUMAN PROTEIN SEQUENCE (hCP1766688) |
| | CANCER GENE: mCG6636/hCG33210 |
| 1729. | MOUSE GENOMIC SEQUENCE (mCG6636) |
| 1730. | MOUSE mRNA SEQUENCE (mCT4916) |
| 1731. | MOUSE PROTEIN SEQUENCE (mCP3446) |
| 1732. | HUMAN GENOMIC SEQUENCE (hCG33210) |
| 1733. | HUMAN mRNA SEQUENCE (hCT24403) |
| 1734. | HUMAN PROTEIN SEQUENCE (hCP46579) |
| | CANCER GENE: mCG6875/hCG32956 |
| 1735. | MOUSE GENOMIC SEQUENCE (mCG6875) |
| 1736. | MOUSE mRNA SEQUENCE (mCT5377) |
| 1737. | MOUSE PROTEIN SEQUENCE (mCP8851) |
| 1738. | HUMAN GENOMIC SEQUENCE (hCG32956) |
| 1739. | HUMAN mRNA SEQUENCE (hCT1686636) |
| 1740. | HUMAN PROTEIN SEQUENCE (hCP1690129) |
| | CANCER GENE: mCG6919/hCG1644194 |
| 1741. | MOUSE GENOMIC SEQUENCE (mCG6919) |
| 1742. | MOUSE mRNA SEQUENCE (mCT5869) |
| 1743. | MOUSE PROTEIN SEQUENCE (mCP10200) |
| 1744. | HUMAN GENOMIC SEQUENCE (hCG1644194) |
| 1745. | HUMAN mRNA SEQUENCE (hCT1644321) |
| 1746. | HUMAN PROTEIN SEQUENCE (hCP1641003) |
| | CANCER GENE: mCG6945/hCG14907 |
| 1747. | MOUSE GENOMIC SEQUENCE (mCG6945) |
| 1748. | MOUSE mRNA SEQUENCE (mCT5912) |
| 1749. | MOUSE PROTEIN SEQUENCE (mCP6966) |
| 1750. | HUMAN GENOMIC SEQUENCE (hCG14907) |
| 1751. | HUMAN mRNA SEQUENCE (hCT5928) |
| 1752. | HUMAN PROTEIN SEQUENCE (hCP33928) |
| | CANCER GENE: mCG6974/hCG17395 |
| 1753. | MOUSE GENOMIC SEQUENCE (mCG6974) |
| 1754. | MOUSE mRNA SEQUENCE (mCT5770) |
| 1755. | MOUSE PROTEIN SEQUENCE (mCP7427) |
| 1756. | HUMAN GENOMIC SEQUENCE (hCG17395) |
| 1757. | HUMAN mRNA SEQUENCE (hCT8445) |
| 1758. | HUMAN PROTEIN SEQUENCE (hCP33979) |
| | CANCER GENE: mCG6981/hCG1735348 |
| 1759. | MOUSE GENOMIC SEQUENCE (mCG6981) |
| 1760. | MOUSE mRNA SEQUENCE (mCT5634) |
| 1761. | MOUSE PROTEIN SEQUENCE (mCP7937) |
| 1762. | HUMAN GENOMIC SEQUENCE (hCG1735348) |
| 1763. | HUMAN mRNA SEQUENCE (hCT1773342) |
| 1764. | HUMAN PROTEIN SEQUENCE (hCP1705220) |
| | CANCER GENE: mCG7008/hCG25055 |
| 1765. | MOUSE GENOMIC SEQUENCE (mCG7008) |
| 1766. | MOUSE mRNA SEQUENCE (mCT5582) |
| 1767. | MOUSE PROTEIN SEQUENCE (mCP18363) |
| 1768. | HUMAN GENOMIC SEQUENCE (hCG25055) |
| 1769. | HUMAN mRNA SEQUENCE (hCT16177) |
| 1770. | HUMAN PROTEIN SEQUENCE (hCP41953) |
| | CANCER GENE: mCG7143/hCG32521 |
| 1771. | MOUSE GENOMIC SEQUENCE (mCG7143) |
| 1772. | MOUSE mRNA SEQUENCE (mCT6024) |
| 1773. | MOUSE PROTEIN SEQUENCE (mCP20132) |
| 1774. | HUMAN GENOMIC SEQUENCE (hCG32521) |
| 1775. | HUMAN mRNA SEQUENCE (hCT23710) |
| 1776. | HUMAN PROTEIN SEQUENCE (hCP45837) |
| | CANCER GENE: mCG7189/hCG1640838 |
| 1777. | MOUSE GENOMIC SEQUENCE (mCG7189) |
| 1778. | MOUSE mRNA SEQUENCE (mCT6099) |
| 1779. | MOUSE PROTEIN SEQUENCE (mCP6124) |
| 1780. | HUMAN GENOMIC SEQUENCE (hCG1640838) |
| 1781. | HUMAN mRNA SEQUENCE (hCT1640965) |
| 1782. | HUMAN PROTEIN SEQUENCE (hCP1622409) |
| | CANCER GENE: mCG7211/hCG1781938 |
| 1783. | MOUSE GENOMIC SEQUENCE (mCG7211) |
| 1784. | MOUSE mRNA SEQUENCE (mCT6016) |
| 1785. | MOUSE PROTEIN SEQUENCE (mCP4537) |
| 1786. | HUMAN GENOMIC SEQUENCE (hCG1781938) |
| 1787. | HUMAN mRNA SEQUENCE (hCT1820826) |
| 1788. | HUMAN PROTEIN SEQUENCE (hCP1698824) |
| | CANCER GENE: mCG7212/hCG37223 |
| 1789. | MOUSE GENOMIC SEQUENCE (mCG7212) |
| 1790. | MOUSE mRNA SEQUENCE (mCT6017) |
| 1791. | MOUSE PROTEIN SEQUENCE (mCP4540) |
| 1792. | HUMAN GENOMIC SEQUENCE (hCG37223) |
| 1793. | HUMAN mRNA SEQUENCE (hCT1952513) |
| 1794. | HUMAN PROTEIN SEQUENCE (hCP1761013) |
| | CANCER GENE: mCG7256/hCG39345 |
| 1795. | MOUSE GENOMIC SEQUENCE (mCG7256) |
| 1796. | MOUSE mRNA SEQUENCE (mCT3682) |
| 1797. | MOUSE PROTEIN SEQUENCE (mCP15726) |
| 1798. | HUMAN GENOMIC SEQUENCE (hCG39345) |
| 1799. | HUMAN mRNA SEQUENCE (hCT30596) |
| 1800. | HUMAN PROTEIN SEQUENCE (hCP49488) |
| | CANCER GENE: mCG7264/hCG39344 |
| 1801. | MOUSE GENOMIC SEQUENCE (mCG7264) |
| 1802. | MOUSE mRNA SEQUENCE (mCT3672) |
| 1803. | MOUSE PROTEIN SEQUENCE (mCP15739) |
| 1804. | HUMAN GENOMIC SEQUENCE (hCG39344) |
| 1805. | HUMAN mRNA SEQUENCE (hCT1950668) |
| 1806. | HUMAN PROTEIN SEQUENCE (hCP1752538) |
| | CANCER GENE: mCG7348/hCG28560 |
| 1807. | MOUSE GENOMIC SEQUENCE (mCG7348) |
| 1808. | MOUSE mRNA SEQUENCE (mCT6342) |
| 1809. | MOUSE PROTEIN SEQUENCE (mCP20154) |
| 1810. | HUMAN GENOMIC SEQUENCE (hCG28560) |
| 1811. | HUMAN mRNA SEQUENCE (hCT19714) |
| 1812. | HUMAN PROTEIN SEQUENCE (hCP43996) |
| | CANCER GENE: mCG7369/hCG22856 |
| 1813. | MOUSE GENOMIC SEQUENCE (mCG7369) |
| 1814. | MOUSE mRNA SEQUENCE (mCT6267) |
| 1815. | MOUSE PROTEIN SEQUENCE (mCP9400) |
| 1816. | HUMAN GENOMIC SEQUENCE (hCG22856) |
| 1817. | HUMAN mRNA SEQUENCE (hCT13954) |
| 1818. | HUMAN PROTEIN SEQUENCE (hCP40284) |
| | CANCER GENE: mCG7522/hCG32930 |
| 1819. | MOUSE GENOMIC SEQUENCE (mCG7522) |
| 1820. | MOUSE mRNA SEQUENCE (mCT6508) |
| 1821. | MOUSE PROTEIN SEQUENCE (mCP11731) |
| 1822. | HUMAN GENOMIC SEQUENCE (hCG32930) |
| 1823. | HUMAN mRNA SEQUENCE (hCT24122) |
| 1824. | HUMAN PROTEIN SEQUENCE (hCP46487) |

TABLE 2-continued

IDENTIFICATION OF SEQUENCES

| SEQ ID NOS. | SEQUENCES |
|---|---|
| | CANCER GENE: mCG7669/hCG30694 |
| 1825. | MOUSE GENOMIC SEQUENCE (mCG7669) |
| 1826. | MOUSE mRNA SEQUENCE (mCT6381) |
| 1827. | MOUSE PROTEIN SEQUENCE (mCP9354) |
| 1828. | HUMAN GENOMIC SEQUENCE (hCG30694) |
| 1829. | HUMAN mRNA SEQUENCE (hCT1952710) |
| 1830. | HUMAN PROTEIN SEQUENCE (hCP1766207) |
| | CANCER GENE: mCG7689/hCG32392 |
| 1831. | MOUSE GENOMIC SEQUENCE (mCG7689) |
| 1832. | MOUSE mRNA SEQUENCE (mCT6573) |
| 1833. | MOUSE PROTEIN SEQUENCE (mCP11083) |
| 1834. | HUMAN GENOMIC SEQUENCE (hCG32392) |
| 1835. | HUMAN mRNA SEQUENCE (hCT23580) |
| 1836. | HUMAN PROTEIN SEQUENCE (hCP46697) |
| | CANCER GENE: mCG7785/hCG24868 |
| 1837. | MOUSE GENOMIC SEQUENCE (mCG7785) |
| 1838. | MOUSE mRNA SEQUENCE (mCT6917) |
| 1839. | MOUSE PROTEIN SEQUENCE (mCP18186) |
| 1840. | HUMAN GENOMIC SEQUENCE (hCG24868) |
| 1841. | HUMAN mRNA SEQUENCE (hCT15989) |
| 1842. | HUMAN PROTEIN SEQUENCE (hCP41880) |
| | CANCER GENE: mCG7804/hCG39065 |
| 1843. | MOUSE GENOMIC SEQUENCE (mCG7804) |
| 1844. | MOUSE mRNA SEQUENCE (mCT6952) |
| 1845. | MOUSE PROTEIN SEQUENCE (mCP3002) |
| 1846. | HUMAN GENOMIC SEQUENCE (hCG39065) |
| 1847. | HUMAN mRNA SEQUENCE (hCT30312) |
| 1848. | HUMAN PROTEIN SEQUENCE (hCP48906) |
| | CANCER GENE: mCG7826/hCG1735557 |
| 1849. | MOUSE GENOMIC SEQUENCE (mCG7826) |
| 1850. | MOUSE mRNA SEQUENCE (mCT6588) |
| 1851. | MOUSE PROTEIN SEQUENCE (mCP13941) |
| 1852. | HUMAN GENOMIC SEQUENCE (hCG1735557) |
| 1853. | HUMAN mRNA SEQUENCE (hCT1773553) |
| 1854. | HUMAN PROTEIN SEQUENCE (hCP1731122) |
| | CANCER GENE: mCG7831/hCG37578 |
| 1855. | MOUSE GENOMIC SEQUENCE (mCG7831) |
| 1856. | MOUSE mRNA SEQUENCE (mCT6886) |
| 1857. | MOUSE PROTEIN SEQUENCE (mCP18535) |
| 1858. | HUMAN GENOMIC SEQUENCE (hCG37578) |
| 1859. | HUMAN mRNA SEQUENCE (hCT28811) |
| 1860. | HUMAN PROTEIN SEQUENCE (hCP47543) |
| | CANCER GENE: mCG7923/hCG22125 |
| 1861. | MOUSE GENOMIC SEQUENCE (mCG7923) |
| 1862. | MOUSE mRNA SEQUENCE (mCT6738) |
| 1863. | MOUSE PROTEIN SEQUENCE (mCP3098) |
| 1864. | HUMAN GENOMIC SEQUENCE (hCG22125) |
| 1865. | HUMAN mRNA SEQUENCE (hCT13218) |
| 1866. | HUMAN PROTEIN SEQUENCE (hCP39611) |
| | CANCER GENE: mCG7927/hCG20927 |
| 1867. | MOUSE GENOMIC SEQUENCE (mCG7927) |
| 1868. | MOUSE mRNA SEQUENCE (mCT6729) |
| 1869. | MOUSE PROTEIN SEQUENCE (mCP3261) |
| 1870. | HUMAN GENOMIC SEQUENCE (hCG20927) |
| 1871. | HUMAN mRNA SEQUENCE (hCT12009) |
| 1872. | HUMAN PROTEIN SEQUENCE (hCP38533) |
| | CANCER GENE: mCG7964/hCG27325 |
| 1873. | MOUSE GENOMIC SEQUENCE (mCG7964) |
| 1874. | MOUSE mRNA SEQUENCE (mCT7300) |
| 1875. | MOUSE PROTEIN SEQUENCE (mCP18236) |
| 1876. | HUMAN GENOMIC SEQUENCE (hCG27325) |
| 1877. | HUMAN mRNA SEQUENCE (hCT18464) |
| 1878. | HUMAN PROTEIN SEQUENCE (hCP42919) |
| | CANCER GENE: mCG8211/hCG24168 |
| 1879. | MOUSE GENOMIC SEQUENCE (mCG8211) |
| 1880. | MOUSE mRNA SEQUENCE (mCT7649) |
| 1881. | MOUSE PROTEIN SEQUENCE (mCP21082) |
| 1882. | HUMAN GENOMIC SEQUENCE (hCG24168) |
| 1883. | HUMAN mRNA SEQUENCE (hCT15282) |
| 1884. | HUMAN PROTEIN SEQUENCE (hCP41497) |
| | CANCER GENE: mCG8306/hCG18967 |
| 1885. | MOUSE GENOMIC SEQUENCE (mCG8306) |
| 1886. | MOUSE mRNA SEQUENCE (mCT7487) |
| 1887. | MOUSE PROTEIN SEQUENCE (mCP11411) |
| 1888. | HUMAN GENOMIC SEQUENCE (hCG18967) |
| 1889. | HUMAN mRNA SEQUENCE (hCT10032) |
| 1890. | HUMAN PROTEIN SEQUENCE (hCP37047) |
| | CANCER GENE: mCG8426/hCG27711 |
| 1891. | MOUSE GENOMIC SEQUENCE (mCG8426) |
| 1892. | MOUSE mRNA SEQUENCE (mCT7097) |
| 1893. | MOUSE PROTEIN SEQUENCE (mCP9700) |
| 1894. | HUMAN GENOMIC SEQUENCE (hCG27711) |
| 1895. | HUMAN mRNA SEQUENCE (hCT18853) |
| 1896. | HUMAN PROTEIN SEQUENCE (hCP43269) |
| | CANCER GENE: mCG8466/hCG29605 |
| 1897. | MOUSE GENOMIC SEQUENCE (mCG8466) |
| 1898. | MOUSE mRNA SEQUENCE (mCT7481) |
| 1899. | MOUSE PROTEIN SEQUENCE (mCP18300) |
| 1900. | HUMAN GENOMIC SEQUENCE (hCG29605) |
| 1901. | HUMAN mRNA SEQUENCE (hCT1816740) |
| 1902. | HUMAN PROTEIN SEQUENCE (hCP1739247) |
| | CANCER GENE: mCG8527/hCG34336 |
| 1903. | MOUSE GENOMIC SEQUENCE (mCG8527) |
| 1904. | MOUSE mRNA SEQUENCE (mCT7245) |
| 1905. | MOUSE PROTEIN SEQUENCE (mCP15644) |
| 1906. | HUMAN GENOMIC SEQUENCE (hCG34336) |
| 1907. | HUMAN mRNA SEQUENCE (hCT25539) |
| 1908. | HUMAN PROTEIN SEQUENCE (hCP46979) |
| | CANCER GENE: mCG8564/hCG27679 |
| 1909. | MOUSE GENOMIC SEQUENCE (mCG8564) |
| 1910. | MOUSE mRNA SEQUENCE (mCT7392) |
| 1911. | MOUSE PROTEIN SEQUENCE (mCP18404) |
| 1912. | HUMAN GENOMIC SEQUENCE (hCG27679) |
| 1913. | HUMAN mRNA SEQUENCE (hCT18820) |
| 1914. | HUMAN PROTEIN SEQUENCE (hCP43233) |
| | CANCER GENE: mCG8581/hCG14605 |
| 1915. | MOUSE GENOMIC SEQUENCE (mCG8581) |
| 1916. | MOUSE mRNA SEQUENCE (mCT7409) |
| 1917. | MOUSE PROTEIN SEQUENCE (mCP13660) |
| 1918. | HUMAN GENOMIC SEQUENCE (hCG14605) |
| 1919. | HUMAN mRNA SEQUENCE (hCT5626) |
| 1920. | HUMAN PROTEIN SEQUENCE (hCP33329) |
| | CANCER GENE: mCG8584/hCG15017 |
| 1921. | MOUSE GENOMIC SEQUENCE (mCG8584) |
| 1922. | MOUSE mRNA SEQUENCE (mCT7403) |
| 1923. | MOUSE PROTEIN SEQUENCE (mCP13663) |
| 1924. | HUMAN GENOMIC SEQUENCE (hCG15017) |
| 1925. | HUMAN mRNA SEQUENCE (hCT6038) |
| 1926. | HUMAN PROTEIN SEQUENCE (hCP35730) |
| | CANCER GENE: mCG8821/hCG31443 |
| 1927. | MOUSE GENOMIC SEQUENCE (mCG8821) |
| 1928. | MOUSE mRNA SEQUENCE (mCT9309) |
| 1929. | MOUSE PROTEIN SEQUENCE (mCP13907) |
| 1930. | HUMAN GENOMIC SEQUENCE (hCG31443) |
| 1931. | HUMAN mRNA SEQUENCE (hCT1958026) |
| 1932. | HUMAN PROTEIN SEQUENCE (hCP1762737) |

TABLE 2-continued

IDENTIFICATION OF SEQUENCES

| SEQ ID NOS. | SEQUENCES |
|---|---|
|  | CANCER GENE: mCG8835/hCG17175 |
| 1933. | MOUSE GENOMIC SEQUENCE (mCG8835) |
| 1934. | MOUSE mRNA SEQUENCE (mCT9428) |
| 1935. | MOUSE PROTEIN SEQUENCE (mCP22858) |
| 1936. | HUMAN GENOMIC SEQUENCE (hCG17175) |
| 1937. | HUMAN mRNA SEQUENCE (hCT1954427) |
| 1938. | HUMAN PROTEIN SEQUENCE (hCP1764428) |
|  | CANCER GENE: mCG8893/hCG19941 |
| 1939. | MOUSE GENOMIC SEQUENCE (mCG8893) |
| 1940. | MOUSE mRNA SEQUENCE (mCT9941) |
| 1941. | MOUSE PROTEIN SEQUENCE (mCP11443) |
| 1942. | HUMAN GENOMIC SEQUENCE (hCG19941) |
| 1943. | HUMAN mRNA SEQUENCE (hCT11013) |
| 1944. | HUMAN PROTEIN SEQUENCE (hCP37649) |
|  | CANCER GENE: mCG8963/hCG1639824 |
| 1945. | MOUSE GENOMIC SEQUENCE (mCG8963) |
| 1946. | MOUSE mRNA SEQUENCE (mCT8905) |
| 1947. | MOUSE PROTEIN SEQUENCE (mCP20497) |
| 1948. | HUMAN GENOMIC SEQUENCE (hCG1639824) |
| 1949. | HUMAN mRNA SEQUENCE (hCT1639951) |
| 1950. | HUMAN PROTEIN SEQUENCE (hCP1609218) |
|  | CANCER GENE: mCG8993/hCG34092 |
| 1951. | MOUSE GENOMIC SEQUENCE (mCG8993) |
| 1952. | MOUSE mRNA SEQUENCE (mCT8968) |
| 1953. | MOUSE PROTEIN SEQUENCE (mCP11923) |
| 1954. | HUMAN GENOMIC SEQUENCE (hCG34092) |
| 1955. | HUMAN mRNA SEQUENCE (hCT25292) |
| 1956. | HUMAN PROTEIN SEQUENCE (hCP46939) |
|  | CANCER GENE: mCG9022/hCG32769 |
| 1957. | MOUSE GENOMIC SEQUENCE (mCG9022) |
| 1958. | MOUSE mRNA SEQUENCE (mCT9076) |
| 1959. | MOUSE PROTEIN SEQUENCE (mCP14863) |
| 1960. | HUMAN GENOMIC SEQUENCE (hCG32769) |
| 1961. | HUMAN mRNA SEQUENCE (hCT23960) |
| 1962. | HUMAN PROTEIN SEQUENCE (hCP46122) |
|  | CANCER GENE: mCG9049/hCG25130 |
| 1963. | MOUSE GENOMIC SEQUENCE (mCG9049) |
| 1964. | MOUSE mRNA SEQUENCE (mCT9186) |
| 1965. | MOUSE PROTEIN SEQUENCE (mCP8512) |
| 1966. | HUMAN GENOMIC SEQUENCE (hCG25130) |
| 1967. | HUMAN mRNA SEQUENCE (hCT16254) |
| 1968. | HUMAN PROTEIN SEQUENCE (hCP42053) |
|  | CANCER GENE: mCG9061/hCG37877 |
| 1969. | MOUSE GENOMIC SEQUENCE (mCG9061) |
| 1970. | MOUSE mRNA SEQUENCE (mCT9106) |
| 1971. | MOUSE PROTEIN SEQUENCE (mCP6323) |
| 1972. | HUMAN GENOMIC SEQUENCE (hCG37877) |
| 1973. | HUMAN mRNA SEQUENCE (hCT29112) |
| 1974. | HUMAN PROTEIN SEQUENCE (hCP47826) |
|  | CANCER GENE: mCG9066/hCG37872 |
| 1975. | MOUSE GENOMIC SEQUENCE (mCG9066) |
| 1976. | MOUSE mRNA SEQUENCE (mCT9112) |
| 1977. | MOUSE PROTEIN SEQUENCE (mCP6294) |
| 1978. | HUMAN GENOMIC SEQUENCE (hCG37872) |
| 1979. | HUMAN mRNA SEQUENCE (hCT29107) |
| 1980. | HUMAN PROTEIN SEQUENCE (hCP47828) |
|  | CANCER GENE: mCG9077/hCG23504 |
| 1981. | MOUSE GENOMIC SEQUENCE (mCG9077) |
| 1982. | MOUSE mRNA SEQUENCE (mCT9209) |
| 1983. | MOUSE PROTEIN SEQUENCE (mCP4875) |
| 1984. | HUMAN GENOMIC SEQUENCE (hCG23504) |
| 1985. | HUMAN mRNA SEQUENCE (hCT1686496) |
| 1986. | HUMAN PROTEIN SEQUENCE (hCP1689892) |

TABLE 2-continued

IDENTIFICATION OF SEQUENCES

| SEQ ID NOS. | SEQUENCES |
|---|---|
|  | CANCER GENE: mCG9223/hCG15927 |
| 1987. | MOUSE GENOMIC SEQUENCE (mCG9223) |
| 1988. | MOUSE mRNA SEQUENCE (mCT9154) |
| 1989. | MOUSE PROTEIN SEQUENCE (mCP13326) |
| 1990. | HUMAN GENOMIC SEQUENCE (hCG15927) |
| 1991. | HUMAN mRNA SEQUENCE (hCT6957) |
| 1992. | HUMAN PROTEIN SEQUENCE (hCP35436) |
|  | CANCER GENE: mCG9253/hCG22665 |
| 1993. | MOUSE GENOMIC SEQUENCE (mCG9253) |
| 1994. | MOUSE mRNA SEQUENCE (mCT8974) |
| 1995. | MOUSE PROTEIN SEQUENCE (mCP4599) |
| 1996. | HUMAN GENOMIC SEQUENCE (hCG22665) |
| 1997. | HUMAN mRNA SEQUENCE (hCT13763) |
| 1998. | HUMAN PROTEIN SEQUENCE (hCP40639) |
|  | CANCER GENE: mCG9266/hCG14925 |
| 1999. | MOUSE GENOMIC SEQUENCE (mCG9266) |
| 2000. | MOUSE mRNA SEQUENCE (mCT9256) |
| 2001. | MOUSE PROTEIN SEQUENCE (mCP10547) |
| 2002. | HUMAN GENOMIC SEQUENCE (hCG14925) |
| 2003. | HUMAN mRNA SEQUENCE (hCT5946) |
| 2004. | HUMAN PROTEIN SEQUENCE (hCP35018) |
|  | CANCER GENE: mCG9336/hCG28203 |
| 2005. | MOUSE GENOMIC SEQUENCE (mCG9336) |
| 2006. | MOUSE mRNA SEQUENCE (mCT9645) |
| 2007. | MOUSE PROTEIN SEQUENCE (mCP8121) |
| 2008. | HUMAN GENOMIC SEQUENCE (hCG28203) |
| 2009. | HUMAN mRNA SEQUENCE (hCT19351) |
| 2010. | HUMAN PROTEIN SEQUENCE (hCP43708) |
|  | CANCER GENE: mCG9393/hCG16330 |
| 2011. | MOUSE GENOMIC SEQUENCE (mCG9393) |
| 2012. | MOUSE mRNA SEQUENCE (mCT8983) |
| 2013. | MOUSE PROTEIN SEQUENCE (mCP8840) |
| 2014. | HUMAN GENOMIC SEQUENCE (hCG16330) |
| 2015. | HUMAN mRNA SEQUENCE (hCT1950491) |
| 2016. | HUMAN PROTEIN SEQUENCE (hCP1766825) |
|  | CANCER GENE: mCG9397/hCG24200 |
| 2017. | MOUSE GENOMIC SEQUENCE (mCG9397) |
| 2018. | MOUSE mRNA SEQUENCE (mCT9198) |
| 2019. | MOUSE PROTEIN SEQUENCE (mCP21072) |
| 2020. | HUMAN GENOMIC SEQUENCE (hCG24200) |
| 2021. | HUMAN mRNA SEQUENCE (hCT15314) |
| 2022. | HUMAN PROTEIN SEQUENCE (hCP41513) |
|  | CANCER GENE: mCG9437/hCG16805 |
| 2023. | MOUSE GENOMIC SEQUENCE (mCG9437) |
| 2024. | MOUSE mRNA SEQUENCE (mCT9395) |
| 2025. | MOUSE PROTEIN SEQUENCE (mCP16621) |
| 2026. | HUMAN GENOMIC SEQUENCE (hCG16805) |
| 2027. | HUMAN mRNA SEQUENCE (hCT7846) |
| 2028. | HUMAN PROTEIN SEQUENCE (hCP36061) |
|  | CANCER GENE: mCG9440/hCG401128 |
| 2029. | MOUSE GENOMIC SEQUENCE (mCG9440) |
| 2030. | MOUSE mRNA SEQUENCE (mCT9084) |
| 2031. | MOUSE PROTEIN SEQUENCE (mCP2582) |
| 2032. | HUMAN GENOMIC SEQUENCE (hCG401128) |
| 2033. | HUMAN mRNA SEQUENCE (hCT401130) |
| 2034. | HUMAN PROTEIN SEQUENCE (hCP801053) |
|  | CANCER GENE: mCG9536/hCG23831 |
| 2035. | MOUSE GENOMIC SEQUENCE (mCG9536) |
| 2036. | MOUSE mRNA SEQUENCE (mCT9701) |
| 2037. | MOUSE PROTEIN SEQUENCE (mCP9054) |
| 2038. | HUMAN GENOMIC SEQUENCE (hCG23831) |
| 2039. | HUMAN mRNA SEQUENCE (hCT14943) |
| 2040. | HUMAN PROTEIN SEQUENCE (hCP41222) |

TABLE 2-continued

IDENTIFICATION OF SEQUENCES

| SEQ ID NOS. | SEQUENCES |
|---|---|
| | CANCER GENE: mCG9597/hCG37835 |
| 2041. | MOUSE GENOMIC SEQUENCE (mCG9597) |
| 2042. | MOUSE mRNA SEQUENCE (mCT9560) |
| 2043. | MOUSE PROTEIN SEQUENCE (mCP8269) |
| 2044. | HUMAN GENOMIC SEQUENCE (hCG37835) |
| 2045. | HUMAN mRNA SEQUENCE (hCT29070) |
| 2046. | HUMAN PROTEIN SEQUENCE (hCP47769) |
| | CANCER GENE: mCG9808/hCG30268 |
| 2047. | MOUSE GENOMIC SEQUENCE (mCG9808) |
| 2048. | MOUSE mRNA SEQUENCE (mCT10254) |
| 2049. | MOUSE PROTEIN SEQUENCE (mCP12786) |
| 2050. | HUMAN GENOMIC SEQUENCE (hCG30268) |
| 2051. | HUMAN mRNA SEQUENCE (hCT21439) |
| 2052. | HUMAN PROTEIN SEQUENCE (hCP44804) |
| | CANCER GENE: mCG9960/hCG1642754 |
| 2053. | MOUSE GENOMIC SEQUENCE (mCG9960) |
| 2054. | MOUSE mRNA SEQUENCE (mCT10183) |
| 2055. | MOUSE PROTEIN SEQUENCE (mCP1922) |
| 2056. | HUMAN GENOMIC SEQUENCE (hCG1642754) |
| 2057. | HUMAN mRNA SEQUENCE (hCT1642881) |
| 2058. | HUMAN PROTEIN SEQUENCE (hCP1628404) |
| 2059. | Unknown (Cytokine receptor extracellular motif found in many species) |

SEQUENCE LISTING (2059 sequences)

SEQ ID NO: 1 - DNA, 40633 bp, Mus musculus
  misc_feature (1)...(40633): N= A or C or G or T/U
ccggtcttcagacacaccaaagagggcatcagatggttgtgagccaccatgtggttgctgggaattgaactcaggacctctgcaagagcagtcagtgctcttatccactgagccaactttccagaagtttatttacataaacagtccttatattttacctgctctgatttttgtgattaaaatctgttactacttgtttgcgttaccagctatcactggaagaacatgtttatcagagctgtcagttgggctgggacagaaagtcaaaccctcaactgtcactcaaaggtctgatacccaggtcagtaccagcattaaggaggcagagagccagtgcatttgacactacaactgaaacttactttgaaaatgtttaccagcttattttaaatgtcaaaatgctcaagaaactcatcagctgtagtaagcaattcagacagccataaacctatagagaacagatcttaatctaagttcaagagtcttatagaaatcaaacatgtaggactgtcaaacattctatcaggatgtagctaactgaggtaaactaggtgctgggactatagacaagtattcctatgtacctcagatggcactaaaaccgtcttggtactttctagtgtggtcttcggcaaagatcatcaactaaggactgggtcctgaattcaggcgctactgcgtaagtgctgagcagttccctgaggatgctatggaagctttgggttttgtttttctttttcaaggcagggcctcacatagcctaagctgtcctcacactctatttgtagtagagaatgaccttgaacttctcatcatcttacttctgcgccccctccccccagctctagaattacagccctgcaccaccatgcctggtttactaagtgcttgcgacagaacccaggacttcccgcatgctgggtaagcacatctgtcaacaagctatacccccagcttgtagaacctatttttagtaaatttcttactgacatagtaaaatttgaggaatgaattttctctgtggataaatgtcttaagtggtaattaacaggtttggcctgattatatgataagggtgtgtaaatacattcatagagtagtggtggcatgcacctttaattacagcagttccacaccacagggctacacagcgaaagagaaaagagacacttgtgacaataaccagtttagagattcctcaagataaaaggtttttatcacttaagtgacaaacacaaaaattattcactatttaaaccaggcgttctggctagctattaaattcaatagttagtacgggaagttctgaatttataattggataatgttccaaaacttatttttgagttatttggaacctgaaacacacattcccatagaaacaatgctataaatggtggctcaagtttgtgctcacacccaaaagcctgttaaagccactgtgcgccctgtatgagtcttcacgatgctggggcgtactgtgtcattagtactcaccactgtgaggagcagtatggtacagtaatgtccactgtacggagccctcaaggacagggacaatgcttaaaggccttagtgttcttgtggtcagcagtcatcctacaaggctggcacttaaagtgaaaggaaaagaaagaaaagtcctggaaacagccactgctagacatggggtaccaattctggctgctcagcaactcccagcaacccttgcggcccttgactcctccttctcagccatcaaagcagaagagtcacattcaggcaaggactcctgcactgactagcaacaacagtgcttctggcaatctaactgttaaaagttagtgtcatcatactgaacacaatttataaaatttcatgaaaaatcaagcccaatttatgaccttgcagatcagaaagcacacccaggctttgagtcagtggccgtcagccttcctactgacacaaccctttaatacagttcccatgctggggcgatgcccagctatatagttattctgttgctaccgttatgaatcaacgtaaatatcggatttgcaggatatctgtgaccccctgtgaagagtcgttcgacaaccaaccccacccccagccccagccccaatggggtctaaacccgcaggttgagaaacactgctctaagaagttaagcaacatgcgtagcgacatctgatttcagtggctctaagggtcagacctaggtctctatcctcctagtctaggttcctctggtcaccagcagcgcctgtgactgcaccacctgacttcacctcaccaacaggccctgcccaatgcaggaactgttcacacttatgcaaaactcaggctgctgctctttggctagtctgtttctgttcccctggccaagccaacagctgtcacttctaaaaggcatgctgatccgctgtccgccattttaatctccgataggccatgaaacatctacataatttacttctttgaggccctttgttatgtactatgtggaaggtaaccaaattgtcttttggcttcatggcaggtcaataaatgttcccaacttaacacggatgagccatctctgtagttcaactggatgccatgtctagatagaaacggaattcatccacacagcaggcagagggaagaaaatggggttctgaactctgcttcctctctggtgtaagaggaaaggtattttacatatccatttttaaccttctatactagaggcagtgtagccattttctgaacactagagggcaatgtaggcacctctgccctaaacgcagccacagcaccacgttggtcccccagcacatggcattggtattgtttgttttgtagtacttttacttattctaaagccatgcgaactcatgccgtctgccgcaactgttaacaatggaaggcaagccgttttagaacttaagtattcagtctaagctgacacatggcctgccacattgatggtttgcttccccctctcagcagagcctgtaagtccaatgaagaacactgtttccaggtctgcagctctaacccaaactgagaaaacgtcttttctttctttttggagaaagggtctctctctattctgctggcctctagagatcagcctgcctctgcctccaagtgctagaatcaaaaaggagtgtgctaccatggccactaaaactaactaaagtaaataaactaaaaccaacaaaaagtaccagtaagaaaagatccattctaaacataattccatttctaagccttaaatctcttaagatttcccccatctcaaaacccgtgcagagtgaaagccttccttacttcatacacaccattcccttgcttagaaccatctttggagaccctttcctgatttaggaggaggcagacacctcttttctgtacagcaaaagtctgcccatgagccacagggagacaagagatgggtcatctgaactggaggtcctatggcccttgaaatgaaggtgttatatcaggcattattacaacccctaacttctagtagttgcttgacatttaattgatatttaatgagtttttccaaggaataaatgttaaactgagcaagttagatttggctcaccagtttttgctttatggctgtcactgaaacttttatatagttgtcagcttatagggtctctttcagacattagtgaacagattcttacaacgaacaccctgagataggcttttaattatctatattttgtgaatgaagaaaacatgtgcagtagttaactacccatcttgtaaacagaagctgggactgaaaccctaactcttgattcaaaatgcagagtttcagtttctgtaactcagactccactttctgggtatgattattcagtaaggcgccctctggaacattctaagcctcccacagtcactctttccatcacagtataagctctcagcattcttgctgtcttatcttgcaggctcacagaacacaccccttccccatctcctttcccatctgctgaccgccatgcccaccccacggctggcaatttcaagtatggaggagctcttcagctagctcttaaaagggcaacatgcacctcacacaggaaactaacagaaaatataattagcaatttattatttaatatttactttttatttttatttttttggtgacagggtctcactgtggagctggctggaactgtgtatactaaggtggcctcgaacccacagaaatccacttgcttttaccttctaagtgctgggattaaaatcatgtaccccacacactgctattctttaaatttttaaaaaagatttattcattttatgcgtgagtacaccaccattactctcttgagacacaccagaaaagggcaccagaccccacaacagatggttgtgagccaccatgtcgttgctgggaattgaactcaggacctctggaagagcaagcagccagtgctcttaaccactgagccatctctccagccctattctttaatacccatcattatagtttaccgtgccagaggctgagcatagggcctcaggcatgacaggcaagcactctcctactaagtcatatacctccaagccttcaaatatgattgagaacaagttatattcacatagtagtgttctcaaagagcacatcacccccgcccaaaaaaaacccccagcagttggtgatacatgcctttgatcccagcacttgggagacagagacagatggatctctgtgagttccaggacaggcaatgctatacaaagagacccccatctcaacatagcagcatgtcctcaacaccttcaagtaactactgtgattaaatctgttcctgctagctggcagctttatcagggaatcgacttcacagctcatccaccttgactacaccaggctaagtagctttgtgatgactatacaggannnnnnnnnnnnnnnnnnnntaccttaaatatgtaagctgccaaatgtgggtggaattcagacaccccacccccaccccccccaccaggccttcccataccataacttaaaacaactctccttaatgcccaccgctcctggaatttccttcccatcaagtctctctctctctctctctctctctctctctctctctctctctctcagctttgggtgctgatcgatcatgaggaacccacaccatcacaagaaggcacagggatgtcttggcagtggtctctgtggcaagtgtacctactcattcccaatgatgagtgagctaagctctctccactggaagggtttgttttaatgagtgtagtctgcataaagcaatcggataagagattgcaaatctgctaagggcgagaagtcctccaaggtgaaccgcatgaggtctaacctaagcatacaaactttcccatgttactaagttatagagtatgacgtcagcttgatgcaagccccccccccccaatctggaaattctcatcaatctgagttatgagaagaaagcatgagcctgtgaaggggcacaggccagggtgaggcacacagagcaagatgctccaatgctgccttcacggttttaaacaaggaattgattgttcgccctgattacctctggggagtgggagtcagagtgactttcagttttgtattttatgtactttagtatagtctgaacttttataaagagcatccgcttttatcattgaaaaggtatttccactttgagaaaaacaggcataaataacttaacagactcacataaaaagatgaatgaacagcaaagcattttcattattttatcaccagaggcactaccacaagaaactatcaaaaaatacttcagagacctaagtgaacttcaagcacatgttttacatatttaaccctcccaagacaagagactgcagcctaaaaacatttatttttctgcattctaacacaactcccctccccttttaggcaaagtctgtgacctgtctagagaagaacaggcctttaaaaaaataaaataaaaaagaaggcagtgggctggtgagatggctcagtgggtaagagcacccgactgctcttccgaaggtccgaagttcaaatcccagcaaccacatggtggctcacaaccatccataacgagatctgacgccctcttctggagtgtctgaagacagctacagtgtacttacatataataaataaataaatctttaaaaaaaaaaaaaaaaaaaaaaaaaaaaaaaaaggcggtaacatttttttcctgaatggtgttacaaggaacactgggcactttgaaaaggcccccaattgtactgacaaaagtggagggaggagtgtggaggaatgaggaagcagaaggtacaaacatttggcagctactatgacatagaaacacacagtcctgagcaggactggcagcacaaacctgtaatcctagcactgtggctgcagaagcaggcacatccctcaagaggttgaggccagcttggtctacaagagtgagaccctgcttcacaaaaacaaaaaccccacaaggtcagaaggctggggtggaggtgcaggcccgttatcccaccactaggtgagaggttgaagcaggaggaccaaaagctaaggctggccccagaccaaacagtgagactctagctttaaaatacaaaacaaaacaaaacaaaaaaaccccataaaacagccgtcaaggtgatccatgcttttaatcctgacatccaggaggcagagacaggtgtatttctgcctttgaggctagcctggtctacagagtgagttccaggatagccagggatacactgaaaaacacttgtctggaaacaccaaaaaccaagttacaagatcaggaagctgtgctcgtggcctggttaaaatgggttctttcctgacaacgacacagcagcagtggtgcaaaccagcaggcataatgttaggaactggaagaacacagccagctggaaagactgctcaaccaggtctactcaacagcatgaaaactgaggctttgggtttttaaattttaatttctaatgatgtgtatgtatgtggggggaggggtgtgcacatgagtacaattgttctagagtccagagctccctggaaatgaagttacaggtagttgtgagctgcttgggatgggtgctgggagtcaaacttagttcttcttgaaggaaaggcaagtgcccttcacccctgaactatctctccagccctgagttttgttttttgaaaaaaaggtctcgctatgtatgccaggtccaggttagcctcaaactcttgatccaacctcttgaagtgctgggattatagacgtgcacaaccacaccctataaaacttgctgtcaacggagaaattctggtgttaaaatgagtgcaagtggctggaacacagcactgtaccgcagaacttctaagccttaacctttggaaaagcactgcactgcacctcggctgcgttaggtccgtctgtttctttaagaggaagaaaccccatgcagctaccaatgccactcagtattactgagactttaggggatagtgattcaaaagggaagttttacagttctaggcaactgaccatccatccatcatttgggcttcagcctcttgtaccttcattctttccatttctccagatcatatccatttgaggtgacaaaattccagagaacctattttataccttttaaaaaacatggttgctttaaaacagtcataagaactacatcgatttccccagtcgacttcagggtgcctcaaacttcggctcaagaaattctaagtggtcttggaaagcctcagaacaagcctatcaccccaaaatttaggatttcctgaggcaggagaattatatccaagcgatcctgggctacctagccagaccttgtctcaaaacggggtgggggtcggggggaaatgcttggaacgctttgtggattccagtgtcaaaggggaaaatgttgccgcagcgattcatactgtacggaaatacagtctgaccagtggagaatctacatgtaccgtcacagcgacattcgatttgggaacatgatcacacacatacaaaaccctatccccagaaaacaaggactttcattaacctgttctagacccgtccgagttggaaaatgtcttgtcaagccctcagatcacgtggacgagtggctaaggtggaaagggagcctgggagcggcggctgagcccagatccacgcctgcacgcttcagcagcaaggactccagatcgccacccaactagctcaccgcctccaccagaacttctacttgtaagcgcccaccactggaggcaaaaagcactttcttctcgggactcggggggcggggggggaggatctcgtacacagaaaaccccccaaacccccgagacctaccactttggacccgaacaaaaagcgtgtgtgctgaggagcgggggtgggaaagagcgaagcaggaatccgcgcggcccagccgcctcctccctcggagcgcgcccaagtctgcggcctccggctccgggacgctcccctcccaccggccgcccagccgcagctggaagttagcgaagcgcgctctgggcccgtcaatcaagcgcggcctcccgcctccacctcccctccccccacccccccagcacaaaataaaataaagggaaaagaagtaatttgggaagtcgtctggagaggggattcgtccggaacccggagaggccgcgcgcaccggactgacggccggccccgagcgaagccgctcggcagacccccgccaccggctcctcgccgcgcgctttccacgctccggctccccgcaccggtcggcgccgcctcggccacgcactccgccaggcccgtggcccagcttcggccaaagttgcgcaaatggccccgacgactggcagctactcaccgggcgcggtgggacgcgcggctgcggaggttttatggagttgagggcagcggagccgctgggaaggcgggcggaggcgaggggctgcgggctgcagttgacggcgcgcggcgctcggctgggctgcgccgaggacactccgggctctgccagggactgcgctgcaacaaaggacttccgctgccgcacagccgcgcctgccgcaccgcactgagccggccccgcttacgcggcgactccgggtctgcccaccagttcgcggcggcgtccgccagccttcccctccctctcgcccgcccacccactccgccgctggcggctaggggcacccgcggtcgcctgttggttgcaacaagtttctgcgtcgggccggggaggctggcactgcccgcagcgcgggcgcccgggcggcggcggctggagcagcactgtcgcccctctccccggagtcggcttggccctcctcctgtttgcacagctggacgccactgggatcctcccgactcccccagggctggatgccgatcgccctctacccagatgtcagacccctgtcccgcagggccccgcagttggacccgcccccgcgctccaccctggacgcctggaggggggggtgacactctcgtcccgtccagcctaaagcctgtccgctcggggtcctccgtgccccccgactcctcttcgcgtgggcccgccagcctcgggcctgagtcacttcccccgccatgccccgcccggcccgcctccctaccctggctcccgccgcatgtggctgcctgccccgcgccctcgtcccctcccgcgccagacgccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcgggaagccgcgcgagagcagcccgccgggtgcgtgagcgggcgcagccgcgtggtgtgcgccgcgcgggagcccgcccctcccgcacagagaagcccgcccgccagtccgccgccgcggcggagtctgggtaagcaacgcggccctgcccctgtgggctgctccgggctcagtccctcccgccgcgagccgcccgggcggcggctgcagctgcacccgtcgcgggacagatgcaagtagccggggagaggggtgctgtttttggtccgttggagatgtcagtcagggcccaaggaggacattagcaacggcgagcgagtgctgggcgcgcggagccgcccctggccgtgggccgccggggcctaacgcgggcgggatggcgcgcgcgattgccgcacagccttagagcccattcccgctgcgggccgggctccgagcgggcgcagaagcctcaatccgtctgtgtcagccgggtcctgggcggccgcgtcaggcctccaggctctagcaagtgggcgggtgtccagatcgggctgcgcagccctcactctcccctcccccatccagtttgtgagtacctagcatctagggcaagtagccccctaccctaataattaatttttctcttagcccagtggtttttcattttgaattctggcccccatcttatatcatcgtctccctagcactcatttggaggaatcaagccgttatcagttgcttaggtaacgcactgcgctgtacctggaacctgatagcagctagtgttgtgtgttttataaattaactcccatctccctctaagggattaaagttggccttcttcctcgagggactccagcaagtccttcaaaagctgcagagctgtcgattgacagaattgaagtacatcttagaatcagagtttttcagctgaaaaggaccttaaatatcgagtccatccctcatttcacagctaacacccggcctaagaagcagagtgttgcccgatcaaagtttctgcacctttcataattagcctcaggactgcagtgccagtttatcctgctttggacagtgtatactccagaagtgattaaaattacatcaggtttacaggacttctcaagttgatagcccaggctagtgtagaagtagcaatggatcttaggtcgggctctcactcgcaggaactaagagtgtatgccccctggtctggccacgtgtctcggccttaggtttaggcatcattcttgaagcaacctagatataggtacatagccactgcctgacttgggggtgggatgagtaggtgtgaaatagtcaagatggctgggattcagttagggagcaatgagacatcctgggtggtcagcaagaagacccccacctaccccaccacacactagactgtcatgcccagtactataataagctgtaaggagtttccagtcaggtttagttttgtgtgctaacctttgccggcagttttaataactgaattccctaaaagggtagtattgtcttgttataaatatgttttaagtcggcagaagtgagtgagccagagaggtatacctgactgtggtgacaagagtagttggcaaaggaatgtgagtctcaatcacttatcttccaagcctagtcagtgctctttcgcattacatcttgctccccaggaagggggtgagagaatcgcctgtggctgatttattggcgcctgtggttgctcagagaggccaggcaggactttcagctgccctctatgccttacaaagtggagctatgtacttccacccgatctcctgaggggaatgcaaaggagccaggctgtctagctgaggaggaggggcctgagcggcttggcagtaaaatctcctagcacgctgggaagtgcagcatagtgcctaacctaccgctgacccaaagtgatttattccctgcaagctgctggtggtatctgaccaatttgtccatttttgaagtaagagctaggaaagagttggcgaactgtcagagttcctatagaaaagcagtgcaggtgctcttattttgatgaattgtaaagtagccctacaccacttcctgtgccccctttctgcttgtttatcccacagagcaagtgcatctgagtccttagagaaagccaaaaagaaaatagttgatagtagttacctctaccagcgatggaattggatcctttgatctccacttcatgccagttagattcctcagccactgcttcttcctttagtctgtcgagatggctcatcagttgagagcgcttactgtgcatatagacaacccaggtttggcttccagcgcccatgtggctcttaacttgaaataactccagttcctggaaacggattccttctggtttccacaggctcctgcgtacatatggtatgcctgaattcatgcaagtacacatagaatatgttttgccaggcatagtagtgcacaccttttagatcccagtacttgggagacagagttcaaggccagtttggtctacatagtaagttccaggacagccagagctacatagtgagccctgtctcaccaccccactcactcacccacccccaaaagaaagtggaggaaaaagacagtactcaaagctaacatgaaatttcatgattagttcattttaattgtacttggttgtattctggggatcaaacctgccatcttgagaatgccagacaaagcctctactactgggctatattatatccccacccgttgttaggtttctgttctcattttattgggcctttttttcttctattaaattaaccttaagaaaagtgtatattattaaggttttgagattttgtaattaattgcttttgtagatacagatcaaaaccaatgtttaattctgaaacagcaggctttttaggcagagggtattatttagtctgtgctagaagtgtgttcatggagctgttattctctggcagagaagatggtagctcactcacacagcagctcagtcacttgcccgctgcactctgggtctcctctagttttgccctctttcactttccctggcctgtgaggacctcttttactcttgttagatgtagtctttagaataaatcaagaagactcttgtctctttcgtattaagttttttatttctaagttttattggcctagtgctttatcagacagacaggcacacacacacagaggatggaaaaggctgtctgcccacagaccagggctccagactatcctattgaagatttctagaatgtaactgccctttcctgtgtcatccatcacgtcttctctaacattgtctgtgaatgggttcctggcaggtttgatctgtgcctgtattttcagatttggcagttcctgtatcatttttagacattatggaaatcaatttaaaagggtctaagaataagtggttctttttcctagatacttttcaccagaaagtttggaaatggtgtggcccttcctggcctctaaccactctactagtgcattagtttagcacatttctgtttcttttctttgaggggtgtgtgtttgtgtgtgtggatctgaggtcagaggttgaccttgggtgtcttccttactgaaggtggggctcactgattcatgtaacctggctaagccagtgagctccagggatttgctttgggatgggggtgagtacagggagggcccttcccccaagtctcctgtttgttttctttttgagatagggttttctaagttcaggcctcaaacttctatgagctggaattacaggtatgcaacagtatgtctaattacttaaattccttaaaccacctaaaattgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggtcagactaggttattgtgggatctcgttctcacaaataaaaccagatcaacttgtcacacatccacaatcatcaaaaaataccattttacaaataccagctacacttgtgggaagccttttatcaggtagcactggagcccttttaacttgtgtatttctagccatgagtaagtagttcataaaagcttgacattcctctgccagctttcctatcttttactgataattgattataaagtccgttaaagatgcttacggtgtgagagaatgaagagctgagtattctaggctgttctgctgctgatctgagaatgcaagccaaccaaaaagagtttctaaacagtccaagatgttgaatatcatgctaactaaattataaacttgtttcatcttagtttgaactaatccagagctaatttactgcggatctagaaagtaaataacgcttttataatctcatagctatcaatactaagcctattataaatattacttgggggtgagggtgtggtgcttagatgggaaggatattatgatgatacaaataccttgtatacatgtatgaaattctcagaataaaatattaaaaatactaatttgataataaaaatgtttttaaagtttttaaactctttgcttttctaaataatgaagggtgattttttttttaattcttttctgcaacctactttacatctttttttttcctaccaaaaatcttttctgttaattttttttgtttggtttttattagataggctcaggccaaccagccttgaactcactctgtgtagccttggcttacattgaattttcagcaatcctcctgcttcagtttcacaagtgctaagactacaagtatatactaccatgtctgtcttccaaccagattttattattttatgtatatgggtgttttgccctcatgtatgtcttgttaccatatgtgtctttgaaaattggattggcagaagggttagcagtggttgtttctgtttttatggttttggtggcacagtgggtgactaaaactggggtaactgttgctagaagaaaaagggcagagcacacaacatgcagctggaaagtgggggagatgctcaacaaatggtttgttggggtgatgtgtaatactctgaatcttgtcatcactgagttggacatgtttaccacggcctccaaagagcacacctagagccaaaccccacaatcaaggagcagaacttggaagtgttaagttcagccaagttaattataaaaacaaaaacatcactgttggaggaatattactgcagagtctcttacgttattcacagcgtattttatgtgtatgagtgctttgcatgtatgtgtgtaccatgtgcatgcctggtatccatgaagtccagaggagcgcatctgagccccctggaactgaagttagaaaaggtggtgagtttctgtgtgggtcctgggagctgaacccaggtcttctacaagagcagttagctcttcaaccaccaagccatctcagcagcccctcatcataggctttagtatataaatgactagataggagaaaaaaaacaaagaccaggaggccatcaccctagtcaatgaagatcaatgaagtttgaccccacagtgacacaaaagttagtagaccaaagatgtaaaataaggctgtaagcaaataggaagtctcagcctggaaaaggcttccagtaaaaggaatgacaccaaggcctaggagggcatggtggccaggttggagttcagctccttcctgggaaattctgccacaagtacctgaagatggaggcgaggtatcatgttggagagatttgaagcgagaggttaaatagttttacacctgaaaataaaagatatggaatctcgccaggcagtggtggtacacgcctttaatcccagcacttgggaggcagaggcaggcaggtttctgagttggaggccagcctggtctacaaagtgagttccaggacagccagggctacacagagaaaccctgtcttgaaaaaccaaaaaaaacccctggaatctcatggagtgggtttaaccacttagagaaggcaggctctcaagagattctgaggatagataaatggaaactaaagaggaaggagttactgtgttcgaatgttccttacatagcttaatcctgttagtattttaggtcccctttccctttctgtatgaactgacttcgtagttcgtgagttaacggattccccaccctcagtccctccagctaactccctggttaatctggagtggcttctgcctctaagaggtctcaccttccacccagagctcttcctgaggtctccagcttcctcggggccccaccctgaccgtacctcctattttgttgcctctaccctgaaaggtcgtcttgaatcagaaagttggcctcagctacttccctgcacttgtaggacgtcacctgctctcctggtcacctgcgttccccctctcagggttctgcattttcctcaggtcccaggtttgcctgctttgttttattgtagcttttctggctttcaagttttcatacttacctttttttttttaagtactgaaaagtgaacccgggggctcatgaatgctagacaaatcctctaccattatctagacccttttttaaaagtttttatttatttattttttgacccaaagtctaagtttcccaaattagctcaagcttgcgctctatcccaggcaagccttgaatctctaacatgcagggcctggaagccagggtagctttgattacagcatgcatgtgccaccaggcccaacccatacttagcttttagagttttttgttttgttttgtttaatttggcttcgctgtatagctctacatatttagaaacttcagtcttgtcatttcagaggtctcctttggcattgatctttctagagctgtctccactcatcactagacatttctacttccttttcctggagtagacactttgaactcaccgtgtaagaagccgcctcctctaagccagttcctgtggctggctctagtgttttacctttaatatcaacggcaggaacatggcagttactgtgaaaatgtgcgctgaagaaataaatgacatcttctagcaacccactcgcctttagcttgcagcctgtggttgactgtgtcctgtctgccgccacatcgtgtcggttctgtgactggtggctctgtctagctctcccttcattccctgctgccattacgtggtttctagttgtctccttgattaaccgacctagagatgtactgtctaatacttactggacacttactacaggtcctcctatcaaatatatataccctcttgttacacacaaacacacacacacaacaccctcattaacaattctcactgtagtccaggctggccttaaattccaggccctcctgcctcagcctccagagtgcttcatctgacacctcaggaagaaattgccattatccacacttcataagtgctactgaggctcagggaattgagacagacctagttagtggctgcgctgaaactctaagaggttaggtttcctaaaagagtcttgctcttttccctgccactgagtgagtgactgccagtgctgttcctacacgagcatcttacatagctcactgcagacagcgggataccttcaggcacagcttggtgtactcttacacttagtctccttagcagctgagcttgtcctttccttctgtttactccttttcttttcccccctttatactgagttgaattctgatgacaaaatactcacagccctctcagtaaaattactccgttttatctgtctaagcctgttgaaaaccagtttgaatatcttattttcattgcttgctccgtgcttatctccaactgaacgttctagtagcacttgacacttttaatttgtaatgtagttattgtcttgtgttttaatctccttgctaagactgtattcttgacttgagcgtttatggttttttttttgtctgtaacttagtgtgacacatgcttttgatgtgtgtgcgtttcaatgagtatctgctgaggaaatgaaaagtttaactgctgctcagcccattaaccacaagatcttgtattgcagctttgggtgtgctgtttctcatttctgcctggctcagtagttggttatgtcagtgaatatatatataagctgtatttgaaaacctggtgaaaatacctaagatccaagaatttggagggtttttttttttttgaagcattttttaaaaaacagctgattttgggtattttacttggagccattttattgattctaaagtgtttttgtgtgctgaaacttcaaatataggtttttttaaaaatctccttgtctggtgatttttagaagcaagtgtggtgatgaaggtagtaacttttggtcaaatcacctcttagaataagaccctcagtttacagctttgttttgttttgttttaaagattaatttacttattttatatatgtgaatacactgttgctcttttcagacacaccagaagaggcatcagatcccattacagcagccaccatgtggttgctgggaactgaactcaggacctctgaaagagcagtcagtgctcttcactgccgagccatctctccagccctgcagctttatttcagaggataggctcaagtttctatagctcccattcagttatttcagtgatgctgaaagtttttgggggtttttttttttgttttttttttttttggtttggtttggttttttgttttttcgagacagggtttctctatgttgccctggctgtcctgaaactcactctgtagaccagggtggcctcgaactcagaaatctgccttccaagggctgggattaaaggccacttcctggcaagttttttgtttttttgacatgaggaagggtcagcaagatggctcagcatataaagaaaggcacctgccattcaaggctgagggcttgagcttgagccctggaacctttatagtagagagaaccagttgacacagcattgtgctctgaccttcgcatgcacaccctggtgtacacacacacacatacaatgataaatgtttaaggtgataggaccagtgagacaacttggcagtaagggtatttactgctaagcccaacaacctgactttgaacccctggacctacacgtggtaggattatagaaccatgacacatctgcgagctgtcatattatctccccatgtgtgccatggcatacttgtacccagacacacacgcacacacaatgttaaaaattcttgtagtttatttttgtttgcatatgtgtatgtacgtgagtgggtacagggaggccagaagctgtaggtaaaggcattttgcaagatacctgattggttatatcagtgttgggatctgaaacctgatccaacaacaaggaggcttttttgtttgtttggtttttgttttggggaataaaaacaaccttttttttttttttttttttttttggttttatgagacagggtttctctgtatagccctggctgtcctggaactcactctgtagaccaggctggcctcgaactcagaaatccacctgcctctgcctcccgagtgctgggattaaaggcgtgtgccaccacgcccggctaattaatggaattcttgaagttaattatttataaagaataaaacttgtaaacaatactatcctttggtcaaagatatggtcctacacaggcagaatgtgatgatatataagaaagtcaaaagtggggctggtgagatggctcagtgggtaagagtacctgactgctcttccgaaggtctggagttcaaatcccagcaaccacatggtggctcacaaccatccgtaaggaaatctgactccctcttctggtgtgtctgaagacagctacagtgtacttacatataataataaataaatctttaaaaaaaaagaaagtcaaatatgggactggagagatggctcagtggttaagagcactgaccattcttccagaagtcctgagttcaattcccagcaaccacaaggtggcttacaaccatctgtaatggtatctgatgtcctcttctcgtgtctctgaagagagtgacagtgtactcctatacataaaataaatacatttaaaaaaaagagaaagtcaaaaacaggaaattcaggatggcggttatgtttggaggtaaggtaggtggaggtgaagtgagagccgtgtcaagggatttcttccatggatataatgattatttcctgtgttgatagtgtgtaggtaggcttatattttatttttattgttttttttaagagatttatttatgtatgtgagtacactgtagctgtatagatggttgtgagccttcatgtggttgttggaaattgaattttaggacctctgctcactctggcccaaagatttatttattcataagtacactgtagctgacttaagacgcaccagaagagggtgtcagatctcataacgggtggttgtgagccaccaccacatggttgctgggatttgagctcatcatctttggaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaactgtttataattttgagttcagatagtatagtcccccctttcatctctactccttagtttctttctcagagttattaaagaatgaaaagcctgctgttgtatctgaccctttccagtgatatatacacagacaggaagttatttatgtaaaatgttttctctcgtgttgaaaagtaaaataacaattcagtttcttttgcatagttttctttatgtagttttatattctgtctcttcttatgtctttgagataatgttgcattaatatattatgtagtttttaataaaacaggttcttttgtcaatggtagtgtcattatgctctattttagactttatttccatatatattttgttgttgtttatcatctgcttaaccagcaggacatccaggtctctccctgacccctctgtgttaattctccttaagcttcctgtggagttcatctgtagctcctctcagtgctctccggtttgtgggtcatgtttcctttgagggactgtgggggaggcagagttggcctttggagcttaggtttgaatgctgcttctacctcttactagcagtgtaatcttgggtgttcgtcattcagtcctgagttgtaaagggaaccaaatattcctttgcttagaaagtcctgttaataatggaatgggtcggggctggagagatggctcagtggttaagagcactgactgctcttccagaggttctgagttcaaatcctagcaaccacatggtagctcacaaccatctgtaacaagatctgactcattcgggggtgtctgaagacagctacagtgtacttatatataataataaataaaataaaaaaaaagaatggaatgggttaaagtgcctaatctaggaagcactgtaatgggttagctctctttattctatcatcagttgctcacctgtctgctaccgatgttcctgctaatctcctaatggttataccagcctccatcactgacctcctcagaccttagtctctctggccatggtagaagcctcattctcactttcagaatctgctctttcaaaggctgttctcccggttccctagtgtcttaggacttcattgctgtgagaggcaccacgaccaaggcaactcttaaaaaggaaagtatttaactggggctggcttacagtttcagaggttcagtccattatcatcatggcaggaagcatggcagcatctaggcagatggtgctggaggaggagctgagagttctacatgttgatccaaaagcagccaggaggaggttctgattccgcacaaggtggagcttgagcataggagaactcaaagcccacctacacagtgatgcacttcctccaacaaggccacacctccctatgaccaagcattgaaacacatgaatctgtgggggccaagcatatccaaactgccatacttatgataccccttgaattgcaactgccctctccccaaagtaccagggctcttgcacagctaggacagaggtggtggtgaagattagcctcccacctgcctgaaactgtgactttcctgtgtctttgttgtttagacacagttactgtcttggtcaggacttgcttgcatagcctcatgcaggaatcttccccttgaggctcatttgccatatcttccttttcttaccacagagaatctgcatccggacgcgtatgaaatcaggttgtaggttctttctcatgagctcccaggccccatataaatcgggatatggcttgacatctgtgactgctaagttttatgacagtcaggaggccagtgtctcctgaatgccagaggatctcagaaggaagtggacagttgtagtccaggcaggctgcccatcaggctggagagatagctgaggctcacagccaggtaggatgccctgctattattctattattcccacttagaggagacatttaaatagcattttccattacaacccagttttcactaagttatctcacgtaactctgagccccactgcagtattccacttcatctctccagttaagaaacagcactagagccgggcgtggtggcgcatgcctttaatcccagcacttgggaggcagaggcaggcggatttctgagttcgaggccagcctggtctacaaagtgagttccaggacagccagagctacacagagaaaccctgtctcaaaaaaccaaaaaacaaacaaacaaacaaacaaagaaacagcactagagcagggcagtggtggcgcacttgggaggcagaggcaggtggatttctgagttcaaggccagcctggtctacagagtgagttccaggatagccaggactgcatagagaaactctgtctcaaaaaacggaaaaaaaaaaaaaaagaaagaaaaaaaaaagaaacagcactagaaatgtggtcacaagatgggggtggagctcagaagtagagtgcttacctggtgtagacgaagccccaatcattaagccataaggagagtaggagtggggtttgcctagcatgtgtaagacacacacacacacacacacacacacacacacacacacacacacacgaaagcaaaacatgatcacattgaaagcataagcatttctctcacccatacaaattaccctcttccttgcttaaaagactgtcttattgttcagaagagttcatctcagttgtcataattaaggggtttaatgttagagagtgaagtccacagtgttgagtattttcatttaaaatgagaccttaatgctctaggtttgtgtgaactataaccagttgtatgtataagtatgtatatttgtatgtgtgtgtgtgtatgtgtgtatgtatataaacatctgtgtatcccaaacatatgtatctatgttggtttttctcagagccgccatggatactgctagccatagccttgtgcttctgcagcagctgaacatgcagcgagaattcggctttctgtgtgactgcacagttgctattggggatgtttacttcaaagcccacagagcagtgcttgctgccttttctaactacttcaagatgatttttattcaccaaacaaggtaagaaggggcttttgtaaatgataatttttttaatatttacaattatatcatttaaggcagtggttactcaaccttcctaatgctgagaccctttaatatagttcctcatgttgtggtaacctccaaccataaaattatttcgttgctatttcataaccataactttgctgttatgaatcgtaatataaatatctgatatgcagggtatctgatagttgaccccgtgaaaggattttttgaccctagaggggttgcaacccacaggttgagaatcaatgtttaagggcttattattgggttatcctaatacaaatttttaattataatatatatacacacacacatatcagtattaaactcagtacatggtatccatggtaaaacatacttaataaaaacaggtataactcaaattgattaaaggcttagcccagtccagtgtggggctgtattcctttaatcttatcactcaggtagcagaggcaaggggatctcttaagtttaaggccagcttgtctacattgtgagttctaggctaaccaaagctgcctaatgagatcctgtctcaaaaaacccactaccaacaaaaaaggcttagccaatacccaaacatgaagtcctataatgtaagttccactgttatgctggtggtagctgaaaaaaggcagctgagactgagctgttaaatggcccatccaggagtaaatagctgatgggttgggctcaagtgtaagtctgaagttaacctgtgtgcttaagcactgggctgttgatactggtgtaacatcatttcagtgtcacattgtcccatcacagatggacatcaccagtcagagtgtttatttcacattttctgtttttgtgttcttttgcattttttgaattttggtagtatgggaattcaaattctgagctcttggaaagattaattttagtctagtctatgtttagacagttctagactattgcttactcgcttgcttgcttgcttgcttgcttgcttgcttatttatttatttatttatttatttatttataaattttgccatagagtcttactgagttgcccaggctgcccttgaactcactctgtagcccaggaggaccttgaacttgtgatcttcctgcctcagccttctgagtagctagagccatagcccaagccaccaggcttggtaccctgtatatttagtgggttgttgggtttttttttttttttttgcttttaaaggaccttacataaaattgaggtatcaaatcccagttatatatattttatttaactgttcaatcatttaaatattttctctctctctctctctgtgtgtgtgtgtgtgtgtgtagattttcaagaaatctatagtctgatagagaattaaatgtaaagcaaataattgatgtgtcttgtgttagaccctccctggtgctgtgacagatgcctaagaaaacaaggatgtgttgtgcttgcagcctcaggctttagtgcacttgcagctgcctggcgcccatgactttaacactgggaaggcagaggtaccatgaaagaaggcgtaacaggaaagctacgcactttgtagtaggcaggcactttgtggtatgcagtgatgaccgggactagataagcagccctggcatgagcggctcttcttccactcttcttccaccttggccccatctcccagtgtctcccacctccaagtaattcaggcacatgacattgtgactctgtgagtggagactacaccggtgaagccagagtcctcgtgacctagtcacttccccagagcccatcagctggccaccaaggctgtaagactgtacacctaagctttcaggggatagtgcatgttcaagccctaacactttgagttttcttgtctgttaaatgctgcaataatacactctccttctgggtattaaaagagttcagtggattagtgacattaaagtgtttagagcagagctttgtcgttagtaagatggtgtcaaacatcaggtgtacacaaagtagaagacttctagcaggcctgttttcagaattttgaaacagactttacaaatctgaaaaatgaagagtctttcagatgttgcagaggaatataaggaggggtattaaaataataaggaggggaaatagcatggatcacgatttggtccataatatttatgtatcactgttaaactcagttcatggtatccatcgtagagcatactaataaaaacaaatataactaagattaattaaaggcttagcccagccaggtgtggtagctaatgtttatattcctagcattttaggtacagagacaggagaatcactgtgagtttgggtccagcctgtactatactgcagtaccaggcctggactacatattaaaactctgtcttagaaaaagaaaaaagaaagaaagaagttgtcttagggttttactgctgtgaacagacaccatgaccatggcaactcttttaaggacatttttttgtttgtttttttgagacagggtttctctgtgtaaccctggctgtcctggaactcactctgtggaccaggctggcctggaactcagaaatctgcctgcctctgcttcccaagtgctgggattaaaggcgtgcaccaccactgcccggtataaggacaatatttaattggggctggcttacaggttcagaggttctgttcattatcatcaaggtgggaacatggcagcatccagtcaggcatgttgtaggaggagctgagagttctgcatcttcatctgaaagctgctagcagaatactgacttccaggcagctaggatgagggtcttaaagcccacacccacagtgacacacctattccaacaaggccacctagtgccacttcctaagccaagcatatacaaaccgtcacagaagcaaaggtgatataaaatgatataaaaatgatataaaatgatcattcagacaacagagtagataagatggctagaaagtgtggcacagtacaaagatgaggttggagtgaaatcctgctagaggtgttttgtctctgatgtgacaccgtagattacactcaccacattataaatgctatcttccacccagtctgctctgagctgtgagttgtttagcttctaaagcaccatctaaacacaggcattgaaggagttagagagacaagagtgtggagcagagactgaaggaatgaccagctggagactgccccacctggggattcatcccatatctaatcaccaaatgcaatcacttttgtggatgccatcaagtgcttactgacagaagcctgttatagctgtctccggagaggctccaccaatgcctgacaaatacagcggtggatcctcacagcctaacattggactgagcacagggtccccaatgaaggagctagataaagtacccaaggagctgaaggggtttgcagccccataggaggaacaacaatatgaactaaccagtaccccccagagctcccagggactaaaccatcagtcaaggaagacacatggtgggactcgtgtctctagctgtatatgtagcagaggatggcctagtcagtcatcaatgggaggagaggcccttggtcctgtgaaggctggatgccccaggtagggaatgcagggccaggaagcaggagtgggtgggttggtgagcagggggagaggggaggggatagggggttttcagaggggaaaccaggaaaaggaacatttgaaatgtaaataaatacctaatgaggtgaggcctgccttgtgttgtgtttgtattgatcaaacatctttaggtaacagaatttacacccccagaatgcatgtcatagaacatgctggtgagtagacagagtggatcaaagagtgaaacctgagagaggaagcagggatgtcaggaatgaaggactagagaaactagattgtcaatatcctggctcccagaataaactgcttcaggggaacagtgcaccgacgctgcccaccgtttcttcaagtgcatcatctccctttggtgcgcctgctcttaagttcactgacttctgccttgttatgctatctagtaaccatattgcctttgaaattcctaggatgcttttcaaaattatacttgtatttacttgtgagttaaagatttagaaccaaaacgtttcatttacattttaaacattaacagtttcattatatacctttaaaaatatgaatattttgttggtttggtttgcttttggttgtttgattgtcattttgttttttagtttttaagattttttatgtgtatgagtgttttgtctgcatgatgtgagctgttatatgggtgctggaaactgaagccaggtcctctgccagagcagtgagtgctcttaagcactgagacatctctctaggcccctggttttggttttcggaggagggtctctataattaacactttaaaatcatccagctaaatggcagtaattacattcatatgccttgtatatgggtgtgtggcctgaatgatgtctgtgttccacctgcatgcctggtgcgcactaagccaaaagagggcatctggtcccctggaactggagtcacaaacgattgtgaggcaccatatgggtgctgggaatcaaaaccaggtcttctagaagaacagcaaatatttttaaccactgagccctttgtccagcccagttctgtgtctttgtaagtgttgtcttagatgtttcttcttttgctggttttggtttttttcagagagggttttctttatccctgactgtccatgagtgctgggactaatggcccggttctgatttagatatttcatgaatgtggtaccatacaattttgggccttttgtgtcttttcttttcttttttcttttttcttttttttttacttagtatgttttcaagagttcaaagttataacccatcccagaagttccttgtccttggcaggatggcgtgcgtcatgtttttacagcctgctttgctaacccattgtttttctcttcctctctttttttcttttattatttcttttttgggacagggtctgtctatgtagctctggctgttctggaactctctatttagaccaggctggcctcaaattcaaagagattcacctgcctcagcctcccaagtgcttggattaaaggctgcaccacaacacctgactccattcatctttgatgggtatttagttgttcccagcttttagctactgtaaataatggtatcgtgaacaccagtgtacaggcatcctttccagtttctgtgttagttgctttcactgtatgttcagtgtaaacgcagagcactattttagtcactagtctctatcctcttgtacctagagtagtctgtactgcttaggagtcacctggtggtgaactagtctgagcatctctgcgtttcctgctgttaggcagcaggttggacacacaaagccttgttgatgaaccataaaagcagttaaattcgaagactgatttttcctgttgtgtttcatcaaggcagattgccaggtttaaacctctaggggagaatttgttttaacctaagattgttagaaaccaaaaggccaactagattgtatttcattttgtttgggtttgtttttgttttaacagtgaatgcataaaaatacaaccagctgacatccagcccgatatattcagctacttgttgcatattatgtacacaggaaaagggccaaaacagattgtggatcatagtcgtttggaggaagggatccgatttcttcacgctgactacctttctcacattgcaactgaaatgaatcaagtgttctcaccagagactgtgcagacatctaatttgtatggtattcagatttcaacaacccagaaaacagctgtcaaacaagggctggagatcaaagaaactcctcccagtagcagtggaaacagagctgctgtcccaggtgaccacccccagctgcagctctctctggcaattgggctagatgatggcagcggtgcggagcagcagaggacccatcctgctgcccaggccgtggaggagcaccagaagcccccagtgtccatcaagcaggagagatgtgatccagagtctgtgatctcccaaagccactcctcatcctcatcagaggtgactggcccctcttttacagaaaacagtatcaaagtccacttatgccattactgtggggagcgctttgaatcccgaagtaacctgagacaacacctccatacccacgtgtccagatctctcccgttcggtgtccctgcttccattttggaaagtaatgaccttggtgaagtgcatccacttagtgacagcagtgaggctcttgaatgccggaggctcagctccttcattgtcaaggagaatgagcagcagcagccatcacctgagcactcgagccgaggcacctcagagcctttgcagattagtcaagtatctttgatctccaaagacacagagccagtagaattaaactgtaatttttctttttcaaggaaaagaaaaatcagttgtaccatctgtggtcataaatttcttcgaaagagccagttactggaacacatgtatacacacaaaggtaaatcctacagatataaccgttgccaaaggtttggaaactcattggcccagaggtttcagcagtattgtgacagctggcccgatgtccccttaaaaagctctcgcttgtcacaagaacatttagacttgccttgtgccttagagtcagagctcacacaagcgggtgtggacaccatcctcgttgagtagcagcttctcgggcagaacttttatactgatcttggaggagatttacacgccatttctaatcataaattagttagttagctcctcatggtcttttgacttaaaatattatctgttgtgtgttttgaggttgaacaaaccagttctcattataagacatggctattaaacataactttcaaattatcctatgagcttttctatacattaaatcataatttgaaaatcagaagttaatgtagaaactttaagagtgagtgattatttataaaatctcttgtttttccaggttgcagaatcagtaaaatgaacttgactatgaagcagatgagatctgttttagagaatattttagagactgggattgaagctcatctgtagagtacttgcctagtgtgtgtgaggccctagggttcagtgtccagcatacactcacatgcacacacacagatacacttctaaactgtcacttgtcttaggtttcatgtgaattatgctcttaggaaaatgattttttaaatattttcagccatataggaaatcaatcattttaatgtataaatatatgtatggggatatatatatatatatatatatatatatatatatatatatatacatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatacacacacacacacacatatatatatatgaagtaagtagttactttaatgtataactatactattataatgtataaaaagtttgttttgttttaagacatggctataccaaatcacaagtagttttaactgtacttactagcattccaacctcttatatggccttttatttattagccatcaagtatacctcatttttaataaatattttagctaaaaggaaggactggagaagtcagtagtgaagaaggcttgagcagagaaacagtgcattcacgtaagtggtcatacaggtctgtgtgagccaaccttgtgcggataggcagatctccagtgtgctcttggacaccttcaggtgtttatagcaagaggatcacctaagtttgaagaggaaaatggtaagatacgtatcatctccctgacttaatgttgcagacttattaaggctgcctgggttgatgatagtttttttttctaaaagtcactcataagggtgatttgacaatggtgtagctttcgcttttctgttagtaaaagcagtggagtggatgcactgagcattccagacctacttaaaacccatgccggcagctctccttctgtgaatatactcacttcccttttatagtggcgacacttagaaacttacaactccaggaaaatggaagatgttggactaagtgatgaattttctgtacctaacaagtagcttagcaaatttcattgtttccaaagggttatttcaacttgaagttctgttctcaagaatcaaaaggcaagagagactgtagaacagcaccccaccaccaccctattgaagtctcagctcacagacatttgaagagcatttgagttggtcctgccacacacacactctcagccttgctatgtcaccaggttggccttaaaatcttgagcacaagcagtcttcttcagcttcccaggcggccagtaccatggggtacgtgccatttcacaccatggggtatgtgccatctcacaccatggggtatatgccatctcacaccatggggtatgtgccatctcacagacacctcggtgtgtatagccagttaattctgaccccactcccatacctctgaagacatttaagaggttctcctgcccccgggcgtggtggcacacgccttaatcccagcgcttgggaggcagaggcaggtggatttctgagtttgaggccagcctggtctacaaagtgagttccaggacagccagggctacacagagaaatcctgtctcataaaaccaaaaaaaaaaaaaaaaaaaaaaaaccgattgtttttattcccccacccccatccccctctggatgaatggtgagttaggttacatgacagagttccagagatggtggcatggactctaatcccagaatttgtgaggctgatctctgagttcaaggccagcctggtttatatagtgagttccagaccagttagagtgacatagttagaccctgtctcaaacaaacaaaacagcacacacacagataccacaccaacctgaagtagtagcttcattgttttgtttgtaagtttttgagatagtcttgctatttggcccaggctagacttgaacgcaccgttgtcttcccatccggccttcagagtggtaacttttaaaggccaagtgaagaaccctactgggcactgttttaaggtaactgagtttctgatttagagttagcgtctgagatcaagactgatgatgtgttttaagaacagaacatagctagtggtagaatggattgtattggggtggttaacaaatgtgctgtttaggggtcataactgcatggtatcttacacttaagtcatcacagcaatcactcggttacttgagtgacttgatcatacagaagcacagatactgaccatgtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgctctaaaatggttagtgtgctgatggaaaccaacagcaggaagcggttccacggctagcccggttcagtattccatctggtagattctagaacatgcttgcagccctacttaatagataattagttgagaaaattagtttttattgaaaatgcgccagaaatgggagtgctacttgagttcttactcttctgaactgtttgtatcgttcatcaaggaagataggatttagcattagtggaagtaaaatacacctatttcagcattaaggaaacttccctccaaatacattattttctttttttttttttttttttaaagatttatttatttatttattatatgtaagtacactgtagctgtcctcagacactccagaagagggcgtcagatctcgttacggatggttgtgagccaccatgtggttgctgggatttgaacttcggaccttcggaagagcagtcgggtgctcttacccactgagccatctcaccagccccattattttcatataagaaaaggaacaaagaaaataaatatcccattgcttcttggatgaagaccatctaagtaataaatagggacgggagatggaataaggattatccgtaggaactcactaatgttctttggaagtaaaactggaccgctttctctgaccactgaagggaataactgctatcatgggaggaaaacaagctgcgaagcggacagcgaataaagcctgtttgcaccggctaattcttgatactgaaccttggattcctgtgaatacttgacagggatctttgtggtatctgtgctaaaaatagttcatgtgggaaatttttacaatgtaacttgtgtcttttagtgtacttaaactaaatatgtctgtggcgtttcattaagaagttgttatgttccaaggagtgaactctgtaaacatttctatgctcaaccatgcttgtgtaaccgctctctctttaatctggtatgtcacagtcctgaatgtgatgtcttaaatgcaagtgtcccacactggctctccttctagattggatgaaaccctggtgtgtgtgtgtgtgtgtgtgtgtgtgtgtgtgtgttcccccaattccttaggttgtccttcagcacagctgccatcggctccttgcagtcactgcaacagagaaggtcagaggacagccctcggccagcattcaggaagctgatacagtacgattgagtttaaggccacgcttaactgagtcttaaaaaaataaaacaagagtctggaaagatggctcagtggttaagagcactggctgctcttctacaacctcagatttgttctcagcccctctgtcaggcagcttataactacctggcactctagttccgggaggacctagttctcctctgatctctgaggtacctgcacttgtgcgtgccagacccatgcacagatgccaatggttaaaactaagccccagctgggcgtggtggcgcacacctttaatcccagcacttgggaggcagaggcaggcagatttctgagttcgaggccagcctggtctgcagagtgagttccaggacagccagggctatacagagaaaccctgtctcaaaaaaccaaaaaaaaaaaaaaaaaaaaaaaaaaacctaagccccaatcaaacctaagaacttagataatagaaaggcctaatgagggaatggccaggctctcaggcacgcatagcaaatgtagggtaatacacggtagagttatacttccatgtggtatgctacaaatggcttcaggaatattctacagagttttgtatcccagtttggaaactggctttcatctgttttatgaagatataatatgacttgattcgatgtaacaaaatattagcttgcagacctgatcttactttatagcattttctgtcaatgttacctttgttgaggtaagtggtctttgctaggtaactttaaaaaaaattttttttaaatatctgtatttttcctgcacatatgtatttgcatcatatgggttcctgaggccagtggaggccagagaggttggtctgacctagaaatggaagtgcaggtagctatgagccactgtgtataggctggaaactgaatttgggtcctctgaaagagcatgggatgctcttaaccaccaagccatttctccagccactattgttttttgatttttgtttttgtttttcgagacagggtttctctgtgtagtcctggctgttctggaactcactttgtagaccaggctggcctcaaactcagaaatccacctgcctctgcctcccgagtaagtgctaggatcaaaggcgtgcaccaccactgcccagctctctccagctgatcttacattgggcgtgatgcaaaaggtatgaatggacttgattcttgccaaccacagcctgtggcaagagagtgctgtcctaatccagaaagaaagctctagtcatttctcaggggggtcttggtttgcttttactctctgctttttactctattcttctgtccccagcaacctgatctacagcagtgcttcttagggtatgttaggatcttcagagaaaaagaagaaaaggaagaaataggcaagtagataacgtcacactgtcctatggctggtgtggtagtacacacttgaaatccagacacttggggacaatgacaagaacaactctttgagtgttcgagaaaagccaggtttccttatcgagtgctaagccatttggggctttatagtaaaaccctatctccacaaacaaacaaaatgagcaaatatgaccttgattcatacctttatagagacaggattatgaagagctgcactctgcaagctgagtgcctggaactaaatgatgtaattgcgttctgagtccaaaaaagacataactggaagagctattgaacaaattccagtccaaaagctggcagacccagaaagatcgtatgcttgcatttttgcccaaagttaggaaaagatggctctctcgggcaagggaaggccagatttctgtgcaggcctttggctaaatgaaagcagtctattttatcccacacttgtaattctactgctactctaattcccaaataaccaccgccaaagccagacgtgatggctgacatagtgagttgcagtgagctagctgaagtggggagaccatccatcagcttacacggagaccagcctgaccaaggagaccttgtctcaaaaacaaaaccaaacgccccttgacatacacccagagtcggggatgggaatggagctcagtagagttcttgcttggcacaacaaggccttgagtttcatcctgcaaaataatgtatacataaaagtatatcgcatagctcagtcaacacaaaattgacagtaaaaactaccttcaccatgtggatgatcaataatgtggagatatttggggtaattatgcctgggtggagcatgataaagttgctactggcatctagtgagtagagaccaaggaggttggtaagcgcgtcataataaaagtatctccattcctaccctactctggactgctcgaggtgtcagtggagttgaggttgactagctcttgtctaaaaaactaagtcttgtgatagtgcataaggacatagaagttcgggattcctatctagtccgtttggatctagtggaatgtatgatgtctttgtccaaagtcagttctatttatattatccttttagaaatcttaaattggattatttaaagtcagagctgcagaaatggcttagtaggtagcatgtcacttatacaagcatcagggcccatataaagcccgtgcctgccgttggacacgcctagaaccacattgtgtggtgaaaatgggatggacagcaaggtataaagatggagaactgtgggggaaagacccacgcgcagccccgtgtgcacatgcacccactcacactaacaagtacagagacaacactctacaaacacaagtaaactaaaatcagatatagtcatcaacagactgctcaaactttaacatccttgaaaaacaaaaacccagccatcttgttctgtagctcaatcctttcacctcagccccccaagttgtggatgatagatatatactgccattttcaggtcaagacaactaagcctattagtaatgttgaatcaattgtatttctaaagtctggcaaaagaaaaagatgattgtagtttataatttgtgtggattttaatttggccaaaagatggcgccagcgtaccgtagaaatgtatgttctgctgtgttaggacctgactctccagctccttttgtattttagtagcttcgttaggaccttctcttcccttgcagtctgttcagtgttaggtaatagtgtcttgacatcccctctgtgcatctgacttataagaagagcatcagcagagaacagcacacttgatagttgtactattgaacaagtttgaggatttttcaaagtcattaactccaataacattgaccctccttttcatatatcaaactcaattaatgttttctctggccaagagctaaatggagacattcaagaaaatcataacttgcttagacccccccctccatctttttattggcatatattcattgcactcagtgttgggtattataaagtcaatttcaagtcagttgtgtgctttagccatagccaagccctcctacttccttccttggtcccttctctcacccacttgtctcctgaagtctcccttttaatttcttcttgttttagcttttggttttatttgtttatttttgagacaagctctctctgttatgttgctctggctattctggacttatgtagaccaggctggcttcaaactcacaaagatctccattcccccgcctcccacatgctgacattaaaggtgtgtgccaccacgcccagttctcctttcttttgtcatgtatgtgtatatgcatgagacaggaagtgaacaaaagcatgtattttctttctgcatccatcttgtttttcttagtataatctccagctacatccatttttatagcaaatgactcattcttctggctgaatgaaactttgttgtgtatgtatacattttttattgatggaaacctaggttattatgaattctgctgtagtaaacatggatgtggaagtatctctgtggcatgatgtagaattgttcaggtatatttccatatagtggtactgctagcaaacaataccaggaattgataggtgggaatgcatgggacttaaaagctcctaaacagcccaggcatagagtctcatccctttatcccagcatttgggaagcagaggcaggagggtttatgactttgaggccagactggtctagggagtgaattccaggacagccagggctacatagagagacccagtctcaaaagcagaaggggggagggagctgctcctttggtaaagaaaaagagtaaatggcagtccatggaaggaagaaaccattgccagctgtgcatctgacagaattactgtcaatatgtaaataagtaaaaaagctaaacacacacacacacacacaagcaatcctgtcactaaacggaccaatggaaaaacagctagttctcagaagataaagtacaaatggctcagcatccttagccaccactggagacgctgaataaaggcacactgagattcctcttcccagctgtcagaatggctacatcaagaaaacaagccgaggcacaggaagcctcttgaaccagtgggtgcatagactgatagcatcattggaaatcagcgtggagcgtcctcaagctagaacaggctgcctcacgtgcatctcccctttccttccctttgtcacctgtttgcctttcaaaaccacagtcccacgaactacaaggaggctcttagatgacctccttccccacttctacctgggtccctctttaaacagacttctcacctctcatagtccgcctttttcagtgcctggacttgtcggttctcactgtcattgcgagtattctcctaggacttttcctgagtgtttaagtttctgtacagccgagccctctttgagaaatgaccccattttctctcagataaattgtctcctagcttacacaaaccttttccagctgaaacagtttggtaattctgtatcaaaataacagaaacaaagtatccctcaagctctccgtcccatggtgccccctcttgctggaaacctgatggaggattcctgtatacgcttagtcccttggagggctaagcagccaggtaggcctcacatctgtggctgcctgctatttgactttcaggaaggtccagagaagaagatcttcgtgggcctcataagcctttgaagaagggaaacttgcgaattcaactctaccacatttttctatgctaaaagctgtatagagtccaaattccatgtagattaaagttatgaatgtaaaggaaattttccttaatgcacaccaaagccttggaaggcgggggaaaacttaaaattcttattactgggccaattttgccctccagcaccctccgcccccacaagtctgtagtctccagtgctcttagggagtgcttccggattcatttgtttgtttgcttgtttgtttctcttgatctcccagttcttgggtctccatgccttgggagtacaaggataacaggtagacatcgccatacccagat

SEQ ID NO: 2 - DNA, 1586 bp, Mus musculus
tgtgcgccgcgcgggagcccgcccctcccgcacagagaagcccgcccgccagtccgccgccgcggcggagtctggagccgccatggatactgctagccatagccttgtgcttctgcagcagctgaacatgcagcgagaattcggctttctgtgtgactgcacagttgctattggggatgtttacttcaaagcccacagagcagtgcttgctgccttttctaactacttcaagatgatttttattcaccaaacaagtgaatgcataaaaatacaaccagctgacatccagcccgatatattcagctacttgttgcatattatgtacacaggaaaagggccaaaacagattgtggatcatagtcgtttggaggaagggatccgatttcttcacgctgactacctttctcacattgcaactgaaatgaatcaagtgttctcaccagagactgtgcagacatctaatttgtatggtattcagatttcaacaacccagaaaacagctgtcaaacaagggctggagatcaaagaaactcctcccagtagcagtggaaacagagctgctgtcccaggtgaccacccccagctgcagctctctctggcaattgggctagatgatggcagcggtgcggagcagcagaggacccatcctgctgcccaggccgtggaggagcaccagaagcccccagtgtccatcaagcaggagagatgtgatccagagtctgtgatctcccaaagccactcctcatcctcatcagaggtgactggcccctcttttacagaaaacagtatcaaagtccacttatgccattactgtggggagcgctttgaatcccgaagtaacctgagacaacacctccatacccacgtgtccagatctctcccgttcggtgtccctgcttccattttggaaagtaatgaccttggtgaagtgcatccacttagtgacagcagtgaggctcttgaatgccggaggctcagctccttcattgtcaaggagaatgagcagcagcagccatcacctgagcactcgagccgaggcacctcagagcctttgcagattagtcaagtatctttgatctccaaagacacagagccagtagaattaaactgtaatttttctttttcaaggaaaagaaaaatcagttgtaccatctgtggtcataaatttcttcgaaagagccagttactggaacacatgtatacacacaaaggtaaatcctacagatataaccgttgccaaaggtttggaaactcattggcccagaggtttcagcagtattgtgacagctggcccgatgtccccttaaaaagctctcgcttgtcacaagaacatttagacttgccttgtgccttagagtcagagctcacacaagcgggtgtggacaccatcctcgttgagtagcagcttctcgggcagaacttttatactgatcttggaggagatttacacgccatttctaatcataaattagttagttagctcctcatggtcttttgacttaaaatattatctgttgtgtgttttgaggttgaacaaaccagttctcattataagacatggctattaaacataactttcaaattat

SEQ ID NO: 3 - protein, 466 aa, Mus musculus
VRRAGARPSRTEKPARQSAAAAESGAAMDTASHSLVLLQQLNMQREFGFLCDCTVAIGDVYFKAHRAVLAAFSNYFKMIFIHQTSECIKIQPADIQPDIFSYLLHIMYTGKGPKQIVDHSRLEEGIRFLHADYLSHIATEMNQVFSPETVQTSNLYGIQISTTQKTAVKQGLEIKETPPSSSGNRAAVPGDHPQLQLSLAIGLDDGSGAEQQRTHPAAQAVEEHQKPPVSIKQERCDPESVISQSHSSSSSEVTGPSFTENSIKVHLCHYCGERFESRSNLRQHLHTHVSRSLPFGVPASILESNDLGEVHPLSDSSEALECRRLSSFIVKENEQQQPSPEHSSRGTSEPLQISQVSLISKDTEPVELNCNFSFSRKRKISCTICGHKFLRKSQLLEHMYTHKGKSYRYNRCQRFGNSLAQRFQQYCDSWPDVPLKSSRLSQEHLDLPCALESELTQAGVDTILVE

SEQ ID NO: 4 - DNA, 23618 bp, Homo sapiens
  misc_feature (1)...(23618): n = A,T,C or G
tttaccgttctgctttccctttgctagcaggaattttctttctctctctctctctctttttttttttttttttttttttgctttattgggagaaaaagtgcttagagtgttcagttattttttatatttttctaattcatttcttctctggttacaaatcagtcatgcatggatgttttattttttctgaaatctccaagcactttaagcaaaggtttttattagcccacttgagtagtgtgttcatgggagtatacttccattgcgaaagaagtattggtttacttgtatccagaagttttagttactcttgcctgtactgtattctaggtctgtactagcattataattttccatctttctcctgtcctttgagtaccttattttttcttttagaaatttggtttgtctttaatggactgagaggaatcttttcctttctttctccgggttctgattttttttaaaggtctattaacaatttgtgcttactgttgttagtattcttgtgtgcttggctttatcaggcatcctacaatgtaatgttggttagatgggaattagaggtgcttggaggttggctatgtctgccaacaggcaggaggccccaaactaacgtttcccagttccattaaaggtttctagagcataactactcttcctgtttcatctaccccctccataccctctttgctaacattctcagtagatcttaataagcagatgtctggaattacagcagattttacctcaaacagtattttcagatttagaatttctgtatcatttttaggtgttatgaaatccaatctaggtgtaatggagtaagagagtaaatatttctttttcctaaatactatttgaaaagaagtctgaaaatagtgtgttcctccacccccccacccatgcccatcctgccagtttaggagcacttttgattcttttttttctttttctttttttttttgagatggagtttcactcttgttgcccagactggagtgcaatgacacaatctcagctcaccacaacctctgcctcctgggttcaagcgattctcccgcctcagcctcccgagtagccgggattataggtatgtgccaccacacctggctaattttgtatttttagtagagacggggtttcttcatgttggtcaggctggtctcgaactcccgacctcaggtaatccacctgcctcggcctcccaaagtgctgggagcgagccaccatgcctggccatggagcacttttgtttcttaatctggccaatattttaaggttacaattagaattacagttgtttatatttgttcatttaatgtagtcaacataatttccatactttgaacactcttacggaattgtttatttatagagactagtataaagttgttctatcttacttagtttgaactaatccagagttatacaatctagaaagtaaagaaagtttttattgtctcttaaatatcaatgtaattgtagagtgtgaaataatttcttgggtttccttggtcccgtgttcttctgaggcagtggttcttaactgagcagtcacgttagaatcacctgggaagctttttaaaaaaagaatctgggctgggcgcggtggctcacgcctgtaatcacagcactttgggaggccgaggcgggtggatcatgaggtcaggaaatcgagaccatcctggctaacacagtgaaaccccgtctcgactaaaaatacaaaaaaattagctgggtgtggtggtgggcgcctgtagtcccagctactcgggaggctgaggcaggagaatggcgcgaacccgggaggcggagcttgcagtgagccgagatcgtgccactgcactccagcctgggcaacagagtgagactctgtctcaaaaaaataaaaataaaaataaataaacaaataaacaatctggccgggaacagtggcctacgcctgtaatcccagcactttgggaggccaaggcaggcggatcgcctgaggtcaggagttcaagaccagcctggccaacgtggcgaaaccccatctctactaaaaatataaaaattagccaggcgtgatgggcacctgtaatcccagctactcaggaggctgagtccgggagaagcacttgaacccaggaggcggaggttgcattgagccgagatcgcgccattgcactccagcctgcagcctgggcgacagagcgagactctgtctcaaaaaaaaaaaaaaaagaatctgtgcctcacccctagcaattcaattctgtttgggctaagcctgggttgggactcagacatcaatacagctctgcatagaaggttttacagtatagtcagcaataagaacctctgtttcaggataaaatgatttctacaaacattgtttcattctctacataattaaatgtcacacctctacagtcatgtgaaagttccattaaaaagttagtcgctatataaagtcttttatcatatggcacttgaaatattttgcttttgcctttgtatttatagccatgagtaagtagctcaaaaaagatgtacatattcctctgccaactttcctgtctccttgtctgaatgaaaattcatcataaagtctcagtggtaagcattgacagagaaaatacctaagactgttttcctacagaaacagtcgtcttgctctttttgttccttttttattaaggattcttacagcctgagagaatgaagagctgtgtagtccaggatatccggctggctaccatagatctgagagtccagtctagtacagtagatttttctaaatacataagaatcaaagatatgtattgaatatcaagccagctttaaacaaacatagatactagtataaagttgttccatcttaatttgaagtaatccagagttactacaatctagaaggtaaagaaggtttttgtaatctcttaaatatcaatgctaaaactattatgataatgtatcactttgataacagataaaacttttaaaaatgtagcactcatattttgattctggtatttataagtataataaaatactttatttttccataatttctctcacatcttaaaattctcaccagaaattctcaaatgtaacttctaagctctttctgtattcatgggaaactttagctatttcacatactagagaaaataaaatagacagtcaaagaatgatgagcaaaggctatacaaaaagtctagctaataatttgcagagtaggttgtattagaaaatgttctaataactcaatggaatggggctattgatttgaagtaaaatctggtatattacaacatcaaagatctcctattatgcaaaacaagtttgaatgcacctcatgtgtacttggtgttttttttttaatagattttaatttgtttcattttatacacttgaaaagtttactcccttatttgattcaacatatttgcaaaatctgccaacagtgtaaatgttgaaagttctagatggggttttgaagaaagggccctgggtttaaactcagtcttgatgtattatcagcaccatttaatagctagttgtttgacttcaggtatgtttcctgccttctctgagcctgtggtttctcagccataaaatagagctgatagtacctgctctactacctcacaagatttaaaagaaaaaaagatagtgtagggcagtggttctcaaagtgtagtccaaggagccactggaggtttcatgggtcaataaggatctcccttatgtaagaacagattctcaatatacttgaaccaaaacaagagatgacaacagattgaatgcagaatcagataagagagtccagctgtatctgttaaagccagatattaaagaggattgcaaaatgtaaattaatatcacccttctcacttgtttttgaaaaattttttaggaaaaaatatgttaatatgtaatgggtttattgctattttaaatattttaaaatttcttttaattttgaatatagtaaatattgataaatataacctatataaacaacagctcttcacaatctctaatactttttttttgagatggagtctcgctctgtagcccaggctggaatgcagtggtgtgatctcggctcactgcaacctcttcctcccaggtcccggttcaaacagttctcctgcctcagcctcccgagtagctgggattacaggcacacgccactgtgcccagcttttttttttgtatttttagtagagacggggtttcaccatgttggccaggctggtcttgaactcctgaccttgtgatccgcctgccttggcctcccaaagtgctgggattacaggcgtgagccaccgtgactggtctgtaatactttttagagtgtgagtggatcttgagaccacagctttttagaactgctgataaacagtaatggttgagtagggctgctctgcctatggagtagccattcttttatttattttctaataaattgctttcgtttaaaaagaacacaatgttgggggagggggtaatggttgaatagttcctatcaggacagtttcctgcagataactataaacttgatacactttttttttttttccttttgagatggagtttcgctcttgttgcccaggttggagtgcagtagcgtgatctcagcttaccgcaacctctgcctcccaggttcaagcagttcacctgcctcagcctccagagtagctgggattacaggcatgtgccaccacacccgctaattttgtatttttagtagagatggggtttctccatgttggccaggctggtctcgaactcccgacctcaggtgatctgcccgcctctgcctcccaaagttctgggattacaggcatgagccactacgcccagctgataaaagttttaaaaattaatagatggcatttgagaattacaaaaactagattgaggtctgcaactggaagaggagaacagcaatgaataagcttctgtttttatggcttttagactggcataaggtcccagctggtgatatgaagaggtggctacaactgtaataacaacctgtaatctctcttgaagaaaagaggacagagctcacagtgatcatgcagctggaaagtgcaggagaaaatcctagaaagaatgttggagtggcagaaccccaaacactgtttataaactctgcttgaatttcttgcaaacccctcaactgtacatgtgtggagcagcctccaaacagcacacttaaggctaaaggagcagagatttcagctgctgtccaccataggggaggcagaacttggagtttaagtccagctaaggtaattgtctgcaaaaaacaaaaacacaaacactctttggaagaatattacagaatctagagtgaattgtattaatcacaatacctagactataatccagaaacaatcaccctaatcagtggagactgaccccataattagccaaaggttggatttagcagagaagatttaaagcagcagctattataactatgctcaaggatgtaaagcaaaatgttgtatatgtgaacaaataggaaatctcagcagagaattagaaactttaaaaaagaatgaaatgaaaattttacatctgaaaatacaatatctgaaacaatcttgaatagatttaacagatcagatatgacagataagtcatttaatttgaggatagattaatagaaattatctaatctgaagtagagaaataagttattgtatatgaaagttctctgtaaacttcagtgctctatgtaagtttcagagtttattactccaggtttctttcatatgtaaagggaagaggtatgtttgggtcttctgatctgcagcttccttaatgtcctgtcctgtcatgtctgtgtctaagctttataccctctggtttctttatttttatttttttatttttttttgagacagagtctcgctctgttgcccaggctggagtgcagtggatctcagctcactgcaacctctgcctcctgggttcaagtgattcttctgcctcaacctcccaagtagctgggattacaggcatgtgctaccacacctggctaatttttgtattttgagtagagacggggtctcaccatgttgttcaggttggtctcaaactcctggcctcaagtggtccactcaccttgtcctcccaaagggctgggattacaggcgtgggccactgcgcttggcctagcctctggtttctaatatcccctgcagtcagatatttggcccttgctgctttcctgtactattgtcagaggttaccaggaatcttttggtcagtacactcgacatgtttgtaatgggcctcacccccatgtttctcttcagtgttttgcaccattgccatctcctttctgcaaggtcattgcctttcctcaatgacgatgttttcttttttctcctcctctgtcttattttgtcttttctgttttccaaagattcattcttagcttttttccctcttatttcattctactttttagtctactttattattttcatacttggttacttcagccttgtcgtttcagaggcctcttctccctctctggctctgctctctctagagccctgtcctgcttcttgtccccgctgatcactaaacatttctacttagatacctggtagacacttggagctcagagtgtctgaagtgaaacccctattcttcttcttcttttttttttttttgaggtggggtctcagaacctcttatcaagacggtttctgtacttcttctctaatgttctgggactctgcctttatatcaacacctagcacatggcagttactctgaaaatgtaatctgaaggaatggatgaattcttccaattacccaagctggaattctgagactcacctttgatttgatctctgtggtgacaagtcatgtcagttttgtgtctgatgtatctcttgtattccttccttcattcccactgcgattactttgataccatagtaggctcctagccagtctttctccatgccttttcccttgctaatattttttatatgttgctgttagagcagtctttactcacgcctaatgatggtgatgatgataatgcctagtatttattaggcactaactgtgggcccactgtttctaagtgcattatatcattaaattcaaataacctataagttagatactgtcattgtccatattttataagtgaaatggaggcccagagagttaagtgtcttgccaagaccacgcagctagtaaatggcagagctaaaattttaagctgtctgattttagttcaagctttaactaccacgctctgttctccctcccacagagtaagttaactgatcatgctgttcttactcaaacatcttacatagttcacttcaaacacgacactactttttagtcttatattctgtatgctttttgaactgaccacatttcattatttctgttactttttttttctatgccaagctgaatccttctgttatctaactattcatattcttcccagtaattttattcattttattttttctgcctggccttgtttcccatcaagttgcctgtgtttatctccctctgatagcatgttctctaactgctctgtgctactgaatgcatttatttcatattataattatggtttgatgttttatctttcctgtgagcctgtaatcttgagtgtagcatcttgtcatttttttctgtctccacgccttgtacaatgcaggcttttacacattttttctttattaaattgctcttcaaaaatatctgttgaataagtgaagaatttaactgttaccaacagaccattaaccataagattcctgtatgggtggcttattagtgtgctatgtctcatttccctatggttcagtagttcaatataatgggaagaactggtgaaaatgtttatgatccgagggtttggttttgttttttttttttgagacaacttatcaggctagtttaagatgcttcaatatgaaccatttcattgattctaagacacgtttttcacatgctgaaattgtcaatacagatttttagtttgttaggccgggcacggtggctcatgcctttaggaggctgaggtgggcagatcacctgaggtcaggagtttgagaccagcctggccaacatggtgaactcccgtctctactaaaaatacaaaaattagctgggcatggtggcgggcacctgtaatgccagctacttgggaggctgaggcaggagaatcgcttaaacccaggaggcggaggttgcagtaagccgagatggagccgttgcactccagcctggtcaacaagagcaaaactccgtctcaaataataataataataataataatataacttggggattattccacatcagtacattaaatatgtagttttaatagagtctgccttttttttttttttttttttttgagatagggtcttgctctgtcacccagggtgaagtgcagtggcatgatcatggcttactgtagcctcaatcttcctggctaaagctatcctcctgtcacatccacccaagtagctgggactaaagcatgcaccaccgtgcctggctaatttttgacacataggaagcactataaaatgttagctatatttattatattactgatcacttagctgtctgctgcccaagccactgccaatctttagacggctaaccctgcattacatcactgacctccttagaccttggtctggctggctggtgtggaaacctcattctctttttcagtgtctgctctttcaaaggatgttctcctggccacccaatgatgccctttatactacagctaccttctgcctaaagtaccagggctctctccacagtagggtagagaagatgatgtacagtctgccacctgcctgaaaccagggcacttctgaatgtttttgctgcttatactcggcttcttggccagaattctgcatgttcttcctcatataggcttccccgcagttgttccaccttgccttttacttcctttgggaacctacattataatatgcgtctgaatccagttgagatcagttctttcttttgtgtgtgtgtgtgtgtttttgagacagagtctcactgttgcccaggctggagtgcagtggtgtgatcacagctcactgcagccttgacctcccagtcttaagtgatcctcctgcctcagcccctcaagtagttgggagtacaggtgcatgccaccatacctagctaattgttttattttttgtggagatgacgtttcactatattgctcaggttggtctccaatacctgggctcaagcaaccctcctgcctcatcctcccaaggtgctgggattacaggcatgagccactgcgccagcttaagttctttctcaggaggctcttgggccacaagtaaattggggatgtggcttgacatctattttaagagttcctgagctactgtgatgataagtcccccaaacatttgatgagagttgggaagccagtatcccctgagcaccagaggatccctgaggaggagtgacatctctagctcagccaggataccgtgttatgttattaacatttatagctaacatcgaatagcagtttccattacaacatgattttcacataagttatttaactctgaggcaggaatcagtatctcattttcatttttctaatgaggaaacaagattagaaacattgtgttcacatagatggaaaaggacaggtctgtcttcatgtgtcactcataccaagctatcttcttaccagatgaaaaagggtcatattttatggttcagcagagtttatatcagttgtcataatggaggaatttagtgttagccgtgtttgcagtgaaagtaataggattgaaaacttgaataatttcatttaaatttagatctccttgttactctgtaggtttgtgtgaactgtagacaattttgtattaataaaaaataatgcgtatatacatacacacctatctacatttatcttgtcctttttttcagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggtaaggatgtgtttttgtaaataagaatttttaatattgtgatttatataagctttattatagtatcattttggaaattctttgttacggagtcacactaagaagtaaaattataattttttttttttttggcgacagagtcttgctctgtcacccaggctggagtgcaatggttcagtgtcggctcactgcaacctctgccttccaggtacaagcgattctcctgcctcagcctcccgagtacctgggattacaggcgcctgccaccacgcccggttaatttttgtatttttagtagaggcagggtttcaccatgttggccaggctgatctcaaactcctgacctcaggtgatccgcctgcctcagcctcccaaagtgctgggattacaggcatgagccaccatgcctggccaaattatannnnnnnnnnnnnnnnnnnncgcaaaatataacacatcttatacataggtaataaactcagtgtgtagatccataatggaaaataagaatgaaaataagaatagctaaaatgaggctgggcgccatggctcacgcctgtaatcccagcactttgggaggccaaggtgggcggatcacaaggtcaggagttcgagaccagcctggccaatatggtgaaaccccgtctctactaaaaatacaaaaattagccaggcatggtggtgggcgcctgtagtcccagctactcgggaggctgagggaggagaattgcgtgtacctatgaggtgaaggttgcagtgagccgagatcgcgccactgcattccagcctgggtgacagagcgagactctgtctcaaaaaaaaaaaaagaaaaaggaaagaatagctaaaatttattgaaggcttatcccatacccaagcactaagtatttgccctataatgtaaattctactgctgtccctatttcaggaaaaagaaaactgagactgagttaagtaacatgcccatgcaggattatacagctaataagttagatgcagatttgtctgaagctatgtctatgcttttagtcactaagctgttaatttttgtttcatataacacttttgttttttttattttttatttttattttttttgagacggagtctagctctgtcacccaggctggagtgcagtggtgcccaggctgaagtgcagtggcatgatctcagctcactgcaacctccgcctcccaggttcaagcaattctcttgcttcagtctccctagtagctaggaccacaggtgtgcgccaccacacccggctaattttttgtaattttagtagagacagggtttcaccatgttggttaggctcctcttgaactcctgacctcagatgatccacctgcctcggcctcccaaagtgctggaattacaggcgtgagccaccgcaccctgctgatttcaataggttctttcagaagttttaagatatctttattgtggctataaacatataaaatttgccattttaaccatttttaattatacaatgcagtggtgataatcacattcgcaatgttgtacaaccattaccactgtctatttccaaaacttttttatcaccccaaacagaaactttgtacccattaagcaataactccccatctcaccctctcaacccccagaaaccgctaatttactttctatctctatgaatttgcctattctagatattttatataatacttgtccttttgtgtctggcttattttacttagcatgatattttctgggttctccatgttgtagcatgtatcagaacttccttctttttatggttgaataatattccattgtgtgtgtaagccatcttgtgtttatccactcatcttttggtgaacactcagcttctttctaccttttggctactgtaagtaatgttgcagtgaacattggcatacaggtatctgtttgagtccctgtttttagttcttttgatcgtttacttgatagactgttaaattccttaagagcaggtacctattttattcatcagttttctaccgctggcatctagtatagtgcatatcacttaggagtcacttgattaatgttgaactattcagaatgtatgtctgtgtttcctaactttaggcagtagattgaatacatgaagactttttgctaggccataaagttggtataaaatgaaagtttaagcctttgttgccatgttttattaaggcagattgctaggttcgaacttcttaggaagaaattgctttagtctcagactatactgttaactgaaaggccagctaggttgtgtttcatttcttgtgggtctgtttttgtttttaacagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgttttaaagcatattctaaactatcacttctgcctacatttcacatgaattcactcctaccaggattatttttaaatattttcttccatataggaaattaatagttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctctataaatcaacttaactctcttttataatggtgacacttacaaagctaaaaccccaggaaaattaaagttgatgaaagaaataacagattccccggctctatatacctgggaaatagctggttaagcttcaccacaaaggatagatctaaattgtttctgaaatgtttaaatttcaaaccccgcatagtcaaggataataaaacagactcatctttttttgccctcttgttaaattctaagcttcacgggcatttgaatacatctaaaaaatttggtttgtgagccttagaatttaaccacttacaaaactcttgagctccctccacttctgaggacgtttcctgacacattcaacagcatcagcgtccaatcaggagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactgatgtgtgttgagagcacatctaacttgataagatcaattgtattgggagtaattaaaacaaatgtatgttctttggggtcagaactttgtctaatcttaaacttttttctaccaattcacttaagcaactattgaaatttgtactgccctcaaaaatatcatctcattggaagaacacaagtattaacattgattttttgtattttaggctagttaagatatatttcctagccttcttcaattcaaattctattgttcttattaagataatttttctcctctatattcttccctgtttgcctactcattattattatttttttaatttaatttttttttaagatggagtttcacccttgttgcccaggctggagtgcaatggcgtgatctcggctcactgcaatctctgctgcctgggttcaagcgattctcctgccttagcctcccaagtagcttgggattacaggcatgcaccaccatacccagctaattttgtgtttttagcagagacagggtttcaccatcttggtcaggctggtctggaactcctgacctcaggtcatgcaccagcctcggcctcccatagtgctgggattacaggtgtgagccaccgtgccaggcccactcattattctttgacacaggaaatccttgtatatagctaaagggtggaggtagagttgtacatggttggttggataagacagcaagtgcctcagggcagagtttggataaatggtaagagtttgctagcagctgattggccgtgatagacaacactcatttaaagcagaaatatatctgttcgttgagagttaagaaaatagtggttaactgtatttctattcttatagttccttttaatattagaaattcaaagcaaatgctctttccttgttccttaaaacattcattctgtttaggaagtgggaaaatatcaacttcattttatagaaaaaaaatcccaaaagctgaattccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagcctcctgagcatgtgccaccatgcccagctaatttttgtatttttagtagagacagggtttcaccatgttggccaggatggtctcgagctcctgacctcatgatctgcctgcctcagattacaggcatgagccaccgcgcccgggtctgcaggcattttttaaagtaactgtcatatgcctaacactgtgccctgagtattattttttaaagacatgattgctcactgagaaaatttgctttgtattttaaaagttcttccagctaggccaggcgtggtggctcatgcttgtaatcccagcactttgggaggccgaggcgggcgggtcacgaggtcagaagatccagaccatcctggctaacacagtgaaaccgcgtctctactaaaaatacaaaaaattagccgggtgtggtggcacacacctgtaatcccagctactcgagaggctgaggcagtggaatagcttgaacccgggaggcagaggttgcagtgagcggagatcgcaccactgcactccagcctgggtgacagagcgagactccatctcaaaaaaaaaaaagttcttccagctaaaacctttattttttgactacatctccacaaaatggagctatactgttagccagtatcctaatagtatagtgcagtttgcataatgattaccaagcttgaaactggaaatgtcatatgcactttcgtgtgtatcaggcagatactaaacattttccccttgagtcagcttaaaatttttccttcttttgaaatctcacgcagttgttttctggagaaaaatagagactgttttagtatttgttcttattagcgtatcatcagaactcagcacagtctgccttataagaaaacaaaaaatttttttatttataactcttgagattgttacttcttgctctttctgatttcccatccgtaaagtgggtgtaagcaatacttacctcacaggggtgttgtgaggatttatattaaacgtgttaagttctctcagtattattgattaaaatcaaccatataaacgacatttattctgtagctagacctattaactttagtatttcagcctataaattctaaaatgttcttaaaagcagtaatgtactatctaatattcaataactaattgacagaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttattgaaagttctcccaaatatattgtttttgtttacacaaaggaaaaggaacaaaaacaataaataaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgaccttgtgatctgcctatctcagcctcccaaagtgctgggattacaggtatgggccactgggcccagcctatttttatttctttgatgtaggtgatctaaatagtagatgaggacaggaaatggggtgaaggtaataatagtattattagaaaagtcttcactgaaaattgaaggaaatacatattaatcgtggaaaaagatagtgtgaaaaatgtgtaatttcgttaacatttatttgtacaggcacattcttgatgttgtgagtcagatacttgataaatgtccattttttgtagtaattgatgtaaaaatgggccatgtgaagaattttcataatgtaatttgtgtctttgtatattttgaactacatatagatttgtggcacttaaattattaatttttgatttcttaagagtgaagtctgtaaatgatttctctctgctgtacttctgtgtttgtatggttggacattttgaaaactggtgagattgcacagtcccaaacctggatgtcttaaatacaaggaattacaaactgtgatttttgtcttgaagacctggaagaattcattgtgcttcagtatgtatttgtactgcacttgattaattagttaagtattggtctggtgcaattgacattaactgtcatcaactcctctattttgtgctaaataaagtcatttagtcagaatggatcaaatataaacttatactttaaaataaacttagattataaaaacttgttcaataaaaaagacccactgaaaaatcttcaaagtacatgtaacacatagctaatacaggagaccaaaatcaataatacattgtgtggctaaactcatccacctaatgtactgtgaatttgcttcagaaacattcttttagaaagttgtgtatctgccgggcatggtgcctcatgcctgtaatcccagcactttgggaggccaaggcccaggagtccgagaccagcctgggcaatatagtgagacctcatctctgccaaaaattttggccaggggcagtggctcacgcctgtaatcccagcactttgggaggtcgaggtgggcggatcaccagaggtcaggagttcaagatcagcctggctaacatggcgaaaccctgtctctactaaaaatacaaaaataagccaggtgtggtggtgcgcgtctgtagtcccagctacttgggaggctgagacagaatcatttgaacccgggagatggaggttgcagtgagccgagattgcgccattgcactccagcctgggcgacagagtgagactccgtctcaaaaaaaaaaaggcagggtgtggtggctcacacctgtaatcccagcactttgggaggccaaggcgggcggattatgaagttaggagatcgagaccatcctggacaacatggtgaaaccctgtctctagtaaaacacaaaaaattagctgggtgtggtggcacgtgcctgcagtcccagctactaggggggcagaggcagaggaattgcttgaacccgggaggcggaggttgcagtgagccgagattgcgccactgcactccagcctggcgacagagcaagaaacaatgaatttcatatattttatcaagacaaattaatgtgacttaatcaaaaacaagtttattagcttagcttatagaatgtgttcttattttacatcagtgtttgccaaatgttgtgttcctagtgttgaggcaagtagtctttgtactgggtaacattttggaggtgtgatgcaaaaatgcatttgtggacctaattcttaccgaccataatctgtgttaatcgaaaattgacgtcctaatcaaatgctttccaactgctgtctctggaaagaaaggtagtatttcgtcatttcccagaagtttcttgctttgcttcttcttttttttttttttttttttttttgagatggagtcttgctctgttgcccaggctggagtacagtggagtgatctcggctcactgcaaccttcacatcccaggttcaagctattctcctgcctcagcctcccgagtagctgagattacaggttcccaccactacactcggctaattttttgtatttctagtagagacggagtttcaccatgttggccaggctggtctcgaactcctgaccttgtgattcacctgcctcagcctcccaaagtgctgggattacaggcgtgagccaccgcgcccagctgcttctttcttctctatttacagtctactgtatcgccttttgcccccagtaacatgatccacaatagtagttctcaactgaggtatattagtcaggattctccagaaaaagaaagaaacaacaggtagaactgagagagagaaagagattgattgattataaggaataggttcatgtaattatggaggctgagaagtcccaagatctgcagttgggaggctgagaggctggggagtcagtgatgttccaatctgaatttgaagacctgagaaccaggagagcttatggcataagttccagtccaaaagctggcaggcttgaaactcaagaagagctgatgtttccatttgggtccaaagggaagaaaagaccgataattgcagctcaagcagtcaggccagagaaagtctctttttttattatattctggccttcaactgatggaatgagagccacccacatcagggagggtgatcttctttacgcagtctactgattcagattttgtctccctccagaacaccctcacggacacacccagaataatgtttgactaactattggggcagcccatggcccagtcatttggacacataaaattaaacattacacagggctatccccccccatagagacatttgacgatgtggagatgtttttggttgtcacagttgggtgggcgatgagggaggctgctgctggcatctagtaggtggaggccagggatgctgctaaacatctcagtgcagaggacagcctcccgcaatacagaatatgtacctcaaaatgtcattagagctgaggttgaccaacccttctgagaccttaaagtaagttttgtgatggctgtcaggaataaaagaatacaaagaaacccaatttgggggatttctattctagtcatgtttagagcaagtattggagtatgagatgtgttcagaattaaattctatttgtattatccttgatcccagcttttaaaagataaaaatgtgattattagaaataaaaggaaaaaatgtgattattaaaaatcagagatgtattaatcagcaagacagttttgaatctattcatataatgtttgaactaaataattgtctccccaaagaggtctcttcatgaaattgagattgtaggttataatttctgtgaatttttaatctggccaaaaggtggcaccagtgtacctttaaaaaaatgttcattatacttgaattcagcattactattaatagtaaatattatttagggcttagctacttttggatcatgctttatagagtcaagactaatgagaattttcttaaaatttcataaggtactgcaatatcttgacatccctctttaatcaagatgcttctgatttacatgtacatatctcagcagataactttttaaaatatcacattattgtgctacattgagcatttctgaagatttttccaagccattaactgtgaggccttggaatttgggctcttttaatcaggcatcacactcagtttttggtgttctgcctggtcaagacatagattgaaggacatttgagtaaatacgctcccttgctcctttcttgccttttgttcattttttgtacatccacaatctatgaggtatgttacctactgaaatttactttcttttccaactgtggttcaacaactgactttcttctctcatactttccaacccattccattctgaataagttaagagttttcttaccttcagctcttctcaccttccaatactaagtgaatacagcctgcctcccccttcatttctgattacaatattattctcatcatcctaggactttgtacctaatcaccagttgcttctcctaagtttattttacagctgataagccaacttggaaaatgagcccactctccctcagatacattctcttccgctgtttgaaacgtttttcattgaaacaatttggtgatattgtatcaaaataataaagtattaagctactggaacaccatggtgtcctttcatgtcaaacgtctgaaggaatgacagtcctccaagagagattctctgtacaaatggtgtgttcccactgtcctggaaacaggagaggcttgtgccagggggctggagaagatggctctcacccactgtggtcgtcatcccttgtctggtctgtgttattaacaagtttcaggaggttccgtgtcagatttatgtgcatccagcaggcctttgaggaatgggatcttgtgtatttagcactgccacattttttctatagtggaagccatgtgaaacttagtccaaaccatatgcaggtaattaaaaaaaaatttttttttgaactggcatttatggtaactaccatatagggaggaaaacctgaagaacctggagtggttctgtagaaagtgaagtcacacctgttactttttgaaggtgaaaacatatttgcaaaggcaagggaagaggttttaaaatgcagatcaaagattcgaggggagtgaatctcaacagtattcctagctaaccacttctcatttcccaacattgctcttttttcacatgtgtgctgtctggtggtgtgagctcagtggtttctgtcccctctatcacaatattttaacgtctatgaggaaagacatataaagggaagagtcctttttttaaaatcttaaatatctcctatttcactattaacataccagttttgctgctctctcaaactggtggctatgctcagagccaccatgatggccatgcagacaatgcacaacacagtgctagggggtgcctcgattgaatgaaggcttctcccagagttgtgctgtgccaatggcacagctgtgcgtgacagccttgcctttccttatcctggtttaaacactgggtttaagaagcccttattttgaatttctgcagcaagtagcagttttcactgattagtcaggattaaactaagatagacaagtggtatagaaatcagaataagatttaaaattaccccgaggtgacacaactaatggcttggtcaaaattggtagaacttgtattaaaagggtggattttgctgtatgtaaattataccttaatgagaaaaagattcataccactcagaaaaatataagtcttag

SEQ ID NO: 5 - DNA, 1303 bp, Homo sapiens
atggacactgccagccatagccttgttcttctccagcagctgaacatgcagcgagaatttggttttctgtgtgattgcacagttgcaattggagatgtttacttcaaagcccacagagcagtgcttgctgtggcttattttacttagcatgatatttttttttaacagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtag

SEQ ID NO: 6 - protein, 419 aa, Homo sapiens
TCSENLVFCVIAQLQLEMFTSKPTEQCLLWLILLSMIFFFNSECIKIQPTDIQPDIFSYLLHIMYTGKGPKQIVDHSRLEEGIRFLHADYLSHIATEMNQVFSPETVQSSNLYGIQISTTQKTVVKQGLEVKEAPSSNSGNRAAVQGDHPQLQLSLAIGLDDGTADQQRACPATQALEEHQKPPVSIKQERCDPESVISQSHPSPSSEVTGPTFTENSVKIHLCHYCGERFDSRSNLRQHLHTHVSGSLPFGVPASILESNDLGEVHPLNENSEALECRRLSSFIVKENEQQPDHTNRGTTEPLQISQVSLISKDTEPVELNCNFSFSRKRKMSCTICGHKFPRKSQLLEHMYTHKGKSYRYNRCQRFGNALAQRFQPYCDSWSDVSLKSSRLSQEHLDLPCALESELTQENVDTILVE

SEQ ID NO: 7 - DNA, 32586 bp, Mus musculus
  misc_feature (1)...(32586): n = A,T,C or G
gaaatgagtatttctgtgcaactatttaagaacccgctctcaatatcctctgtctgtgaccaggagtggatttcattgcttattctttttgtgggacattgaactgtctttcacagggggctgcatcgttttatagtcccactagcaataactgtcccccttgggaatacatctccaccaccatctgtcccttttctcctcctttattccacaaaagctagtcccccacagatcctctgaacctctcttgctcctggggcagaaggtgaggaaactccaggaggaggtctctttagcatccagccttgtcttttcttcagtagagcaggctgtcaactccctgttattattaaagtacacgctacagtcgtttgtgtgactcttactattctccaacacctctgtggtctctctaaacttcctattaaactcccacataaggaagctggggcagaaggaagatcgtgtggaaatctaagttccgaggagcgcacgtccctaacgtccgcctcctcccgctctgcctccctgcagtgggcgggcctgggggcccagacgcctagagagacctggggagaggaggcccctcctcggggttactctcggtcagcacacactcccggggttacttcgcgttcactcggtccacagcgcctgactcctcgcagccaatcagcagccgcgctgcggctctgccggcacccgctccaatcaggaggcgccgcccctgcagtctagctgcgggagacaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatggcagtttgacagcttcccgacaatgtaaggcttgtctgataaaatcagtggtgagttaattaacattttttaatcttgtaaagggaaatatgctaatattttggcgcatttccctaacccagtgaaccaaaaacaccatattacaaaatcacacatgaataaaagatggcttgaaaatacaggcaagagctgggtgtggtgatgtatgcttttaatcccagcacttgggaggcagaggcaggagactctgaattctgggctagcctgatctgtatggtgagttctaggacagccagggctatgaaaacacacacacacacacacacacacacacacagagagagagagagagagagagagagagagagagagagaacccaggcaagactagactaatggattcttattttaaagactaagaaacctcagggcctggggcacatggcagtagacagaaaagctgcaagacgccattcctcacctggacttcacactgcaaacagagcatacttgaggtagagtgctctgtaaacagcctgtgatgggccatgagtaccgtggcctggagctttctgactgcatgcttctcacttagttcattagccaactcccattctcaggcatgctccccctcccccaacttgcttttgagataaacactgtatgttgctttggctgttgctttggcgagccatgatgtagaccaggctggcctggagctcacagaaaagaaaactatttaaaaatttggtagagagatggtatgacagtaatctcagctctccctgtgttatacagaaggaaccggagggagacagaaggctaagaacctattatccagtgttagagccatggcggcagcagtgagtcccactttaggagggcagatagggtccttgtgaggtggagatcctggagggaggctcctgggagaaaggcaaggactttgagttgagaaagtagggaaggatggagtccacctagttttgatactcaacccaatgtcccaaggagaaagcagcaattgacaatgaagtacagctgatgatgaagccttctgcaataacccaggaaacacaggtcccagagtcgcccagccttgtggtcctatggtcccctggtgtgggtgctggggtgtagccactgtggataggggagttgaagaaatagggagatttgggggattctgcacagtgtcacccaactgtaaactcaggagactcagaccgaaggatagagaggtaaaggctacatttgatcaaaatgcattgtgtgtgcatataaatgtctcactattttaaaaagttcaacactacctaggctgcatcaggaggactgacagagagtcgggggttgggtgggggttgtgagctcaagggatgggtttctagtggactttgttcaccttaaaagtctcttggcagccaaacttggctgcgcaaacctttggtgttagctctcaggaggtagaggcagagggattctgaaagttcaaggccagtagggtctgtataacaacttctaggctggccattagggaaaaacaacaaaagcccctcccagttctttttcttgagataaggttttaagtagcccaggctggccctgaacttcctctacctcctgagtgttgggattacagacgtgttctaccatagtgggttttactcagccctgagaaccaaatctcaggctcagtgaatactgggtaacccactctacaaatctgagaatatatttgctcttgtgttacggccaagttaaatctgcatataacttagaaggtgaaataatttcattaggcttcttttggacattttgttcctccctatcgtgttccccagaagaacacctttaaattattttgagctgactctcgagcattcctttctgtagtcttaaatacatgcttacatagctgaagaattccatttttgaccttgcaccttggaagactgaaatgtaatgttaaaacaaccaccgctgtggtgaccaccatcggcgcaagcatttgggaaggaacctgcacactgcattttctccagcctctcagtggcttcaccatcgcacaactatctccgttctggatctgagcactgctttctcccccccccccccccctgcttttccacacacttcattactgacactcaacccccttctgcctccttgtctttatctccacactacactacactggcagcacccagcacgctgtgtcctaaggcaatctctcccgtggcgtgaccccctcaccagctctgaccgagacagcttccctctgagcctattgcatggtccttgtctccatggccggtgtagtgactccgtttcccctccttagtgttgatccctggcttctttctcactcatttactctgttgttttgaagaatcgtgttccctcttagtcacaggataagctggcttcagtttttccaagtttcatatcatatcggcaaggacgttcatcgggcccttcctgctcagaaacatttgttcttctgagcattttttaaaatgtaattaatgaattcccccttacctgatttttgtgtttacttgttttctctttgattttttacccttacttaagtgtgtgtgtgtgtgtgtgtgtgtgtgtgttccagagagcccatgcctcaggttgagtgtggaagtccatgaacaattttcaggaatattctttctttccatcacaggtgttctggggatgacagaatctccaggtgtggcagcaagcatctctacccactgagccatcttaccagccccagtttatattttaggattctgatggcttgctctctagagaggtccacttacactcattgtctgggagcgtactaaaatttcttttcttttctttttggtttttcaagacagggtttctctgtatagcactggctgtcctggaactcactttgtagaccaggctggcctcgaactcagaaatccacctgtctctgcctcccgagtgctgggattaaaggcgtgcgccaccacacccagctgtattaacatttcttactaccctccccgttttctgtctccatctctctttctgctctcaccttctttctcccctgcctgtctctccacttgtgctgaagtctgtggaaactttccctcagtaaactccaactttgctcctaaaagtcaaataaaaatcctcttatcactctccttttgaatttggttttatttgaacttggccaaggtttcttggagttggattgacaagcaaaaacaaagacaaaacaaaacagaaccttaagtgcctactggtctgctttctctctataacaagcttcttgccagaaccccacccccacccaaattcttattaactttatctgagaaccgtgatctataaaatgagaagagaatggaagaggaggaggaaaagacaagggtggttttaaattcagttttcagaaaaatacaaactttggtcattttgaagataatgcgctttgaataaattgactgtgacactttgctttggatttttagagcaaagccagtcgcgtggatgcccataccctagaagagcagtgagggacagtctagtcacagtagaggcaggggcatgtctattccaatatgtggacaggatatcacactggacaggtctggctttttctacttgggatatgtggtctaacaggactgcctgatccgtgtttttcccacacttgaattgttcccgtgccaactgctttatgaaacacttaacagcgattcatagtgatggggtgaacagcacaggggctatttgtttattttagacaaggtctcgcagtgttgcttaggcttgttttgaactcaaattcctcctacctaccactcccaagtgcggaaattacaggggtgaactctttttctttctcttgcaatgctgttggtagaaagggggccttgcacatgctagacacacatcctaacactgggctacatctccagcccacagacagcttattacattttatacattcttaatttcacttttttagaataataaagtggaaaagacaccaggatcctaaaagagaagaaaaacccacattatatgggtttataaagcaagctaataagcttttcaataaaattaagaatggtatgttcctttcaccttaacacacatactgaacttgagtgacggctcttgagtaatatttctcagatggttcagagttctgcagcagaaaggagtggaatgaacagagcgaccttcgcctctctctctagcctcttccagaaggaagattcccagactgtctctcctgtccctccttgaccaaccagtcatctccttcactgtcctggggatccagcaccgtgcaccaggctgctcctctaggggtgagggtggggagggggtgtggggggtaaagtgtgctttgctttcctgattcaggcacaaacagcatcctaagcaaggactcttcaggggtttacactgtggcccttacttctagacactctggaactccaaccaagcagaggacacagaccttgcctatgtgatgtggtttgagtgggaactgtttgtgaaggaaaggaagggtagggaaatgggagggggaggaaggaaggggaaaacaggagaggaagggaggggagggactaaaaagactcatttactttccttatggagttactggaatggctgacctcattccaagttagaggatgcttactttgtatctgaacgtgatggggaataaaactgctcacagtaactttgtttcttttctcttactgagttcccacgtcccaacccgagaaagacttctctagcaagtgccttgctgaaggaggttgaagctcctggagccaagcctgtggctctctcctctctgttctcttcgcctggttagcatctgcttttggcttagacatgagagctagaaaacatgcctccctgtgagtcttactgaaaggtcccagggccactcacctgccgccacatctgcatgtcctgaaagtcctatgacttgccatcccgagaagtaaggaaacaatgcccacctcaagattcatcttttcataacccttttactatactgctcacctattgcctattattattattcctgaaagaaataataaagagaataatattatttatattattattataaataatattatagttcaattatctagttatgattatgtaacaagtttaataaacaaacacctatttaaagcccttcttgggtcaggtacccaagccctatttccttggtaaatttcagtacagctgtcagaaaagcggaaactacccgacatggggagccagcctggtaaaaccattgggtaatttaaaaacaaaaataaaaacaaaatacaagaccaggaatcagtaaggtcagcagtgggtaaaggtcagagggaagaatgctctaggcaaagggaaaggaatatttttatcgtttaatattgaaaaatgggactgaagagaaatgaagatatttaagggaaagacataagcagggaaggaccaaggtccagagggcctccaaagcccccgaaagaagtacaggctccatgctgtggccaataggaactccctacaataaattaatttatttaatataccaatgtgggggctgttttattcttactctcttgagttgaagggtcaaaattaaaaactgccatacactgtgtgtcctttttcatacagaaaactttatagtcccgtccccagcttccacgcacacactgtgcattgctgtaccaaagaagcctgcacttctcgcatccctgcatccctgcaaacgcaagcataggcaaacattcatcacatattacctatacctttcaacctggtcacttcgtacttcttgatgccaggcctcatgctgtactgtatcatccctaccacacagctttattgaagctggcccacaggggatgagacaggcagcttcctatcttgattatcaacagttaacatggtctcccaccttttcttcctggaacccttaactcattccttttctaggtttccagaactttctccccaagggagagaaatgtaggactcctgttctacgtcattgtcttggcaggcctcccttgctttctccgatagacaatgaatgcaatggcagctggcttaagaaacatcaccaaccagctctgatgcaggcagcactgtaggctgcaggttgagggaatgtaagggcagtttgtctccagtggagagctgcctttagtagcaatcaaggcattccaaaggaaacactgtgtcttcttccccaaagcagcatgcaatagatacttggaaatcccaactcatctggtggaccttcatcagtatctggaatagtagcatggagggtgatgcttcaccacacacacacacacacacacacacacacacacacacatacacacacaccctgtggatgatgggagtggtccttttaaaagagaccccaggatttggagaggcggttcagccattaagagcatttgctgttctttcagagcaccagagttggattctcagttcccacacagactgctcaactccagttcctgggaacctgccacctctagcattctcaagtaccttcacacatgtgtgcatatgcacacacacacacacatgtccgtataattacaagtaatactaaatctttttgtttgtttttaaagagaaaccccagagacaaagctcaccccttccccattgaacacagagatggccacctaagaatcaaaggcccattcttggcagaatcaaactgctggggctttgctatagatacccagcccccagaaccgtgaggagccagtatctgttgtaaaggcctcacagtctaagggagtttgtttttaacagccaaggacaaaggacaaacccacagctagtaaaagatcagacatcacgcagacaacccagggggaagtgacatctccagataacttcacacagtacctctgagcctccgccagccatttgctgaggacacctggtcgtgttcagcattcttggctatggtcagtgagccaggcctgcaatggaggtgtctggtcacaagccagagagttggcaagcccctgagaccagaaggcaagaggtctggtttggtctcaggaaatgcctggcatctctcttcttgagaagacaagatgtctatcaaccccttttcctagaggtgggagatacagtaatggggtgacctggatacagaaggtactctgtgaatgcaccgcctgcataggctacaagttctatctcttgaaagagttaacacaggccccagagaagatggggcagcgagggaggtgtgttaggtcagagcacccaaggttcaagggtcatagggtcctctgaggagtggcttgaaagcgtttcagcacagctagctcctccccttgccggctgaacagtttatcccatctccgtatgtccctatgtccccttcttcctgcttagagtggaagaacagggctacccactgagcagtcacagagaaccttgcagtaataatttaatacccactctctgttcctactccacatacataaggctccctcggctagatgcttttcggcggttttcagatagcaaactgcaaactttcaacaaaagagtctcctaaaggtgccacatgtattcgcaaggcgtgaggtgggaagtggggggtgaggggtgggattgagatactgctgactgaccttggctgtgctctcggagtgtgcacagtgaccatggtgacccagaccagtgtgaatgggcaagccacagatctatgaaaacttgattacagcaccagagctccgagttattatctggtaagcatcctggagctggtgggcaaggctgagccattgttccaaaagggactacagaggcgcctgttagggagggaggcccctctcagctttgctctctgttggtggtagccatttcccctcccacgcgcctctggaaatgcaaagaccggatggagttgcaagtggtcggcgctctagtggctttcccactttatgtacctctccgcgtcttcctgccccggtagccaacccccactgctagattgggtcttctcttccagagaaagcgctgaagcgcccccgtggcagggtgggggctgggtggaggaccagcgggggatgggtgagaagccaggagcagaaaaagaagggaggaggggggggaggagctggaggcagagggaacagcagattgtgcagagccaatgagagcagcaggacgaggtggtaccaaattcccatcggccaatgactagccagagtttacgaaggcctcattagcatcgcccccctccgcttggctagggatgggacaatgcggtgttggtgtctgcagtattctgactcctggacaccggtggctgcaagctgcgattttggcgtcctctcattttctatccttatctccgcccgcggctgccctggccagccagtttttgattttttatctggtcattgatcaatataacgaacctaaggatatacaggacattaataccccactgccagctctggcccagagcttgtaccgcgcagcgggctgcagaaacttagtcatagcaccctttgtcgctgaggtctgaagctcgctgcacgttctcatccctgggaacgtgaccccagcatccgacgccaagatgccggcccacatactgcaagaggtgagcttacaccccaccccccaccccctcctcaggttggcggttgcagattggacttctaggtgggtggctgttgagggttggagagagttcagagcagctgggagcatttagccatcatttccgaattgctcaaccttgatagattgtttctggaccgggtgataaccggatttttactcagtacagttgattgtcccaacttgtgtttcttaaagtaaaacctgacctcttttcgatatgcgcagattttcctttgtgagttgctaagggtgctgctaataaagcgtcctttcctgccccttcatcataaggcttattcccgatggcctgcacatttccgtgttccattggtgcgctctacagtcatgcaaccttggcactggggtatggccgttattgcatctctcccgcagttatattagagggaaagtaacccctgctgcccccacgcgtctgcagtccctaattctccaccccctctcattgcagatctctggcgcttactcagccaccaccacaatcacagcgccaccttctgggggacagcagaatggaggcgagaagtttgaaaagagttctcaccactggggagcagatgttcgccctgaactaaaagatgatctatatgaccccacctatcaggatgatgaggggcccccgcccaagctggagtacgtctggaggaacatcattctcatggccctgctgcatttgggagccttgtacgggatcacactggttccctcctgcaagctctacacctgtctcttcggtgagcagcaccccttgtcttgggccaatacttcagatttctccttgatctttaaagaggtggcctctggtctctgacccaaggcagtggccctttctttttggttcttgttggaccagctggactgggcaaagaacctcgtggtgttaagaatggggggaggggggaacttgagtcttgagagtctcataacattgatgcagaggtctctgagcaggcttttctgtatgagtcacttgatggcacctgtcccagctttgcctgccacaagagaagcagggcctgcctcagagacgtcagagccaagagctagaccacgggcctagtgggtaacctgttgagtccagtgaggggacaaagccacgggatgctgttttaggcagagagaacagagggtaggttataagcctaactgtttggacttcctgcctggccagactaggctggtttgcctggagaaagatgacgaaggctcctgtatatccaagttcaaaggtgtatggtaccacgatttggtacaagccagtcaacagaccattcttagaataaaataagattgcaggaaggttttaccttctattcagccttctgcccctcttttcctgtccacattgtgctgtggcacttttctctccacacctaacacatacctcctgagcaggaagagagcctggagcagccacagcccaactgtgatgagtgtgcccctgtgccactgacctgcctagctcagctgcccagggagccatgggtagtgctgccccctagcgacacgcatgtgctttgcaggtggttacacaactgaacattgaaccaggaaggagggactgcatctatagtcagggcctcttgctgctctcagagaagcggagagcaagggtttctttagaacaattgattttctagaacagtatctgcatgtaggtactaatggcaggtctcttgcaggacagtgtatagaaaggctggttgtctcattgttggctgtctctctgcctcagtcctcctaggtcctataagtggtgaaatctgatccttgagagttttccaggtaccaaactttttctcccaagacaaggtttctctgtgtagccctggctgtcctggaactgggtctttagaccagactggcctccaactgcaagatgggcctgcctctacttcctgagttcggggatcaaaggcgtgtgccaccaccacccagctcccactcatagtcttcacatctttgtcaaaagtaggaatggaatacttctttagaatagttgtgtgccctgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccctctaccccatcatctgagttttgatccagtctacttgggtcatctgcagcataagcccttggtgctcagcgaagggctttggctctgcccaaagccatcccgtgatgcagggctctggttaccctagaatttttccagataggaaggcctttcatccgtggctggtctcctgggatcctgtaggaggtacgggagttgggaaggaggagagaggggtctcaggaaacatgttatctgactgcagaaggacgcagcagttggtgcaatgtggggtgtttccagtagcaactaagttctgtagtctgtgaaggtcctttgtttcttggtgttccttgggagggagccagtattagcctattctaccaaggcccctgctccctagttctgcaaatgggggcagggggagggtgtcagatgtctgtaccgctctctgtcccagtgagatatcaggactgtcacttcttgagcctttctgcttcaaggacagtgaagcagtgtttttctgccagctttgagcatctaacattctgcaaggacaggaccatggccagggagagaaacaagacaagggagtggatatgcagatcttaggggctgagtagtagaacggaaacaggtgatggcggatggaaaactcaccttcgaacagtagacagacgaccttttccagaatctgtttctttaatagaagtgcttggtacaactagtagtaccttgttcaaggtgtgtggagaatatgagagtattagtaccctttgtaatgtttgcgccactatgcaaatctgacttcccgttatgctgctgtggtgttgaaatgcacctttgctaaaagccttgtgtagagttagctattcagtatgccactgcttgtcttttccagttagccattgcccaagctgttctggctggtgcttcagaactgcccttggatatgggttctaagttgaggaaatgcagtttcctgaccagaaatctttagaggactgctagaggtcaaagaacattggccctgggaatgaaacccagtgatagccagactcgtgatgaccagtggtaccaaatgtttaaaatgtatgaagtttctacaaatcagtgcgccccagggctgcagggaaaaccaggcctttacccaaaggctaactgagaagctgacgggtgccaggaacctgtctttggcatacttcccttatgaatcttggcttgttggtgacacccaactttctggtcctacagcgtatttgtactatgtaatcagcgccctgggcatcacagccggggctcatcgcctgtggagccacagaacatacaaggcacggctgcccctgaggctcttcctcatcattgccaacaccatggcgttccaggtaagaagtgggtgctgtggctgtgtctccgcccaggggtgggtagtcagggatcaaggtctggatagttgactaggacagccattgtttctactgctatgtggtcccctagagtgaagatcagtgctgaagtccatataccatagagtcacttgtaaagggaaacaagaaagggtccccatgtgccgggtcacttttcatctcagagtcccaggggtgtcacacaggttggcagttgtgggtctttagtataaagggcacacaaaagctgagcactgactctggtttcttagaccataagtgaaccgttcgttttaaagtaactgtcttagactctaccacagtgggatgaacacggacccacaggtgtcgtaagaccctggggctcttttaagtcctcaaagccatttgaggaagtagacacaattgttgctacccctctacaagcgccggagcttacaccggagaaaagacagagacttggtagaggaccctcgtggctcctaagctcttaaggacacaagggtagccactggtgggtttaatttgcagcaagatgaaactaggaaaccaaattggttctctgtgccgtgtcgagatttgagatgctcaccagatttgccgaatcctctctggcggagcaactttacttttcaaagatccctagtattcttgggggacagagggggtgtggaggaagagacagtggtgtgctcttgaggtaagccaggatgcagacaggcccagaggtccttgggtgatgtacctgtgctcgggagttacctgctggccttgatcctgggcagaaagggctgccacttggtgaatgggtttctccactgtttctacagaggagcaccccaggagtcaggccacttgccttgtaactaactctgtgagccataggataaggcgctccatgtgagccctgccccgaagtccctgcttggaaagctgctatgggatcctccaaatggctcattggttaaaagtgctttctgtgcaagcctgacagtttgatcttaaatctggaaggagagatctgagtcctgaaagttgtcctctgaccacacatgggccgtgacacgtgtgcacctgtacccacacacgtaaaattagctttaggattgactcttcttgctaatgaagcatgaggactgtgacttacccacgcttgctttcgtataacctcaggaggtgaccgtgctgttcctctgctctgggactttaaattgctttttctatatgtgcccctaaggcaaggatgaagcacaggatagcccctcaccttccaccctgtgcgtattcttgagccagagtcctgaggattttgtgagttgggctgagagtcccaggcccttgcagacatctaggtccttgcaggctccttggagggcctctcttctcaatactgggttcctctttcctgtgcttccagaatgacgtgtatgaatgggcccgagatcaccgcgcccaccacaagttctcagaaacacacgccgaccctcacaattcccgccgtggcttcttcttctctcacgtgggttggctgcttgtgcgcaaacacccggctgtcaaagagaagggcggaaaactggacatgtctgacctgaaagccgagaagctggtgatgttccagaggaggtgagtagggtgtgggggttgaagctgaggctgtgacccccccgggaatgtacagtttacactgtctgcattttttattcggaattataaagtaaaagccgtgacttactgtgtccacatgttcagatcatttttaaaacgtatttttaacatcctgtagggcacagagagaaaccgattttcctccgtgcgtgttatcttataataggcaccagttaactgcaaaaaaaacccaaaaaccttgctcattgtcctaagcggggcaggacggccctgagtgcaatcgagagcttatcttgcaggactaagtggcctcctataagggggtgataagtcaaggagcctgagagtcaccatgcaagtcaggatctgtctagactggacagctgcaaagagcaggggcaggcttaggagaaagtggcattgaagccacagcacacagaggcatggcgggttccaggttccagggagaggccttgccggcagtgcagtgagctgaagggtgggtgttcaggggtgcagccgctgcttgaaatcccaggtgtgagagagaaaaagagcgatgatgaagacctatcgccaactcccttcctacagactcctccacacagacttaagtagttaagttagcaaccgaatcactaaaggcttctccagcagcgtgaggcagggagtgttgctcacactcttgggaagggcacaagttaggtggtaggaaagacttaagcagagaaacaaggagttacatgcaggggacttcctagggtgtgagaggaaaaggacacagcgagtcagtagttcccttggaaggatctgtggtcttgtgtacccgagggatagtgctgtggtctgtgtcagaggtttacagtttggggattggggaacagatctaggaacactggtagcaggaagtggaggcgtgccaccacatgctaagtgaagattccggtggtcatgagaggaaacaaaggcaggggctggaaagatgatggccccgctgtgaagagcactgactgctcttccagaggttctgagttcaattcccagcaaccacccgatggctcacaatcatctgtaatggggtctgatagcaacagtatactcacatataaaataatgtgagagagagagagagagagacagacagacagacagacagacaaaggcagcccagaaagcaatagggataacagggtcatttactgcatccatattccccccatctaaacagagagctaacagcacttgctctcaaatcttctaccacaggttttgggctggttccttctggtctttactcatgggacaggggagaaatcagccctacctgtaaggagtgtgagagttctctctccatgaagcctaaaatgtgtcatctcattgtaggtactacaagcccggcctcctgctgatgtgcttcgtcctgcccacgctggtgccctggtactgctggggcgagacttttgtaaacagcctgtgcgttagcaccttcttgcgatacgccgtggtgctcaacgccacctggctggtgaacagtgccgcgcatctctacggatatcgcccctacgacaagaacattagctctcgggagaacatcttggtttccatgggagctgtgggtaagtccccacagcaggaccacatctggtggctggcttcttagagattcttggccgggagccagaggaatgatgatgatgcgatttttgatatttcccactgtgagacttagggggggggatgggggatggtaatttattagggaattcttttgagaggccataacttctttggaaagggtgaaaatgtgcctgtgatgggaccttttgagttagttcttccgtttcctgattacctctgacagctcagggcagggatcattaatagaaaagcagagtcgtctccatgagtgtaagcttcatgtgttgatttagccatgctgtataaaagctagagttacaattcatttcaagtatgttcctggatagcatttttatctctagagtgcttgggcgtggcttatccattagtgacacctgtaggtgcacgttggcacatgttcctcgtcaccctgccaccctctgcccacctatcctctgtttttctgatttctcctgttttgtgctggagctccccttcgcacagggttgatctgggagtcctaccagatcagttgatcgtaattgttgggtccaagctataaatccaatcccagttgtcaggatgcatgcacgcatgcctctgccacctgtgccgcccacattttcctgttctttcaagttagttttccctatgcagacctgtggtttctttttcttactgataagagctgttggtcagccaacgacactgttcagattggtgcttgtatatcttggtacaacactcaatttagccagtttggatggagctagatatatctatatatctatacacacacacacacacacacacacatctatatattttgatggatatatatatatatatatatacacacacacacatatatatatatatatatataattatatatttaacttataagtacactgtaactgtcttcagacacaccagtagagggcatcagatcccattgtgagccaccatgtggttgctgggaattgaactcaggacctctggaacagcagtcagtgctcttaaccactgagccatctctccagctccaactttggatattattaaaagtatttttcctgggttgtcatgaagggtcagcaggtaaaagcacttacctgccaaacctgagcagcctgagtttgatccctgagacccacctcgtggaaggagaaaaccgactcctgcacgctgtggcactcattgtgcgtatgcagaaactcatacaaatactaaaagtacatttaaaaactgctcatgttctctttatgtttgaaataaattacctaaactctgcagcactgagatcctcttagagatggagtcacttagacaagatgtgtaggtcccagagtataaatggaactgcaatgcctttggtggtgtctgtctgttccgagtaaatgaaactgggtttagccattcactcacctgcagccctgattcccctaagtctgaggagcccactgggtaagaggcgtgggcagaggaggaagcactgagccccctctctgttctccttgcttctatttgcaggcgagggcttccacaactaccaccacgccttcccctacgactactctgccagtgagtaccgctggcacatcaacttcaccacgttcttcatcgattgcatggctctcctgggcctggcttacgaccggaagagagtgtccagggctgctgtcttggccaggattaagagaactggagacggaagctgcaagagcggctgagtgtggggtcttgcagttcctgttccagaagccagcttggcagaggcttactgttctgttaattaactactgagtattgccacccagatgctaaaatgatgactgacgttaacccattctggtacagtattgtaaaacggacaaaaatcggaagtcgacagctcttccttctatgctaagctcatcttcccttctagtttcttttcccgttgtctttttctttgctttgtccctgatgacctcgtttctcattgcttctcccaagccagccgccgctcagctataggtcagtgttcaccttccagagtacaccaacttctcaagggtctacagtaaaggttcgtgccccacccccaactcttcttaagctgctctgagttagaaatacaagaaaaatcttgagagatttctcctgttatttttagcccaggctttgccagatggaatgaaaaagaaaatagtttttatttggcagggagcctataaaagaggtaaatcttaaggggccaagttcaacacgcaggctatgattcatcaaagccgtgggagagggggatctcttatgaacaggctcagctccgtctggcagagctaccgcagcctttcaacatagcgcgcctcctctcctaattcttagtaggtggcaactgaggaacttcgtgacactaaaatacagtaacacatcagtatctcagtgtagtttaggctgaagatttaaaaaaaaaatatatatatatatactagtaaagtgaaaaacaatttgtaggaaaagtggtctttaataaggattttcttttcctttaatgacaaggacccggggccaggtgtggtggcttgcatcttaaattgcaggactggagaggcagaggcaggtggatctctgagttcaaagccagccagggctagatagtgagaccttgtctcaaattaaaaaaaacaacagttagcaggacatgcagagcaagggaccctcgagtgaggcatgtttggaatccgtagggcagtcgctcatggtttcgagcgtcccgtgagctgcacccccagggtctttttaattcctgttcttccatctttaagatgatggtcgtgcccacaaattgaggatagctgtggcgtttccatacatctaacagtggaaggatttcaagagttgaacttgagtcacagttaaaactgaaaagtcgtaaagtctgtcctggatccttacaaacactccgtgagtgcttccctcagaagacgatgctgcgcgccttctccctcccactgtcgggcagtggacgggcacgttggaagtcgctgtgggcgcctcctaatgacttctcaaaggaaagcttctgagggccccttaccaggggacttcacggctttggggtgttctagtggagcaggttaggttttttttagcccctttcagtcccgctgctgtttgtggcaaggcagtactgactcatgcctcactagctctgtgaccaggtaggactctgcctgggatacatggttgaaatctctcagctctaccacacctgcctcttttcccctacccattttttgtgttttggggtgggtttttttgttgtatttcttttttcctctttgacatttagtcttggtctaggcagaaatgtcctggatatttccaggcagtaaagatgtgtggtcctggcaccttcctcactcagagatacaacctctatctgcagtaggtagagacggctatccttttctggtgggtttcagattctccacctcttatccctcccaggcttctgacactctcttcagctctaaagaaaaagtttggccaactttctagaaacatccctggctcagagagactctttgtcagtcattccaaaacaaatggtttggtggcacacatgccggcgagtcagggcggacagagcatgcaccgtgctcccggcacttggcaaagcttcggcaaagcttcgcgggctaatcagccctcctgggtgatgctgtggttaagtgggaagcacagcactcgaggttgtgttcttaagtgcctctgtttgaaagctttgggtagggtaggagagctgagatgccatgaatttcacagaaaggctctcgtgcagcagtgcagaagcctggccgcgtcggctgtacagcataccaggtgctgtgcttcgaggggacagtcttcctgggctagttgaatagagagaggctttagggccttcctgtgcccacttgaaagtagccttacccttcagctgtttgctaaaagagaattcttgggcgaatccaaggtatttgctgagctgtggccctattctattccttggatatgccttttgagtgatttcagttccgctggttatggtgcccacttaaacaaatgtgaaaaataaaagcagctctcttcttagcctgccccgtggatctgaaccatgctgtggctaaggaccccgtaaaataacatctgtcgttaagggtgtaccagctcactaagaaacactgctatcaagatttttaaagctcaaaccaagtgacacttttaataagagactaagatctgattgagggagttttctaacagtccttgcctcgtggacacgctaaagtttgacttgggtgccttacctcttttctaaccagtgttgctcgtgagcctgtggcgctcgcttgctcgctcgctcgctcgctccgtggattccttaaaaccagagagcctgtaagtgtggcaagatcaaaactggcctggctggagggttagctggacatggatctgcaggattgcctctggggacctcgttttgggaacttttcttggggctgttttgctcaagtgcccgtagctgatggatgggtgaagtaattttgaacgtacgcgatttgtaggttttgttatttgttttaagatttaaaagctggttataggattttaagtgaaagcttttcttcctggtttgctagtgttcttgagtgtcttctttagttgaaataggttagtaggaaatttaagaaagtggtggccgtgttacactggtggtgaaggccagggccgcctaccaactctcagttttttgtaacagtcccactctgacgataatgagttcactccttggataaggatgttaatgagggaagagccttcccgacctgacctaatcagctcttactggacccagctgtcaacactgttgcattggggatttaagtttccaacccatgacttatgggacagattcaaaccgtagcactgggcatttcgcctaacaatactgtgactcagtattctgtgaaactgggataatattcctgacctacctccacgggtaggtgtgagcatgagaaaatgctctttataaaacatttggggatcctctgcagaggagtatttaagtcctgcacatttttgtagtaactgtccatcgtggacttgacatgtgcctatgtcccagatgacgttgttaatctacatcattctcagaggttgaatggatgcgtcagataatgtatactcactgctatgaaaacatgcaggactccgtttccttccttgggtgggatttttcctttattatgtgcaactgtagttatttgtaatctaataattttcattaataccaactccgaaagtatttctactcatctgaggttgtgtttgttcataataaaatgaaatgatctgactgcaaaatgtctcgtggtgttttggctgcaatacagcctcccaggagctgggtggtggcaacggtggcgcgcaactttaatcccagcaatagggagtcaggggcaggcagatgtctgagtttgaggccagcctggtctacagagtgagactcaggacaactagggctacacagagaaaccctgtcttaaatttaaaaaaggaaaaagagaatttagaagtcatgaggtttgagtcataccccagtaacctgccctgccttcggtgttatttgagattcatttctgggaacaggaaaccagtagtaagtggatattaaatcagaaacatcagctggcaccttggcttgacaaatgccaggtctttgagtagctcatggccaaacacacccagtcaacgaagcgtcttagtgcagatctttccttgaagctctggttgggcagtccagctcattcttaggaatatcctgtctttagggaacagctagcctctcaaagtgctgatgcctgaaggaaagccacccagggaggggttcaccatcacaagatgggaaaggcagggcttggtttccctccttatgtccttctctgtagccttttctgcttcctctgcggttacttagaggctaccaaaagggaacacgggtcgggtcgtgcaagactgggctcctagttcacctcaatccctgagtctgtttttacctaagacatccattctaaaggactcttgtaaggtcatggtgccagcctgtgattctagctacttgagggagggaggaagagagggagggaaggcctggaagttcaaggcctgccaggcaacctagtgagattgcctcaaaatttaaagaaataaaggggaccggtggagtcagtgaaggtgtgttccttagcaactctacagggctcagtaattctgaatcccgaatcagggactgcatgctgactctttgccagtccttaagagccaggccaacaattgttgcttcttgttcaagggtaaagatcccctgaagatagcaataaattcctttgggtggtggtggttttgtaggagaggctaatcttaggttaaggtcctagtgaaatcaaaccatgtcacaaaaggaaaagaaacacttcaaagatactgatggagacaagagtagattgcctgatgcccagtggctaccagttttctacttccacagagaaaccgggaaatgtcctccaaaatgtctaccagggcaggaaaaggggaagaaataaaaccaagtcacacatgtaactattggaagctgttgatatattgccagaaaaaaggcaaatttacctccataaactagcaatggataatttaacaatgacacagaacgggatcgccacaaaatcaaaagcagtaagtgttatgcttaagtaccccagggtgctgcctggagaagtgggtcgggtggtcatacctctgatcccagcacttggggtatggggatcccgacaggtaggtggatctctaaggccagcttgacccactgtcatgagcaccaggccagccaaggcaagtagtgaaaccctctctcaaaagtatcaagtactattgaaggaaaacacaaggggaaaaaaaataaggctaagtaacgttataggtgggaaggcttagtattgatggtagtgctcccaaaacagacttgccaattcaagacaatccttatcaagtaatgttccagtgaggtagatgaatatatagattataacattcacaggggaattcaagagacccagaatagacaaatagaaaacatgcacacgtgcacatacaaagatggatgaaatttattctttcaaactttcttcaaagggccattaataaaagtggataaatccagaccaagtggggttgaaagtagacatttacaattaacagatacttggcaagcattcagatggctcaactggtaaagagaatcttctagcagagttaaacaagtgaatatccgcaggtaactgttactattgttggcccaccacgtcatatcacacacagctaggaactcaaatatattatgtaaagctaaaattccctgaggagaaaacactggtgtgcacagatgataatttcttatgacagtagaaacaacgaccctttttaagtgttacgaattcggtttcgtcaaagtagaggctttaggtcttcaaaagataccatcaggtaactgagaaggcagatggggatgtgtgagggcttagtgctgagagtctgtgaaatgcatgctttcattctgctgttagcaagactgagtcaaatcctgcctggaagcaagagctgtactgctgagcaagacccacagcaaaggaacccttacaggtcaacaacaaaaagacgacagggataccatgctacatatataatatgtattatggtatatatataataatacatatataataacaataaatacctgctattagaaataaggcatttgagtagacattcatgaccagaagacccacagatgggcaaaaaagacatggaaaggtacttggtattagcagccctcaaccccgtactaagcagcgtactgaaatacctcatttccactaaaataactgtaataaaaacataaaagtaaaaaggaagtgttgctgaggatgtgaacagacagagacactcactcgctgcggatgaaaatctgagattgtgcgtctcctttggaaagaagaccagccatctcccaaatagttagcaacaagcaggcacggatcgcagacacacttctaggcatccacccaaaggatgtggaaagatgtgtccacacaaaaacttgcacatggggctggtgagatggctcagtggttaagagcaccgactgctcttccgaagatcctgacttcaaatcccagcaaccacgtggtggctcacagccatctgtaatgagatctgacgccctcttctggtgcatctgaagacagctacagtgtacttaagatataataataaataaatctttaaaaaaaaaaaaaacttgcacatggatgtccatacctgcattacatcacagtacaaaagcagaaacaatccaaacatctatcagcagaggtgtaaacacaatgtatttttaagacagtgcagtatttctcagctataggaatgaagtacaagacagaccatttttctgactcagaccaaagaggtacttcaggagtctatttatatgaagtgtctgaaacaggcacatctagagtcagaaggcagattgggagttaccaggggccagagaagaatggaaagtaatgagccctcttacggtgaataacatttccaaaagatacattgtgatggttgcacaactgagcaaatatgctaagatagctgtagggtttccattgctgggaacagacaccatgaccaaggcaactcttctaaaggacagcacttaattggggctggcttacaggttcagaggttcagtccattatcatcaaggcaggagcatggcagcatccaggcaggcatggtagctgagagtactacatcttcatctgaaggctgttagcagaatactgacttccaggcagctaggatgaggtgacacacgtactccagcaaggctacacctccaaattagtaccactcattggaccaagcatattcaaaccatgataatagctaataatttttttttaagttttggtttttctagatagggtttctctgtgaagccctgcctggcttggaactctttgtagagtctgacctcaaactcagagatccacctgcctcttcctcctgagtgttgggactaaaggttttcgctacaatgccctggcttagtaactataaatttttaaggtgcaatttcggtttatagattatttgtctaataacagacgttaaatgagaagggcactttgtgttggattgtttttagtcctaacagagcctgaggttggattgcaaatgtaccagaaagcactggtgaaaaatcacgtcttcaatggaaggacattctctcttctacattctaattcaacagtgaagtggcttccggactttaaaaaaaaaaaaagactaagcatgtgaccaaaagcagctgctataatgtagcctgtgagatgataatcttgccccatcaaattacagtggttggggaaagccagatacggtcttttctgtaaatgaaagggcttgtgccaaactcaaacacaaatgcagcaccttttgaaagacagacatcaagctcgcaggctggaagatgcgatgattgttagcattctgtctaaactccaccccacagttacctagcaacagtcagacaggcctagcccactctaagaggggctgcttgccccctcctccctctcttactcttgtttccctcttatttctctcttgccctcttgggatcttcccttctccattcccttcccacctctctccatgagctcatggccgtggccagcctctacttctctactctctccctctctctgcctttctctgactctattacccttctaactcccctccccatgccctaaataaactctcttctatactataccatcatgtggctggtccctcaggggaagggatgcctcagcatgggcccgctggggcacccccttcccccacacctcaccacacccccatagaacacatcctatacctccttatctttttataaacacatcagtgataatgccaggatcatttctctggtcaggcactaagctaaaggctggaggatgtctcatctcacatcagaagcaagagatgggagcgcctcagagtggtagctgagttcatttagaggcagcaggagtggtgtggcgatactgcagtcaggctccacagaatccaggcaccctctccctgcatgagcttactgtgttctggaaccaaacaatctatccagctcccattcttgctgtgacctaccacaccccagttttacacccacctctcagaccacataaatagtgctggcattttctctcctcgcaactacagtctggctgcctgtaaaggactgagcactattataactaagggcagcttccattaattgcaaatgtctccctgcacttcaatagtggcgctcagtggcaaatgtcacgggaagtgggcgttctcttcggtgacctgtgcttaatgttctatgcaacaaagaaagcactgagttttggacaatgaattctgagcacacgccataaatcccaaagataaactccctaagggacagagattctgccctgaagttgctggaggcagaaagagccctcctcctctggtgagcactcctcccacgctatctgcccggggaacagcagagagctcacaaaagggcagtgtgtgctgtgctgactcatggtgattttggtgctggggacatccaagagtccattggcatcttggccattttccactgagaacaatgagtagtcagggtcaggccttgaaagactttgtgaacaagaacagcaaacgagagaaaactggttgtcaaaggcatggcaggcccagaaccacgcctggctgtattcttacgatttctttttttcttttttctttttctttagaagtggagggtgagggtaagaattctcctctgagactctttgggttagttatgcctgttaactgaagcagcatttctttggcgtagaagcaacttacactgtaaaaataaggctctgtttactcttgccatgcttgtaagatgccctggattgcgtccccaacactggaaaaacaaaaacaaaaaacctaactaagtgaataaatgacatcataaaagcatcattttaaaggtcccaaatccatgaccatggcgcatgaatttatatacttatactgtttagccaccgccatttattactattattagttattaattaatcacctggttttcagacaaggtttctctcagtatccttggctgtcctggaattcagtccgttagaccggactctctctctctgcatctctagtgctgctataagagatgtttatcactatactgggcctcatctttagttttaaaaaaatgtcattatcctcaccccaaaaggaaacactattcccattcgaatgactcctcatgaccctcccactgtatcaacaaccaatatgctgcctatgaatcggttgttgtttatgtcggagaaatagccatactgtgtgtgtctggtagcctccctgcatgacattctgtgtgtctctttgtaacaggtcccccaccgtcccccccccccccccaccaacctggtccttagttggctcccaaatcttaacacaactaacatggtgaagtgatagaagtactattcaggtcatggaacccagcacataggcagcaccacccgccaaaatgaaaacaaagatctaattcatcaaaggccatagctctgggaagtctgtaaatgtactagccttgctttttggcttctgtagttccccttctggctaactgttcttgctaaatgtgtcaaacaaagacatgttttgtattgtgtgtgtgtgtgtgtgtgtgtgtgtgcttaaaagcttgccctgagagagctgaagagatggcacagcagttcagagcattgaccgctttgcccaaggttttaagttcaattcccagcaactacatggtggctcacagtcatctgtaatgggatccgatgccctcttctggtgtgtctgaagacagctacagtgtactcatattaaaaaaaaaatacaaaaaaaatgccataagccgggcgtagtggcgcacgcctttaatcccagcacttgggaggcagaggcaggcagatttctgagttcgaggccagcctggtctacagagtgagttccaggacagccagggctacacagagaaaccctgtctcgaaaaaccaaaaaaaaaaaaaaaaaaaaaaaataataataataattaaaaacaaacatctcaccccgagaaaggctcaagtctgtaagtaccagctagctaatagactttctactggcttaaatctgtgtctaagtcatttctttgatttatcttctttgatcgattcctaacattttcacactggcacaaatcagtttttaactcctcattatgattaacagtccattgtatttatggggagcagttgagttgtcccccccctttcggcttctatgaatagtatgctctgcacatttgtgtgtgtatattctagcatctgctctctgtcgatttgtgtacacaggaatgggatttcttctgtaataattctgtttaactttttttttttttttttgagtaaacagttttcaacagcagtaatggacagtgtcacccacccttcaccataacatttctccttttttttttttttcttttttcttttttctttctgctttcggggaaggccagaccccatggagtaaagtggaagctctgcttccagtagcaagattgctttagccaaagcctcaaaccgtgcctccaacctcgccatttccaaaagcaggcagtgtggctacctccctggatcactaacgcacctcccaccccactgccgccaaacacacatacacagccctgtgacatcataaattactgtcctggtgaccgcacatggagccctaccaaactccaactcaggttaagctgagtgcctgaaatagaagcaacatgcaacgctcttcctccagtcctggccctctgccagtgcctgcccgggagaggtccagctagggtgaggaaaagcaagggtcaggcgtgcgggcccctcccggggttactctgggttagcattggccccagattcactcgcgttcaccaggcccaaagcgcctgacccctcgcagccaatcagcggcctcaccgggctctgcacgcatcgctccaatcaggatgcgctgctcctgaagctagccggtgtaccttgcagtcacagatggaggctagcccagtccctgacctcccccacccccgcctccgctccccggaccttgaatgtgggctctggtcgccagctttcgccaaggaagggggtgggggtgtgtgctggcaaagcagcgcacgtttttttttgttttttgttttgtttttttccatctacgtagtgcaaacgcttatggaggaggaggcagagcgctaggacttagcaaaacagacctcagattgggttatggtgtagaggagagcactccgaaaagcacagctttaatgtgatcaggaactttccaggctgatgtcagcaggcatgaaggggcgtggagtgggcagtgggaggagaaaatgcaggggaggcggtgagagtctggaaatctcgatatttaagaaacttattgtgatggcagaggggaccacaggggctggaagccttatttccaggctttgaaaagactccggtgagggcatggggaaggaaaaggaaggacacatctgtaaagtatttttggagcagagtagacattcagatgctggaatggtgaagtggatgcagggtgggaggggcacccatgacaggcttttagctcgagtcgctctgcaggggcagcctctgcaccaacttaaaataagaagcttgaaacaaagcaggcttggactgggagcgggaagttagtatttaacacgggagtgggagttgtacaaagtttgctgggattaaaggcagtaatcaccacacataatcttaacgtgcccttaaatgtggcttgcaagaattgcattgagaatttttttttctgtctccatgttcatcaggggaaaaaacggctgacaattttcttttttaaaaatgtgtgtgctctgaaccagtttttatatcaaggtaatgcagacttggcagggtgaacttggtagtgttctgtataccatatgaaacagtttaaggagcttggttattacctcttccttaaagatttgataaaactcggcaacgagtcagtctggtgctacattttgacttttggggaaacttttggttactgtctcagtcttgttgactttttaaaaaaatgattttagagctttattatagaaagacagggggaaagagagaaggtagaaaagagagagaagaaaggctagagaataaagagggagagagaggagaggagaagaaaaaagagagaggagtgaggagtaagagccgtcttgttgattgttatgaatccattttaatcgtttatgtccttttggcttgattttgtgagtcctctatgactaggagtttatttatttcttcaatgcctgctaatgtattgccaatgatcatggaactgaagatggttaaaaactactttagaatgttaggaagtgaagctggtgcacgcctttcattccagcactcgggaggctgagcaaggtggagttctgagttcgaggccagcctggtctacagagcgagtaaaataaataaaaaagactgttaggaagttaaaagctatttaaggagcacgtgggaagaatgagtgaatgggatgaagacagtgggtagagaaagggaaagactagagagacaatggatgaaagaaggagaaagaagaggagggagaggctgttgagggaaaagagcaggagactggggaaaaaataaagagaaagaacaaacacaaagacgacccaacagtataaaaaggtgttgctctttaaagatttaattcacattaattttacgtatatggatgctttgcctgcgtgtatgtctgtacctggtgctcaaagaggcagaagaagctgtcagatcatctggaattggagttacagatggttgtgaactgccatgtgggcgctggggatcaaaccctctacaaaagaaacaagtgctcttaacagctgagctatctccctggcccctaaaagaagcgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8 - DNA, 5037 bp, Mus musculus
attctgactcctggacaccggtggctgcaagctgcgattttggcgtcctctcattttctatccttatctccgcccgcggctgccctggccagccagtttttgattttttatctggtcattgatcaatataacgaacctaaggatatacaggacattaataccccactgccagctctggcccagagcttgtaccgcgcagcgggctgcagaaacttagtcatagcaccctttgtcgctgaggtctgaagctcgctgcacgttctcatccctgggaacgtgaccccagcatccgacgccaagatgccggcccacatactgcaagagatctctggcgcttactcagccaccaccacaatcacagcgccaccttctgggggacagcagaatggaggcgagaagtttgaaaagagttctcaccactggggagcagatgttcgccctgaactaaaagatgatctatatgaccccacctatcaggatgatgaggggcccccgcccaagctggagtacgtctggaggaacatcattctcatggccctgctgcatttgggagccttgtacgggatcacactggttccctcctgcaagctctacacctgtctcttcgcgtatttgtactatgtaatcagcgccctgggcatcacagccggggctcatcgcctgtggagccacagaacatacaaggcacggctgcccctgaggctcttcctcatcattgccaacaccatggcgttccagaatgacgtgtatgaatgggcccgagatcaccgcgcccaccacaagttctcagaaacacacgccgaccctcacaattcccgccgtggcttcttcttctctcacgtgggttggctgcttgtgcgcaaacacccggctgtcaaagagaagggcggaaaactggacatgtctgacctgaaagccgagaagctggtgatgttccagaggaggtactacaagcccggcctcctgctgatgtgcttcgtcctgcccacgctggtgccctggtactgctggggcgagacttttgtaaacagcctgtgcgttagcaccttcttgcgatacgccgtggtgctcaacgccacctggctggtgaacagtgccgcgcatctctacggatatcgcccctacgacaagaacattagctctcgggagaacatcttggtttccatgggagctgtgggcgagggcttccacaactaccaccacgccttcccctacgactactctgccagtgagtaccgctggcacatcaacttcaccacgttcttcatcgattgcatggctctcctgggcctggcttacgaccggaagagagtgtccagggctgctgtcttggccaggattaagagaactggagacggaagctgcaagagcggctgagtgtggggtcttgcagttcctgttccagaagccagcttggcagaggcttactgttctgttaattaactactgagtattgccacccagatgctaaaatgatgactgacgttaacccattctggtacagtattgtaaaacggacaaaaatcggaagtcgacagctcttccttctatgctaagctcatcttcccttctagtttcttttcccgttgtctttttctttgctttgtccctgatgacctcgtttctcattgcttctcccaagccagccgccgctcagctataggtcagtgttcaccttccagagtacaccaacttctcaagggtctacagtaaaggttcgtgccccacccccaactcttcttaagctgctctgagttagaaatacaagaaaaatcttgagagatttctcctgttatttttagcccaggctttgccagatggaatgaaaaagaaaatagtttttatttggcagggagcctataaaagaggtaaatcttaaggggccaagttcaacacgcaggctatgattcatcaaagccgtgggagagggggatctcttatgaacaggctcagctccgtctggcagagctaccgcagcctttcaacatagcgcgcctcctctcctaattcttagtaggtggcaactgaggaacttcgtgacactaaaatacagtaacacatcagtatctcagtgtagtttaggctgaagatttaaaaaaaaaatatatatatatatactagtaaagtgaaaaacaatttgtaggaaaagtggtctttaataaggattttcttttcctttaatgacaaggacccggggccaggtgtggtggcttgcatcttaaattgcaggactggagaggcagaggcaggtggatctctgagttcaaagccagccagggctagatagtgagaccttgtctcaaattaaaaaaaacaacagttagcaggacatgcagagcaagggaccctcgagtgaggcatgtttggaatccgtagggcagtcgctcatggtttcgagcgtcccgtgagctgcacccccagggtctttttaattcctgttcttccatctttaagatgatggtcgtgcccacaaattgaggatagctgtggcgtttccatacatctaacagtggaaggatttcaagagttgaacttgagtcacagttaaaactgaaaagtcgtaaagtctgtcctggatccttacaaacactccgtgagtgcttccctcagaagacgatgctgcgcgccttctccctcccactgtcgggcagtggacgggcacgttggaagtcgctgtgggcgcctcctaatgacttctcaaaggaaagcttctgagggccccttaccaggggacttcacggctttggggtgttctagtggagcaggttaggttttttttagcccctttcagtcccgctgctgtttgtggcaaggcagtactgactcatgcctcactagctctgtgaccaggtaggactctgcctgggatacatggttgaaatctctcagctctaccacacctgcctcttttcccctacccattttttgtgttttggggtgggtttttttgttgtatttcttttttcctctttgacatttagtcttggtctaggcagaaatgtcctggatatttccaggcagtaaagatgtgtggtcctggcaccttcctcactcagagatacaacctctatctgcagtaggtagagacggctatccttttctggtgggtttcagattctccacctcttatccctcccaggcttctgacactctcttcagctctaaagaaaaagtttggccaactttctagaaacatccctggctcagagagactctttgtcagtcattccaaaacaaatggtttggtggcacacatgccggcgagtcagggcggacagagcatgcaccgtgctcccggcacttggcaaagcttcggcaaagcttcgcgggctaatcagccctcctgggtgatgctgtggttaagtgggaagcacagcactcgaggttgtgttcttaagtgcctctgtttgaaagctttgggtagggtaggagagctgagatgccatgaatttcacagaaaggctctcgtgcagcagtgcagaagcctggccgcgtcggctgtacagcataccaggtgctgtgcttcgaggggacagtcttcctgggctagttgaatagagagaggctttagggccttcctgtgcccacttgaaagtagccttacccttcagctgtttgctaaaagagaattcttgggcgaatccaaggtatttgctgagctgtggccctattctattccttggatatgccttttgagtgatttcagttccgctggttatggtgcccacttaaacaaatgtgaaaaataaaagcagctctcttcttagcctgccccgtggatctgaaccatgctgtggctaaggaccccgtaaaataacatctgtcgttaagggtgtaccagctcactaagaaacactgctatcaagatttttaaagctcaaaccaagtgacacttttaataagagactaagatctgattgagggagttttctaacagtccttgcctcgtggacacgctaaagtttgacttgggtgccttacctcttttctaaccagtgttgctcgtgagcctgtggcgctcgcttgctcgctcgctcgctcgctccgtggattccttaaaaccagagagcctgtaagtgtggcaagatcaaaactggcctggctggagggttagctggacatggatctgcaggattgcctctggggacctcgttttgggaacttttcttggggctgttttgctcaagtgcccgtagctgatggatgggtgaagtaattttgaacgtacgcgatttgtaggttttgttatttgttttaagatttaaaagctggttataggattttaagtgaaagcttttcttcctggtttgctagtgttcttgagtgtcttctttagttgaaataggttagtaggaaatttaagaaagtggtggccgtgttacactggtggtgaaggccagggccgcctaccaactctcagttttttgtaacagtcccactctgacgataatgagttcactccttggataaggatgttaatgagggaagagccttcccgacctgacctaatcagctcttactggacccagctgtcaacactgttgcattggggatttaagtttccaacccatgacttatgggacagattcaaaccgtagcactgggcatttcgcctaacaatactgtgactcagtattctgtgaaactgggataatattcctgacctacctccacgggtaggtgtgagcatgagaaaatgctctttataaaacatttggggatcctctgcagaggagtatttaagtcctgcacatttttgtagtaactgtccatcgtggacttgacatgtgcctatgtcccagatgacgttgttaatctacatcattctcagaggttgaatggatgcgtcagataatgtatactcactgctatgaaaacatgcaggactccgtttccttccttgggtgggatttttcctttattatgtgcaactgtagttatttgtaatctaataattttcattaataccaactccgaaagtatttctactcatctgaggttgtgtttgttcataataaaatgaaatgatctgactgc

SEQ ID NO: 9 - protein, 376 aa, Mus musculus
SSLHVLIPGNVTPASDAKMPAHILQEISGAYSATTTITAPPSGGQQNGGEKFEKSSHHWGADVRPELKDDLYDPTYQDDEGPPPKLEYVWRNIILMALLHLGALYGITLVPSCKLYTCLFAYLYYVISALGITAGAHRLWSHRTYKARLPLRLFLIIANTMAFQNDVYEWARDHRAHHKFSETHADPHNSRRGFFFSHVGWLLVRKHPAVKEKGGKLDMSDLKAEKLVMFQRRYYKPGLLLMCFVLPTLVPWYCWGETFVNSLCVSTFLRYAVVLNATWLVNSAAHLYGYRPYDKNISSRENILVSMGAVGEGFHNYHHAFPYDYSASEYRWHINFTTFFIDCMALLGLAYDRKRVSRAAVLARIKRTGDGSCKSG

SEQ ID NO: 10 - DNA, 37698 bp, Homo sapiens
caattgcagctcactgcaacctcaacatcccaggcttaagcaatcctcctgtctcagcctcccagatagctacgactacagggcataccaccacacctggctaatttttgtattttttgtagcgacatgttgcccaggctggtctcaaactcctggcctcaagtgatcctcccgcctcagtctcccaaagtgcttggattacaggcatgagccaccgcacctggccccatgtctttaaagagatcctttttgggcccaggcgcggtggctcacacctgtaatcccagcactttgggagcccgaggtgggccggatcacctttgggagttcgagaccagcctgaccaacatggagtaatcccgtctctactaaaaatacaaaatcagccaggtgtggtggcgcacgcctgtaatcccagctagtcaggaggctgaggcagaagaatagcttgaacccaggaggcggaggttgtggtgagctgagattgtgccattgtactccagcctgggcaacaagagtaaaactccatctcaaaaaaataaaaaagttcaaggagggttctgatcaatgaaaagcttttggatgtttagactagaagatctcaggtgaccttggaaagtaagaaggcttttgatgcctacagatttgggggaatgaaggtgtacagcttcaagggtaagtggtgaggcaatgaaaaaagtggctcaaaaaaaaaaaaaaggaattacaaaaaaaaaaaagaaaaaaaaactggctccatttaacaacactagtaatttattaaagatctgttgagtacctactgtgtgaccttctttcatatcggtttggggatatcctaagaaacggaaacaaccatcctcatcttcacgtactaaaagcctcacccacttcttcttatggtgctgattttaaaacagctttattgagatagagtcacgtgccataaaattcacccacttaaaacagacaattcaatggttgtagtacattcacagatgtgtgtgactatggtgctttttttttttttagacagagttttgctcttttgcccaggctggggtgaagtggcacaatctcggcccactgcaacctccgcctcccgggttcaagcgattctcctgcctcagcctcccgagtagctgggattataggcgctcgccaccatgcctggctaatttttgtatttttagtagagacgaggtttcgccatgttggccaggcttgtctcgaactcctgacctcaggtgatccacccacctcggcctcccaaagtgctaggattacaggggtgggccacagtgctcagccgactatggttttaattttaaaggaggaaagtttgggaattaagtttggaagtcaggatttttgtaatttatgctgtaaatgagagagggagagaaccccaaccagcagaacaaattcttcactcctaccttcaccagcggaatcaaaggacccagtgggaggccacaaaggtgctttacctaccagggccactgggtggcagcaggaccctggccccatatatgtcaatatggagagcctgctcttttctggatgtagaagagcagataatccagtttggaggggctgagccttcagaggggcctcaatctagagaccacttttctccacagcttcttcctataccttacctttttttttttccctctggataactctgcaggttcagatctgggccggctaacaggtcctaaacccatagggctttatcattctagaggtctagtaatggcccctattaaactggctcctctgagaagcagacactaaggctgggcaactatgtgtggtttttcatgggggaaacatctatgagagaaaacagggagctgagtgaggctgacagcgctgtcagagagtgaggaaagtcctgcctgagtgaaggagatagggtaggaagattgggagggcagctgtggcatagtcaaagagaggttcagtgaaaccttctgggagccacaacaggccatcgggagttctgtgtcccccaagaatgggcttgccttcacatccctgccacacttagctactggtgaggctgctctaggtgggagcaggcctggggcagtatgacccaggtgaacatcttggtcagctgccctacctgtagtctgcggtctctgaggcccattcgcactgcctccatgccttcctttggagaaatgacagcctcagccctccggggtttctatcaagtgccacatctgctctccacctctcagggagacaactgaaccttcatctctcacctcatgtgctgatttcacttcccaatttcatttccttctccccatgaccccaccctccatcatggctcctcccatgccctggatgagactctgtgcctgctcctggaagcgttcaggcacactcaccctcccaagcaagccctacatttccattcctctgcctttggctgcttcttgcttagaagccctaaaacatgaaggaggtaatggtattacctgaatggtggcttcagcccggatcccaggtgtcagcctgccctggctggaagctagctggccagcaccaggccccatccctttcctggggtccctgtttctcaagtgaccatctatcctctggtgccagagttggtggtgaggtcccagactcagctgagcctcatagacctccctgaactatgcgataggcagccatagctttgccaggtggctcagagagccaagcagctcttggggatcagaaaaaagacattgacacttggctggggaaagcagaggtttggtaaagtgaatgttagagggaaagaatgatgggttcttggcgtgttcttgggaacaacagggtccacagccccctttggggttctcagtgctgttgaggctgcaggaactgaggtagggctgaggggcctgcagtgcctggggctccaggcttcgctcctccatctccctggctggtcctcaactgcaggcttaggaaggatgggataaaggtagttggctttctgggctgctgcctgaaaggaggacatggggacaccaaatattctgcaagaacgtatctgggccagatgacattgcaaatccagagtcccttaggacatgagaagggaataactctggcctttaaaagggaatccagccaaccccgggtgtgggaggagcagaataacagcatggaaattcaccttgattacattaatttacaccttagatgctgaaggtaaagctgagggctagcatgggattttccctttctctcttgggtagggagagatggggaagaaaggtggagttgggggctggagtagaaagatcaagcttttagccgacctggggagccttccagaatgtaacttgcccagaggccaggcctcctaggtactagggtttatgcagcagggaatgtgatcacgggggaagtggtgagtggtggcagggcaggggagaagcagcgcccagcaagtgtccttctgactttctgctcagcatgtttgttctgtggctggaaagaatgagttactagacaaaacatatgaagtacctagtacgcacctagcagatgttaggtacagacaaatccccatcacatcccccacctcagtgctcccaggctggtacaacttttctgagccttgcaaaatacaggtaaatatgtgggtaaatattagtagattatcaaagcacctagcacagtgcacataaatagatgcttaaataaataaaaataaattttaaaaaaacactaaatgactctgtcaccagcccattctcttcccctacccgattctaggggcacctcttaggaagggcgcccctctctcttccctgaactccgaccctgtttaatatagtatgtttacactctgccttcatcagatgctagcctgcccagtttgctattgtgctttgtcctgtttctcttagaaatctgtgagctccccaggggtgggagcagaactttggctccattctcccccacacagcagagaattgactttccgctgggcacaggggaggctcagtcaacactctatccccatgtggctacgttggcttagaggcacagaatgggagagaagcaggctcttggctgaggaaaagccctgggcgagcactgagggaagcttggcctcagacatagccagctgccctctggacctcgcagccctgctgtgcccagctcagctgctgtgtcagtgcaaagccagggtgacatcagctgtgggagaggttactgtcaggcaaagggaaggccaggagagagatggctggctggggcacgaggctagaaggactcaggaaacagttcccttgtaggggaagcagcagcttgggaggggcagttgggaggagagaagcaaaaggggtgaagggccaggaatggccagggcctgcctgttcctttcacctacagcagggagagaggcatgggttcagaactctggaagagagtgtgaccttcctgggagcactcttagcaactgcaggaagcaaatggggatttacctctctacgaccaggaaggcaacacaggagccgggcacggtggctcatgcctgtaatcccaacactttggggggctgaggcgggtagatcacgaggtcaggagttcgagactggcctggccagtatggtgaaaccccatctctactaaaaatacaaaagttagccaggaggggtggcatgcacctgtaatcccagctacttgggaggctgaggcaggagaattgcttgattctgggaggcagaagttgcagtgagccaagactgtaccactgcactccaacctgacaacagagcaagactccgtctcaaaaagaaaaaaaagaaagaaagaaagaaaaaacgcgggggcaagctgctcttctctctttactttggctcagaagctgagtcagggcaagagagactttcccttcagcttgtttatttgttgttggaggccctaggcctgtgtttgcttttcctctccatgtgttcatcctagatggcttgctcagaatggggtagccttccaggctggggaaagatcccctatgggcctccagaggagggagggagtagtctgtggcctgggaaaaggcatctttgtaaggtcagaccactgcagaaatctctggccctggtcctggtcctaagacatttgtccccaggcctcatctgctgggactgtcagtacccatctcacacattctgccctgagacataaactgcttccagtcacacgcactatctgatctgaggacgtaccccagggccccagggataggtaacaataagttggtggaggcccgtccgccagtatgcatacctgtgtgtgcagacattcccgtgtgtgagcacacacagaaagggctggagtgagaggaagatcatggctctgtggatagtgtggagagacagatgtctgccaacagagggaggtgtggggctagtgcactggcctcttctctaccggggaaagacgtgctacaccatctatccagcctggggcccaggaggagccatattcaagggtcctcgttcatagtatatcaggtcagtcttttcctcctctaggtctctgaacttgccaactgcccttctccacactcacccttaatggtcccttcggatttagcaccgtctcctccgggaagtcttctctcgttctctggagctggtctggagtgtacctttcctctggagcctatagctcaatcatctagagttataaagatacagtggctgacgcctgtaatcacagcactttcggaggacaaggcaggtggatcacttgaggtcaggagtttgagaccagcctggccaacatggcaaaatctcatctctactaaaaatacaaaaattagccgggtgtggtggtgcacgcctgtaatcccagctccttgggagcttgaggtaggagaattgcttgaaccccagaggtggaggttgcagtgagctgagatcgtgccactgcactccagcttgggcaacagagcaagactccacccccaccccccgggttcaagcgattgtcctgcctcagcctgcctcagcctcccaagcagctaggattataggtgcccgccaccaccctgggctaattttttgtatttttagtagagacggggtttcaccatgttgcccaggctgatctggaactcctgaccgcaggcgatctacccgcctcggcctcccaaaagtgctagcattacaagcgtgagccaccatgcccagtctttagtttttttttttttttatacttttcttattgagatataatttatataccatagaattcatccatttaaatcatacaatttaatggcttttagtatattcacaggttgtgcatccatcacaatccattttagaacagttttattactccaaaaataaaccctgcattccttagccatcaccccccaacatcctccatcctccttccaagccctgggcaaccaccaatctactttctgtctctataaatttgccaattctggacatttcatataaatggaagcaaacaacatgtgagactttgtgactggctgctttcacttagcattctatttttaaggctcattatgttacagtacttagcagtacttcattcttttttattctcaaatggtattccactgtgtgggtatcccatatcatattattagagacaggttctcactctgtcacccaggctggagtgcagtggcacaatcatagctcactgtaacctcaaactcctgggctcaagtgatcctactacctcagcctccagagtagctaggactacaggcacacacagccatacctggctaatttttttttttaattttcattttatgtattcattttctttcttttttgttgttgttgttttgagatagggtctcactttgttacccaggctggagggcagtggcatggtgacagctgagcagccttgacttcctgggctcaagtgatcctcctgcctcagcctcccaagtagctgggactacaaacacgtgtcaccatgcctggctgatattttttttcttgaaacagggtatcactctgttgcccaggctggagtacagtggcgtaataatagctcactgcagcctcccctcctgggctcaagcaatccgctggcctcagcatcctgagtagctgggactacaggcttgtgccaccaggcccagctaagttttaaaaaatgatttttggtatagaggaggtcttgctatgttgctcaggctgtatttttattgttgagacaaggtctcactatgttgccatgatccccccacctccacttcccaaagtgctcatcttatctgttcattagtcagttgacagacatttaggttgtttccactttttgaccattatgaataatactccagtgaatattcatgtatacatttgtgtgggcatatgttttcatttctgttgggtttatatctaggagtggaattgctggatcccgggtaatattttgacaggcagagttcaggggaagaaaaacttgggaaaatgaagcatgtttagaaatcagcaagagtgcaggggtttttcggagttttattttatattctgttgacaaatgtgcagtttgatgaagatacaagttatactaagtgagaagtgagaattaaggctggaatagggcgttcagagtaaaatcatgaagcactttgaataccaaaattaaggagcttggctgtaaacaaaataataaaaaatcacaattttttttttttttttgagaaagagtcttgctctttcaccctggctggagggcagtggtgtgatctcagctcactgcaactttcgcctcccgggttcaagcaattctcctgcttcagcctcccaagtagctgggactacaggcacttcccaccatgcccagctgatttttgtatttttagtagagatgggatttcactttgttggccaagctggtctcaaactttttgctgtcataattgttgtaactattgttccttttgctgaggtagggcccccagaccaaaaaaaataaatcttagaatccaaatcagtgtgttggtttgaccactgtcacttgagaaccacagtgtgaccagggcctcaggagtagaggtgatctctgctcgaaagagaaatagaatgaaaatattctccgggccaggcgtggtggctcatgcctgtaatcccagcactttgggaggccaaggcatgtggatcacctgaggtcaggagttcaaaaccagcctggccaacatggtgaaaccccgtctctactaaaaatacaaaaaattagctaagtgtggtggcgcatgcctgtaatcccagctacttgggagggtgaggcaggagaatttcttgaacccgggaggcagaggttgcagtgaagcgagatcacaccactgcactccagcctgggggagagagcgagacttcctctcaaaaaaacaaaaaacaaaagaattaagcaaattagacattgcagagagaacctgaagggggtcagaccacgtacagatttctgtgccacatgccaagtacttctgaggcatgactggatgagctgtccacatctgaaatcatccagtcttgttcagaactttcacaccggacagggagccaggactggaatgcagtctcctggtcactggccagagagttggcctgaccctgagaccagtggccaacaaaggagctgcttagtctacctcccaggaaatcccaggtgcttgtcttcctgggaagtgaatcattggcgcagcactccgtattttctcctcttcccaggggaaggatcctagggcagtatttgggaaagacatgggcatggaaggacaccgggtgaatgcatagcctgcctggttctgagctctcatggtaaggctcctacagacacggaaaagatgggggcacagggacagatcagtagggtcagagcatctcagggaccgagggcaatatggtcctgagcagggattaagagcttgggctctcatatggtgtttctgggctcaactgccagctccatcacttactggttgctgtgaccatgggcaagttattccatctctccatatctctttcctcacttttaaaatggaataatggggtacccacctcccagggtcacagagaggcttacagaaaacgattcttgtgaattggcttgcagtaataattcaatacctgccagctattcttattccacatccaagccctttcgcctgctgctgggtgaaaacacatgtcagtgtttcctgacggtttccacaaagaagattccaaaattacaacctgccagtctgaagaatctccaaaacatcccgcacgcatcctggaggcgcgggcttggggatgggactgcccgcccgggtcctgaacaggatgcgtgcgcgcaggcacacacacaccagccagcctgtgtgtgcggccggagtccggtgcggtcccgggtgagcagcgcgtggctggtgggcggggcagagccattgttcgcaggcgtaccgagtcccccgcgctcgcccgggagggaggcggggcttcccgcgtcccccaagctccagatcctggggtggctgccacgtctccctgccacgcgcctggggggacgggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttggggacttgagtctccaactttagtttcttaagctttaaagaaaaatccggtcgtgctggtgcttttatgaattatgcgggttttcctttgtcttcgtggggatgtgagtgctttacttctccttcctactgccgcctcccgataggtttcgcgcccctcgtccccctcgccctccgcccctaatgtatctgtacagtttcagggaacttttctccgttgcgtctcggatacaccctaccctcagtgaactacggcgctgcggaagggtccgtactgtccacccttcccccagcgtgattagagagcggagtggccccagctgcctccacgtgtctcttctcctgactctcctcttcctcccccttccagatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggtaagcagcctccctgtcctcctgacctagtcctccaggtactcactgctcttttaataaggtaggatcttacagaggacaccagcccctcccagcctcccggttggggtttttctcaggcatttctctttggttgcttcaggcctagtgggctgggaagaacctgggggtactgagatgcaggactgtcaatgctgggggttgagagctttggaaccttgtgcttgtgggctttgaagtgtgctgtgctggagagtcagctttccctgaaagagcttttctgtttgagtcatttgcttggctgcctgtcccacccctgccagccacaaaagaatcaaacccctctacctgggaggcatgggaacatggtactaaaccattggctttctagggtttgtgttgagcaatcataggctagcacaagggaaactactcagggagagagtttattggaaagggaggagagagctcattggaaagagaggaaaagagaggttgttatccacaaaactattttgacctgaccccttggccagaccaggcttcttcgttacagaggaagatgaagctcccgtgcaacccaagtcacacaggtgtgtgttgctctgttactctacattccagggtgctgcacataccagtcaacaaaatgctcttagaatgaaatcaggctgaagatatgtttcatgttccatcccccgtccagcctgcttcaggcccccctactgatgccatgaagtgccaagaattctgcaccttccaacaccagtcctacccatccctccttgccagggacatcgaggccaggccagaaaagagagcccggtcttgaggctgctgtaatgagggagacagttcccagtttgtccccgacctgcccttagctcagctctttcagggacctgttggtgtggcctgatggcatggccctgccccctggatacacacatgcgctttgcaggctttttcacctctgtcactatgagcctaagttgggaagggaaagcagggagctctgcagatccaggggccctgcactgctactctctaaggggtggtgagccaggacttctggtgtgggaaactttctgacagctcgctcttgaagggtagttatgcagaagggctggtaggccaagttttagctgtttccctcaggacctcttaggtcttctgaagatggtgagatctggttcattgagcttttgtttccagaaatcctccaggtgctacagtgaaatgcaactgagaagagcccctttgtcaggatctcagtttttctaggtaccacctgtgggcaacagtacttttttaggatggggaaggtagcattccttgggttacatatgtgtcacagccgcagagacagaacaggccaggtgcagatcagttcatctgcataccaggaagagctcttgtatttgtgaggggagggcgacatctgttgtctagcccctctgaggatccagcagaacttcagttgcagctgagggatgaggagcagggatagcattccccaggcagtctgtggatgcctctctccaccctttctccccaagaggatagtcttcacaagtagttttctctcctgcaagctccttccagcctcagcaccccctgtaggtttcctgaagcccagagtttgacccgattgcctctgcttggttatcctcagttgctactgcaaggagcagaattccatcccaaagtgaaggctgtgcctgctacatttttttggtgacctgcccatgggtgtgtgctgtgcccttgggcagataaatgtggctcacagagactagatggtaacttattttactgggccctttggtggatggcttagctgaaagaatgaccatgtcgatgtggggatatcagaactcctctgtcttgagaaacaaggagggtgaggggaggagggtcagaggtctcaacttggacatcttctcttcccaccttcagaatttaggagcttcacctttcttgttttaatccctatggacaatgttaaattagcaactggtcgtgattccagcatttcttatgactgagcacttttgagagccttaaatctctttcattttggagtctcccaaagaagcccttaggagaatgcctctggcaacactgagagccagaggcaaaaccattcaagtctctttcttaaggccagagcaatgagatgttgcttaaccatcaatctggacattttcctcccctggggaggagagaaggaataaatctccaactgatttaagcccttctatttgataggcttagaggtgtttctagaaaaggcaccagagtgcctgagttctttccccaatttccctgttaatataggatcttatatacgttctgagtcaacactgccctagggtcttgcagcaaataacaaccctagaagctcccttgctcattagagagagctctggctcaactgatggtttcccgagtaagatgcaggtagatactgtatctggggagatgtcagtcaccacttggcttgagggcagatcacctggggcctcagtccccactctgagggaatgtggagagagctcttgttggggctgactggctctgtggctctcctggagatcttataggaggaatagaagagaagaaaggaggtagggttggggggaaaaggaggttgtttaggaaacagctatcaatggctgcaaaagaacacaggacaatttgttacaatgtgtggtgtctccaactgcaactaagttctgtggccactgaggatctattgtttctagctgtttccctaggaatgaaacattgttaagagtttctatcaaggccacagcttctgcctgctagagctactgaacagaggaagatatggggacgcccagcagcccacttcccagttagagattatatctggcacctcctgagcctgcaggcctccaggaaggtgagggaagacaatggtggggtgcttcactgacagcttgaagaatatcccaccattgtctagagagcgttgcccggtgagagtatgggctgacagggatgtggcaaaggcgagacagaggagttgtgcatgtatcttgggggaggtggatggtatagctggaacgtgaaatctttggtaaagcttaagacactgtacaaattggatttatgcacagggctaatttttccctgatatggccacactgactgcttgaatatttaaatgcttttttgtaccagttgataaatggccatagtctgaatgccctaagagtcccctacaactaagggcttctcaaattggtcagtgcccagattgtactggctgttattttattttttgagataaggtcttgctgtgttgataaggcttgagtgcagtggcgcgatcttggctcaccgcagcctcgacctcctgagctcaagagatcctcccacctcaacctcttgagtagctgagaccacaggcaggtgccaccatgccaagctaatttttaaaattatctgtagaggcaaggtctccctatgttatcccagctggtcttgaactcctgggctcaaggggatcttcctgccttggcctcccaaaatgctgggatgacaaagtggttcatactacacctggccctctgctgttattttaataacaccctggcttatgggttctgagctctgcaggagtagtttgtggcccttaaaaccttagagaaggcctagatagaggtgaaaggagatagctaggccctgggagaatgcctttaagatgaagaatgagtggtaagagcactattctctctcctgcctttctgactccttagttcctgggattctttagcttatctttttttcctgggttgagaggttggggggtgatatttttcaagtggtaaaatctaagggatgtggttatccctagagttcatggtaaagccagttctcacccaaagcctgacgaagacagtttctagcatccagagagtgtctctggcatcctttcccagatggaactcacactgattggtgactcccccactgtcttctcctggcaggggtattctactattttgtcagtgccctgggcataacagcaggagctcatcgtctgtggagccaccgctcttacaaagctcggctgcccctacggctctttctgatcattgccaacacaatggcattccaggtaagaagttgtctctgctcagctgtttgtcctccacactattaatgatccggggacagaaaggagggatcagcaccagagaggagccacacctgacagccatttcactttcctctctcctgtagtcacctcaagttccagttcagtccttaagtccataaagcatgaagagacttctgagtcttggaaaagggaactggaagataattggaaaatactcctgatgtgtaggaatatttttgatcctaaggtccctgtgttgtcacacaatctggccgttgtggctcttcatcataaggggctttggcacataagccagagactgaccttagattcctgggcagacactggacaataaattcactatttaaggtaaatatcttagggaggcagagctgggaggatcactggagcccaggagtttgaagctgcagtgagccatgatatcaccactgcactccagcctgggtgacaagaccccaactttaaaaaaaaaatttcaaaagtgaataacttaggactccaccacagtgggattgaagttgatgttcccagactcgtgaactcttattttgagataatgagagcaaacacttttattgcactgactatgagcctggcactattctaagcatttgatataaagtcctcacaaaaatcttaggaaataggtactattatccccattttacagatgaggaaaccaagttacagagagattagatagaccagcccaacattgtggccctttcttgggctgccatggtggctaagtaaaacattgaggtttgttaaggcaaaaaacaaacctgggcacggtggctcacgcctgtaatctcagaactttgggaggccgaggtgggcagatcacaaggtcaggagatcaagatcatcctggctaacacagtgaaactctgtctctactaaaaatacaaaaaattagccaggcgtggtggcgggcacctgtagtcccagctacgtgggaggctgaggcaggagaatggtgtgaacctgggaggcagagcttgcagtgagctgagatcgcgccactgcactccagcctgggcaacagcaagactccatctcaaaaaaaaaaaaaaaaaagtttatagcaaagacagaatgaagggaaatggggaaagggaatgcatcatagtcattaagctgtagcaatgggcaaatgatagcatgtggcgtttggcttagcttggagcaagaggaagaaaggaaaccaacttagtggtggcaatatcccaagaacttgccacatttgcatgatcatctctgccatagcagcttataccttgaaggcttccaaagttgtcctgtggagcaaaaggaaggaagagagatattggtacattctttaagggatggaaaaagtcatgaagaagcccagaggtcgtttgaaaatgcagtcatgatcacgagttgcatgcctggccttgttattgggttgtatgagctcttttgcaaggcaccagaatggtgcaccctgcagctgcagcttatctactgattgagaccctaggacacaaggctgcctgcctcatgttccccatgcctagggattaggtaccccatgaggatcttttccaacattccttgcttaaagaattgcaatgttctcacttcttgaaactctctgagctctgtatgatttacctccgttccacccaccatataactttcaagaaacagcagttctattgctatggtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaattttttgtggggacaaggtctcactcactatattgcccaggccggtagcttagttcttaccttcaaaaagtttgtagcctatcggggtggagagataagccaagtatccagataaccatggcataaggcagaatattttctgtactatgagaggtacaaaggggagggagattgctcaatgggcaacaccaaggaagtgatatgaaataaatagtgttggaatccaccaacggatagaaatttttacaactatgtgtggggagagacagtgcaaacagaagaaacagaatgagctaaaacacgaagcatgttccagcaatagagtccttttgcttgaagtatagggtatgggaagaagtaagactggagagactaatgccattcttgtcgagtcctaaaagcagacttaggacttaattcaataagcaataggaagccattacatcttttgaactgcaatgtggcatagttacggacgtgctttaggaaggctgcttttagaacaagtgtaagaaaccactgagccaaagtgagaggtagggacataagttaggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatcccagcactttgggaggctgaggcgggaggattgctggaaagttcaggcattcgagaccagcctgggcaacatagtgagacctcatctctacaaaaaattaaaaactaaatgggcacgatggttcatgcctgtgttcccagctactcaggaggctggggtgggaggatctcttggcccaggagttcaaggctgtggtgaactaaggtcacgccactgcactccagccttggcaacagagtgagaccctgtcaaaaaaaacaaacaaaaataaataaaacaatgaacttagagtcagacaagcaattcaacatggaagaaagacagcccatcccaattagtgtggaagatccatgtaggtgtggagtccccctccattgacctggtgtctggtctgtcaatgtaggtactacaaacctggcttgctgctgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccgggcccggcggctcatgcctgtaatcccagcactttgggaggctgaggcgggcaggtcacctgaggtcaggagtttgagaccagtctggccaacacggtgaaaccctgtttctattaaaaagcaaaacaaacaaacaaaaaagaaaaccaaatgccatacatgatgagcaccttagagttttcctttctttcatcaactctgggctggactgcagtcttgcttgaggcaaggaatgcataaatagaacaatgggatcatctgagtggccagtaagcctggtgttttatgaacttcaagtatgcacacaaagtattttttatctttccactctactcagatatgccttgctttaagagtgtgccgtgccttactgtttggtgatgccattatgaagggcatcaaaataactgctggtggccctttactaccacctaccctcttgtctcctcttgtcctctatttttctctcttctacttctattctgggctaggaacatcccttcccccaacatgccttcaggaatctcccaataaagcagtgtgatcacaagttcctgctcaattctctaatgttgatcttatcttttctcttttctttcctttcattttctttcttttcttttcttttcctttcttttctaatgagacagggtctcaccatggtgcccaggctggtcttgaaccctgggctgaagtgatcctcctgcctcagcctcccaaagtatctacatttttttctctgtccctctttccaactgaatatagactttcaccaaggccctgaatgaattttccttaaatagatctggcgacctcttctttccagtaattggtgctattggtcattcaataatatctagacaaccacactactccacacatttaggcaggtcattgcctaacactcattttctttttctctttaaaaatcttcctttatattctcaaccttaaccatctttattatcttttaaattgttgttgagacagtctcactctgttgcccaggtttcagtgcagtggtgtgatcacagctcactgcagctatgacctcctgggctcaagcgatcctcggggttcagcctcccaagtaactgggattacaggtgcatgccaccatgcttggctaatttttctatttttttgtagagacatggttttgccatgttgcacaggctggtctcgaactcctgagctcaagtgatcttcctgccttggcctcccaaagtgctggaattataatagctgtgagccactgcgcctggcctactatgtttattaaaaggatttattgcctgtaatcccagcactttgggaggccgaggcgggtggatcatgaggtcaggagatcgagaccatcctggctaacaaggtgaaaccccgtctctactaaaaatacaaaaaaattagccaggcgcagtggcgggcgcctgtagtcccagctacttgggaggctgaggcaggagaatggcgtgaacccgggaagcggagcttgcagtgagccgagattccgccactgcagtccgcagtccggcctgggcgacagagcgagactccgtctcaaaaaaaaaaaaaaaaaaagatttatttgtctaggcgtggtggctcacacctgtaatcccagcactttgggaagccaaagtgggtggttcacttgaggtcaggagttagagatcagccaggccaatatggtgaacctctgtctctacttaaaaaaaaaaaaaaaaaaaagtacaaaaaacttagccaggcatggtggcacgtgcctgtagtcccagctactcaggaggctgaggcagaagaatcgcttgaacccgggaggcagaggttgcaatgagccgagattgtgccactgcactccagcctgggtgacagagactccatctcaaaaatatataataaaaataaaagcattttttttctctctttttaactttcacatatctcttttcaggcaccttcttaccattgtgcctattcttactttaacccatgattaaaataaatcatatacactgtataaatctgagattatcataggaatggagtttctggcatgagatgtttcctgtatcgcaaatggatctataatgaccttccccacctccagcctctgggtggccatgagttcaaagtggctgccaatatctgatctgttgttgttatcattcactcctccttgcctgctgctttcctcccttatcacctcaccctttgttctcctccagctctgtttcctgccaccctaatctttttgtttcttgaattacctcccccactgtcacatgctcatcttctctgccaaattaaccttctcccttgagcctttcttgggctgtctcttgctgccccagttgcaaagtcctgtcttctttctacccgttgaccctcttctttttttttcctcccttgtctctgtgtgcatctgattccattttaaatctggtaaccaaaggcctggctagtgcttacacacagcccagctgcaaaaccattaatggacattaataatcctcagtacctttattcctggcattctacccccctcctccccagttcacactgcagatcatcaggtgtcacagagagaggacataccttgaaatgccctagatgatgtcatttactttgcaggacttccttgccttgcttctgattaatgtcatgactggtctgtctgagggtactgttatctacaaagagccaaatattagctcttagtagctattctttatccatgcctgattagggtcagtattatttttggctgtggttcagaaagaagagtcctgccaagcgttggcaaactctctatctgtcgagtttccaaagctttacacgttagagaaattgctgtgaatccagaatttgtttgttttcctccctccagcaaagtgaaatgttcatcccaagagtcctcaaaatctcagaggttacagggtatttttcttcctcagagagcttctgttttatcagcacctcccccacaccagggtcaaagctcaaaaaagttggagcagcccctgggaactgcagtggctgaggacattccagcccctgggctggcctttcttctgatctttggctgcagggcccactcttttggaacctcccacccctagaggtggttccagtgtggtggggaaaggtgtgcttctttactcatttttttaagagtcatagccagagtgcttcattctgcaaggacgtgcacatgcacatgcacacagagccttgagggcagggccaagagtgaatttggaattttccaacctgatacccattcccaaaagtaggagcttctctctagtcattttatcctctgagaaactgtcagttctcctcccacaaggctcccagacagccacgggtgaccagggtctccaatcactccttaagatgcctttgactggctgggcgcagtgactcatgactgtaatcctagcactttgggtggtcaaggtgggagggttgcttgcaacatggcaagaccccgtctctacaaaaaaagtaaaataataaaagtaaagatgcctctgaggggatctgtttggttcatattaaaagagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatagaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactgggtctgggagtttcttttggctgtgattcaaagtcttgggatttgtctctggctcatatctatgtctgtacctttaagagtataaaagaagtagaagttacaatggttgactcataccccattaacctgccctgctgtcctaaaggtaactttaggttaaactctgggacgcaggaagccaggagtctgctgccattaaatcaaacacattaacaccagctggcaacttggccctggggaagtgccagggttctcgggtgtgtcacgtggtcggtcacatagacctaagataaagacactgggagaggaaaagaccagcaggagaagcgctccctgggaaagcagttttttgctcttgcccaggctggagtgcaatggtgtgatctgggctcactgcaaattctgcctcttggattcaagcattctcctgactcagcctcccaagtagctgggattacaggcacatgtcaccatgtccggctaattatgtatttttagtagagatggggtttcaccatgttggtcaggctggtctcgaactcctgacctcagatgatccacctgcctcggcctcccaaagtgctgggattacaggtgtgagccactgcgcccagccaaaagcagttctttaccttgcaacccaggctgggcagtccagctttttcctgtttctgaaaagtagtcacctctagggaataaaatggcttcttgagaatgctgatatgcacagcagaaggaagaaaggaaaaccaatccaaggaacggcttgtatgttcctggagcagagggcttcatgctcacaggtgcacaaagtggaaacggttttggtttttggtttttccttttagcttttaatacttttaaaattatttttcttgaaaccgggtcttcctctgttgcccaggctggagtgcagtggtgtgattgcagctcactgtagcctcaaactcctgggcataagtgatccttctgcctcagcctccgagtagctgagactacaggcatgcatcatcacgcctggctaattttttttagttttatttttgaagaggccggtctcactatgttggtcagggtggtctcaaactcctgggctcaagcgatcctcccaaagtgctcggattacaggcatgagccaccacacccagcctagcttttactatattttatctgataatccttttatggaaaaaagaagggcagactcttttacagtttgaagaagctccatattccatcaggagccatcttgagcaatacctgggtttctaagagctccccagagccagttctccagctcaccttgctttctaatctaaggttgccctcaccttggacaagaagcacgagtccctcagagtaattcagagtatccaaactcaaaagtctatgtacatggaggccttgctagaccttaatggtgacattttcatcaatatccggttttctgccatgagtccctatccctctttttcttaacatattcaagccagaatattttttcagccattctgtaactgcacagtttcttccaagtctctactttgtctcccattaactaggatccaatatatttatgtatttatttattttaatttttgagacggagtccccctctgtcacccagcctggagtgcagtggtgcgatctcaccccactgcaacctctgcctcctgtgttcaagcgagtcttgtgcctcagcctcccgagtagctgagattacaggtgcccgccaccacacccagctaatttttgtatttttagtagagacggggttttgccaagttggccaggctggtctcgaactcctgacctcaggtgattcacccacctcggcctcccaaactgctgggattatagatgtgagccactgcacccagcctcaatttatacaatttatcctcactgttctctttgctgctttctgtttcgtttttgtcttttgtttcagacagtgtcctgttctgtcacccaggctggagtgcagtggtgcaatcatggctcactgcagcattgaactactgggatcaagcgatcctcctgcctcaacctcccaagtaactgggactacaggtgcacaccaccacatgtggcctttgctactttcttatttcctcttatttcacaattggctgagctccctctgattaaacacacctccatgcttcctccaggaatctgtattttgcatatctgttatttcatctggggctgttttcttattattagctgcaaaagttccaaagaggaagaagaaaaaagatatatcagagaggtggaaaagagttgatcaacatggtcaactgaattcaagacagagaaggaacatgtgatgagcttacctgaaagggtgatttgtagagtaagagctcttagggggacaaagtaatgaaccctgattttgatatgtttcatatgggaaggtataaggaagttaaggttctgtttaggaatcaagattaaccgtggggcaaaaggacaaaaaatagattaaggtaataatggagaacagcatagaaatgaaattcccaatgcccaaatggccaccagttttttcacgtttccctagaagaaccaagatagttcctaaagatgtctgccaggatagaaaaggaagaggcatctagattggaaaggaagaactatctctatttgcagatgacatgactttgtatacagaaaatcctagagaatacacacacatacacatattaaagctaataaatgagctcagcaaggttgcaggatataataatatcaatatgcaaaaaatcaagtgtatttctaaactggcaatcaataatttgaaaatgaaattaaagaattccacttataacaacaccagaaagaataaaacaaataggaatacgtttaacaaaaaaagtacataagtttgttacgttgaaaactacaaaatgctgttgaaagaaattaaagaaggcctgctaaataaataaaaagaaatcccatgttcatggattaaaagacaatattgttaaggaggtcatactccccaaattgatctacagattcaaggcaatccttattaaattccagctcctttttttttttagagaaattgacaagctgatgctaaaatccattctaattcaagggacccagaatagccaaaaacaaatgatgcaaaaaagcacaaagttgaaggacttacatttcctgatttcaaaattacttcaaagggtcagtaacgcagacagtgtggtactggcataaagacagacatatagatcaatgacatgaaagtatagaaataaacccatacatctatggccaattgatttttgacaaagatgcttagacaattctatgaagaaagaatagttttttcaacaaatgttgctgggacaattggatatccacatgcaaaagaatgttggtccactacctcacaccatgtataagtattaactcaaaatggatcaacaaaaactataaaactcttaggagaaaacataggtgtaaatcttcaccaccttggattagacaataatttcttagatacgatggcaaaggcacaaacaacaaaacttttaaaaataggccgggcatggtggctcacactgtaatcccagcactttgggaggcaaaggcaggtggatcacttaaggtcaggagttcgagaccagcctgaccaatgtggagaaatccgtctctactaaaaatacaaaattagcagggcatggtggtacatgcctgtaatcccagctgctcaggaggctgaggcaggagaattgcttgaacccgggaggcagaggttgcagtgaactgagatcacaccattgcactacagcctgggcaacaagagtgaaactctgtctaaaaaaataaaaaaataaaaaaaaataaattgaactttatcaaaattaaaaactttttttttttcttgagacagggtctcacccaggctggagtgcagtggcataattatagctcactgcagccctgatttcccaggctcaagtgatcctcctgcctcagcctcccaagtagttgatatatgaatggacatttttcaaaaaaatatacacaaatgaccagaagcacatgaaaaatgctcaacattattagtcatcaagaaactactttaggaccacaatgatctggtacagataggagctgaacatttaaaacatttttttttaaaaaacacaatgagatactacttcatacctactaggatgcctataatttttttttttttttaagagatagggtctcactatgttgcccaggctggtctttcctggctcaagcaattctcctgccttggcctcccaaagtgctgggattacaggtgtgagccaccacaccctagccctgtaatttttaaaaagttaataagtgttggtgaggctgtggtgaaatttggaccctcatgcattgctgatgggaatctaaaattgtgcatttgcgttggaaaacagtatagcagttcctcaaaaggttaaaaacacagttaccatatgacccagcaattctacttctaggtatataggcaagagaattgaaaacatatgtccacacaaaaacgtgcacatgaatgttcatagctgcattatataatagccaaaaagtggaaacaacacaaactcccatcaacagatgaataaacacaatgtgggatattcatataatggagtattatttagccataaaaaagaatgaagtactgatacatgatacaatagggatggaccttgaaaatgttattcaaagtcaaagaaggcaaagaagtcagacacaaaaaactatatatcgtatgatttcatttattatgaaatgtccagaatgggacatctagagacagaaagttgatctgtggttgctagagactgggggaagggttgccaatgtgcatgggttctgtggggagtgatgaaaatgttctttaggtagattttggtaagggttgcatgtctctgtgaatatactaaaaatgtctgcatcatacactaaaagagtaattttatggtatataaattatatcttgataaaaaattatattttaaaaaaccctcttaatgttttaccactagttgtagctgagacacaaacccaaatatattaagtactgatgaaaataaattttttgattaaaggaagtgctccatattctctctctctctctttttttttttttttgagatagagtctcactctgttgtccaggctggagtgcagtggcacgttctctgctcactgcaacctctgcctcccgggttcaagcgagtctcctgcctcagcctcccaagtagctgagattataggcatctgccactatgcctggctaatttttgtatttttagtagagatggggtttcaccatgttggccagggtggtctcgagctcctaacgtcaagtgatctgcccacttcggcctcccaaagtgctgggattacaggcatgagacaccacacccagtccatgttctcttaattatgcagtgatgtagtctctagtctcaaacttcaaagggacaaagactagccacatgagaaaaggcaagctgctataaactggagtataatatgacaatttggctgtaccaagttacttggaaaaatcgagataccatgttctacatttagttaaaggggtttaggcaactgcataaacacagacctaacttccttttgagtgggaaattaaagttctgagtccatcagacttgtggatacaatcataataacaataacaatatttactagagctgggcactgtactgaatgcttggcagtgtgttatcgcaccacatccgaagcaggtgttattgttacctggattttactgatgaggtaactgagttcacttggagaaaaagctgtgagaaaatgtgtaatgttgctatgatctggttccagacctatggtcttaactactggctctactgggtgtggagcagatgacaaactagatatgtcgtaatctgtcatatgtccaactgtatgcctggcaatattcagttatactcagaggcaaagcctggtgatgtgaccctcctccctgggtggcagtggcagggagcttaagttttgcacaaacagcagatgcatccactgttccggaagaacccagctcactccacctcctgacccgtcttaacattcagtcacacctgggttttaagctttcctctcaaaccatagatacgtacccaacatttcctgtctacttttcctaaactacacttcaccctcctataagattgtgagctcctcaaaagcatcttcctctttcagaaatgtctccctgcccctaaacagtcagcactggaaatgacagaatgagctcatgtcttgctctaaattctgtcactgctacaaactgtgtgaaatgtcacagggagtaggagtcatattttgtgacctgtagttaactttccgtgctgcaggcaaagcgctgattcttgtacactgactttggaacaaatgccacaggccctaattgcaggctccaaggagttgagattccatactggggttgctggaggcagaagccttcccactttcaggacccggacctgcccttcccccacgcggtcccgcccagccagctacaccctggccacagagcgctcacaaaggctcagtgtgtgtatgccgggctgactcacagtggttctgggcccaggcgaggaccttctcagaggggcggaaggggccctctccctcctggccattttccatggggagcagtcagtaaccaggaccatgccagacttcaaaaaacagagaggaaagtggaagtgaaaggcagcagaggactcagaattgctgtttcttatttctttcttagagaattatggacagcaggaaggactcaccttttagtctgtcagtttgtttgcgagagagagagagagagagagagagagagagatacattttaattgagagacaattcacacaatataaaactaaccactttatttattgagataggggtctcactatattgcccaggctggtctcaaactcctgggctcaagtgatcctcctcccttggcctcccaaagtgctgggatgacaggtgtgagccaccgtgcccggctaaactaaccattttattttatttatttattttgagacagagttttgctcttgtcgcccaggctggagtgcaatgggatgatctcggatcactgcaaccttcgcctcccgggttcaaacgattctcctgcttcagcctcctgagtagctgggattacaggcacctgccaccatgcccatctttttttttctttctttctttctttttttttttttttttaggagagatggggtttcaccacgttggccaggctagtctcaaactcctgacctcaggtgatccgcccgccccaccctctcaaagtgctgggattacaggtgtgagccaccgtgccaggccgaactaaccattttaaattgaccagttctgtggcacttagtgcattcataacattgtgcaaacactaccttttgttctaaaacattttcaccccaaaagaaaacttgaacccattcaacagtgattccccatcttcccacccacactcggcccctggtgaccatcagtctgctttctgtctctgtggatttaccacttcaggatatttcctatacatggaatcgtacaatatatgaccttctgtgtctggcttccttctcttggcataatctttcaatgttcatccccattggagcatatatcagtacttcattcctgtttattacctattcatattccattgtatgaatacaccacagttggtttactgatttatcaattgatgaacactggagttgcttccaccttttggttattgtgaatagcactgccatgaacatttgagtgcaaatatgagtacccgtttataatttattagggtttatatctaggagtggagttgctgggccagatgctaatttgatatttaaccttttgtggcaccatcaaactgtttccccagtggctgcaccactttaaattttctccagcaatgtatgagagtcaccctcttcttaacgtgtacccatttgtccctttcctctttcctactttttacaaagccagttccccacagacttctctttcccctggagtagagggtgggagaagttgcatctctagtagaaagactatccaagcctccattcttaccttttccgcaaatagaatacggtgaccaggaggaggagaggacaggctgccacctccctgtggtcactaaggtacacccactacagccattaacgcgactccgtaaaactaccctcctagcgacctccaacgcctcggtcctcacccagaacatcacattaaacttttcaacagtcacagataggaaggggctcggtgtggaaggtgccagctctggctcagccctgcgggtgagtgtttaactttcagcccagcttaagatctccgaagacacccatcgcctcgtcctgcccagtcccctccgctaaagggccggcctgcccgggcctggctggcagctgacatgaatggagaggaagcgcctccctctccacccactctcgccggggttactgccggtcacagacccgggccttcaagagctatttacacctacaacagcccaccagcgcctgaccacgccggagccaatcagcggcccccaagcttgtctgattctgtctgctccaatcaggaggcgcggtccttccagcctcttgctcctgtgaatcacaggtcggcgggagccttttttccttttttttttttcccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacgtgagtaaaagcacaggaacagcaaagcgttcaggaacgttcgaggctgacgcaaccggcgcaggaaggtggtgtgtggtgggagagtgggaggagacagtggaaagtttagacttgcttctgtaagtgataagaagtcatcagatattttcaagcaggagaggaaaataatctctctgtttcgcaaagttaactctcatggcaacagagcagagtagcggggggatgggggctgggagatgttgggaagctattgttaccactctggtgaagagtcatgggacctcaaaagctgggatagtcacggtgggaatggaaaggaagggcacaagctgagaggcatttgggaggagaatcaatagcactttattgactggatgtgtgagatgagtgaggacagcaatcagaagaggactttgaggtttctagcctgagtggctggaaggacaccacttcccctacctgaaataggtagcaaaaaggagagagaaagagagaagcagagggattttgcaaagggaataggagttcagtttttgacatgtggcatttgaattgcaagaagtacatccctgtggatgtaatacccagtagacagttgggaattaggatctggtgtcgagaagaaaagtagagatgagatccaaagggtttatagtggatcgggagagaaattgatgacctaaagagaaattatagaataagaagatttgggcagggcacggtggctcatgcctgtaatcccagcattttgggagaccaaggtaggaggattgcttgagcccaggagtttgagaccagcctgggcaacatggtga

SEQ ID NO: 11 - DNA, 5354 bp, Homo sapiens
ggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgctgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatagaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgatt

SEQ ID NO: 12 - protein, 359 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLLMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 13 - DNA, 49088 bp, Mus musculus
  misc_feature (1)...(49088): n = A,T,C or G
attttttaaaggatttatttgtatctttttgtctggatatatgtatgtataccgtgtgcgtgtctattgcctgtgcaggccagagggtgtgtgtgtcagatctcatgaaactggaggtatgcatggctgtgagccaccatgtgggtgctgagaattgatcccaggtcctctggagaagcagtcagtgcttataaccactgaaccatctctccagtgccaacattaagttacttttaattttttaattaaaaattattgtgtggccttgcagtggtggcacacgtctttaatcccagcattcgggaggcagaggcaggaggatttctgagttcgaggccagcctggtctacaaagtgagttccaggacagccagggctacacagagaaaccctgtctcgaaaaaccaggaaaacaaaacaaaaaacaagcaaacaaaaaattattgtgtgatctggcagtggtggtgcaggtctttaatcccagcattcgggaggcagagacaggcagatctatgggtttgaaaccagcctggtctacaggtgggttctaggacagccagggctacacagagaaactgtctcaaaaaaaaaaaaaaaaaaaaaaaaaaaaaaagaaaagaaaaagaaaagaaaagaaaagaaaaaaaagtgtgtgtccagaggcctacttgtctcctagtccatgtatgagacctgaggagagagcactagggagctggctttctccatccccttcacgtgggccctgggaattgaactcagttcttgggccatcaaatttgcaataagaggcttttatttcctcagccatctctttgacccttttaatcctaacaatttaaactgaaaacatgaattcacagataaggaactgactgtgtatatagatgcacagggctcctctgttgtcttgaaacagggtcatccccagttggccatctttctgcctcacttcccaaaggctgcgattactaatatgtgctaccatgtctggctcttttaaaaaaacatttcgatatgtgagccacgggaaataatgaaagtcttgtgaggtttaacgcatgaggagttgagggttctgtgggtgggatgtaggatcacgcgtgcatcttgaagagattactagcttctgcagagagcgggttaaaaggcctggcttagaagagaacattgtgatgtttccttgaaagtgtgcaagctaacgcaagcattcgcaagatgagtaaagctttcagggaggaagaggtctcgcagaagagagacactattgctctgtagttttgcctttttatgtgtccttgtaaaggggacagggtagagctggttcctaactactggagaaagggaagacacagtacctttcccctaaaaagtccttgggaaaattattgattactggggtaactgttaacctcctctcccaaagtgaacgcattcagctgtaacatagccccatggcagagcatttgtctggttcactctgttcaacctgtcccagcccaaagtatctatctctgtctatccatccttccatacactagactacagaaaactcaacttctaaattggcttatgcctggaatcccaccaccacttgggaagctgaggcaggtggactgctgagagttaaaaagtcaatcaaggttatagattaagactataaacaaaatgccgcatgaataaaaaaaaccaaatgaatatgaaagacaaaaccaaatctgatgttagtgtcatcgtcctggcacatggggacctaaggcaggaggataaatatctttgtttgtttgtgttttggtttttccagacagggtttctctgtgtagccttggccatcctagaactcactctgtaaaccaggctggcctcgaactcagaaattcacctgcctctgcctcccgtgtgctagggttaaaggcgtgcgccaccacacccggctgaggataaatatcttgaagcctgtctgagatatacagtaagatcctgactcttaaactcccttcatgcttggcttcataagtggatttgtgtccacgttcttcctaccaaggcagtttggtcacttcatattgctcaagaggcagaggctcctaactttgttttgttgtttttgttttttgagacagggcctcactctactgggactctctaggagaccaagctgtcctacaactgaaagaatcatctgcctgtggctcccaggtgcagggactgaagacccgactcaccacagctggcctaacttattttcttctaatactgcatgtcatcaggtggctctggcttcctggcattctctaggtagagcaggcttggattcacagagcgtctaatgcctctgcttctagggttccccgattaaagaagtgtactgaccacaccggctctatgctatttttatgagatggccatgaacttacagagatttgaggattaaaggtgtgggacgccactgcccagctctggtctcttctttgaggtttctttcctggagatttaatctcatcaaaaagacaccactattttttttttaaagatcttttgttaagatttattttaattttgtttatgtattaatgtgtctcacctgagtacaggcggcccattggctctcttggagctggaattgcaggcagctgtgaggcacccatgagggtactggggattgaagtcttgttttctggaagcgcagcaatacagagccaccactcctgcctcatgaagacttcttgatctcctgaccttggaatgtgctatattaattttggcacaaatgtccagaccatggtactcatttttctttttttgataactttccaatacaatcccttgcatgtttttattctattctgtttgtggttatttactgatgaattttgtgaacttcttcctacgtccagtttccaagtgctaggtttcccatgcctgtgccaccactcccggcttaatagttgtggtttatttatctattttttgtttttttttttttgagacagggtttctctgtgtagcccaggctgtcctggaactcactctgtagaccaggctggcctcaaactcagaaatctgcctgcctctgcctcccaagtgctgggattaaaggcatgcgccaccactggcctggctaacaattgtgtttttaaaactgatttacaatgcttctttgtaaatcagtgaaccgacttttgtcatgtatatacaagatttctcttttcctgctgtttatgataaaaccacattttcctttagggggctgtgcagatagcttgttggtttttatggggcagagtgttttcctcttgtttggagacagccttggtaacctctactggccttgagagctttcagcaagtctcctgtctcagcctcccaggtgaggtggctcactggagctcacctggaaaaagtcaaatgtggtggtcagggtgtggtagggtatgttagggtgtgcttgcaattgctgagctgaggcaggcgaacccctggggcttactgctcagctagtttacccttctttgtgaattcctggccagtaaaacaaacaaaaacagctgggtgtggtggtgcctttaatcccagcactcgggaggcagaggcaggtggatttctgagttcaaggccagcctggtctacagagtgagtttcaggacagccagggctacacagagaaaccctgtcttgaaaaatccaaaaacaaacaaacaaacaaacacctcaaaacaaaaccagggccaccaagcccaagctcaatcatttgatgaaaagaacccactctcaacaggcccgacctccacacactccctgtggcacacacacacacacacacacacacacacacatattaaataaaaaataggatgtacatatgaacacacacacacactgtgagggtagaggtagagagagaacatgcttgtgcatgcatgtgtgtgtcaaaaataatatagtatctaatattatatgtatacacgtatattagatatatgtatataatgtatattcttgagtgacgtttttagataaaagggtaatatcaatatatatgtgtgtgtatgaatatatgtttatttttagcatttatcttaaggaagcagaacaggagcttggggatgcagctcttttggttggtagaatgggtgctattcccagcaccacaaaaataaatatgtaaataaaacattacacagtgttgttcttgcaagggtgtccattaaaaagctgtttaaatgatgactgggcttggtggaacaagtcttgggctagcacttggaaggtataggctggaggatcaggacttcatggtcttccatggctaacctgggctactcgaggccctacttcaaaaaaaaaaataataaaaataaaaagttgtttataatgggaaaattggcaaaagtaaacaataaaacaatgccctggttatgtcaaccatgcatatccacatatggtaagtgacaaatgccacaggatagctagtgatattaaaatgcatgaattgctaaaaatgagataggacctgactcacaaatatcaaaactagagtgctaagcacagatacactattttcatgatattgattaattccgggtactggaaatagtgggtaagacttttcttttttcctacaactatatttgaacaataaagtttaattttaatgtagcaattaaaaacaatgtaccttataattttagagatataacattgtttgtgtataaagtttagctttgacaggaaagaattaccctagctgaaaatatcctctagggtcaggcacacctttgaatgtttgatcctcctgcctctgcctcctaaggggtagggttatacaaatgagccaccttatttgactctaattcaatttttttgaaagaataacttctctttagataagaaagataaaagaaccaacagaaaagtttatcaaggaagattgtgaggaaagacatcataaactctttctgaaagtcttattctttgcttgagtttgcgagagtaaaatgagccccatctttctgggagatgacctgtaccatttctcagaagcagatcagacaaagggctgagcagcaaaggccctccaagacactacaggacagtgtagtctgaccaaggctcagctgagccaggtctaggtgtcacttcctatcagtcccccagggacagcatgaaccatcacctctagaagttttacaaaatttaagtgaaattaggggcagacagcttgggattgccccgttcttcaggggtcccctggtaagcattggggggttcccttaaatatggcagaaccctaacactaagtatgggggccacaggggaggacaggcccctgcttgttagttggagactggaaggggtgggggaattcctaaacactccatttacagagaaggagagccccttgttagtcacagttcccttagtacagggcatttggtggtagatatctgtttctgattccttcaaggtttctgatttcttgtaggttttagagacagacaactgaaataaacacacagagagacacacattctctctctttctctctctctctctctcacacacacacacacacatagacacacacacctactcctctcaccaatactatttggctattaattagttcaatggtcatagaatttaatttacataaatccagtattgctatttatttttttcttttgaggctggagctcctgaatgtcaggctggcctcacacttaatatagctaaggatgaagtctggttctcttcctctcctttccaagtgatggagtcacaggtccatgctagcacgcctggtttctacagtcctggggatctaaccaaggcacgcttttattttttttatgctccagactttactctccctcccctctaagcccaccctgcatccaccctctgactgtttcacatcccacacctcctcttcacccctgactccacaaggatgtccccacctccccacccaaccagatctctaaactccctggagcctccagtctcttgagggttaagtgcatcttctctgactgaacccagacctggcagtcctctgctatatatgtgttggggcctcagatcagctggtgtatgctgccaggttggtggtccagcatttgagagatctcagggtccatgttaatgtatcattcactctttgagacagagtttctctgtatagccctggctgtcctgaaactcactctgtagaccaggttggcctcgaactcagaaatccgcctgcctctgcctcccaagtgctgggattaaagatgtgtgccaccacacggctccatcattcattctttaaaaattacttttatgtgtgtgttgggggcgggttgtctgtggagaacagaagaggcaactggatcccctggagatgggcttcctgggagtcctgagccgcacagtggctccccatcctgagtgtcactcaattagctcatgtttaaagataatttcagaaagaagccatgtggaaattatttaaatatttgtccattaattcattttttgagacaagatcttgtgtggcttaggctggtctaaagcctatagcagaggctagtttgaaatgatcctcctgcctcagcttcctcatttcagggattacagtaatgtgccaccatatctaacaacagtgtagacctataaaacataaggaaggatgtgcgtgtgaggaaaggcatttactcattgtgaatgccaagtagaacttgaactgttttggttgacttgattgctataaaaatacataggaagcagattctagcctaacttaatatagttcctattctacattaattagggattcaagcttgagatgaggtaagtttattagtttttgaataaagcagatgatatgaataaatacagatgacatttctcaatcttaatcttataattgattgatgtcagtaaccacttttttttttttaagggaaagaggctggggtggttaaaatataatgtatttatttgcaaaatgcttagagtcttaaaaaaaaaaacacattgaaaaccaagcatgtcattgtcacacttttccatactacagcagccacagcaggcaggttttccttcttcctccaaggtgtatggcacagaactgtctgaaaaatcaccaaccagaactcaccaactcagtctgagggcctttatccaagtacagggcctacggcacctgatggcaggtggcagtaagggtagatgataggaagacaccccaagtcaaagcttttggtggcatggcagtcccctcagtcagctcaccgaaattatgttgtcataggtgacaagtttacacaagtaaactcaaactcactttagaattcatcaattttatttcatatacaaaacttcattacaccaggtaccaaaattaaggcgaattaagtcaaagtggctttgaaaaatctaaatcgacacagctcaacacttgggcttagttcaatcagaagtgttaaggaaactgggcatggggctctcacctttaatcctagcctggactaaggcaggattgctgtgaattacaggtagcctcatctatacagtgctttctaggacaaccagggacatagagtgagacctgtataaacaaatcaaaagttccattgaggtaagctgggcatggtgacagacccaggctggagagttcaaggccagcaggctacataataatgctgtctcaaaaaaaagtgttagcaaatattaatttataacactgagaaaatgtgctttaaaaacttgtgtgcatgggcgttgttcctgcaggtatgtctgtctgtgcaccatgtgtgcctggtacctgagcaaatcccctgttgctgctattacaggctctgagcctccatacacttacacaggcagtcgcatacacaggctctgggaacttaactcttgagtcctcagacacaacagccatcaatctaaattttaaaacttgaaagatgagagaccaccatttatcaactgctctcttcactccactcccaccccaaaagggaaactccaggtgggtggatgtctgtgggttcaaagccactcttgcctagtgagttctaggacagctagggctacatagtctttaagaaagaaagaaagaaagaaagaaagaaagaaagaaagaaagaaagaaagaaagaaagaaagaaagaaagaaagaaagaaaattagccgggtgtggtggcacacgcctttaatcccagcacttgggaggcagaggcaggtggatttctgagttcgaggccagcctggtctacagagtgagttccaagacagccagggctacacagagaaaccctgactcgaaaaacaaaaacaaaacaaaacaaaacaaaaaattaagaaaggcaggggggaaaaaaacaggaaagaaagcctgaaataggctcaaacatacgaatttttaaattaagcttgtgcaacatggtggttcacacctgtaataccagaactcgagatactgaggcaggatctttgtgtgtatccctggctgacctaaaatgtagactaggctggccttgaccctgtttcaaaaatcgctcccaataaataacagataaatcgacctcactttgtgaattaatgagtgtaaacgtgctaatgttttccaaatagagcatagttaatggggagggtgaatttaagggttcttaattggcaaggcctctttctgaaaaacaaaaacaaaaaagtaaactaatataacttagggaggttcatttccagcttagaccgatgtaatcactctaaattccatacgcgatgccaagagcttttctcaaaatcctaaaaattaattctcatctacacaccctgtcttcggagctgcactcccttcgcggccgcacgcggcgcccgcagcagctgactcctccccgttcatggggaaaaccctgcctaatatttataacgctatgacatactgtaatactcacaaggtggttgtagaagtataaacacgactggagatatctgattggctgctggtgatgtaacacccatgtcaatacttcccactgaacgcacgtgttcgaccttttatttaaatttccatttcatcacagcaataagacactcggggcggtgcattttctgcgaaacgatcgtcgcccggggccagaggtgctgcccggcgtacacaaggagcccaaggaggtgtcctcgcgagggaggcaccgcctggtccagtcttttgtgcaggaacaaaataagttcacttcctcgggcacggccacccacccctcccccggcagatgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcggccgccgccgagacgtcaaggaagttgctgctgctccctcaggacacgggcggcccctccttgctgggcggcggcgcggggggccccctgctagcggaaaggaaccgtcggactctggccttccgcgggggaggcggcgggggtctcggcaacaatggcagcagccgcggccgcccggagacctcggcgtggcccctcaggcatttcaatgggcgagggccggcggccgtggatccggagctggacgcgctggaggggaaggagtggatgcaggacggggcgtccctgagctacagcaccgaagaggagggggcgagcccgggcgatggcagtggggcggaaggcggcagctgcagcagcagcaggcggtcgggcggcgatggtggggacgaagcggagggcagcggtgtgggagctggcgaaggagagactgtccagcacttcccgctcgcgaggcccaagtccctcttgcagaagctccagtgctccttccagacctcttggctcaaggacttcccttggctgcggtactccaaggataccggccttatgttctgcggatggtgccaaaagatccccgaggatgggggcggcgtggaccttacccaggtggggcatgatgagctttcgcgagggacccgcaactacaagaaaaccctgctcctgaggcaccacgtctccaccgaacacaaactccacgaagccaacgcccaggtaccgtagatcctgcccttgcttttcgaccacatcttttgggaaaggtttatcagtggggaagactaaaactaaagtaaagaaggggggaaattaagatcctccgggggaagactcacttcgttccgatcgagagaggttctcgagagcttatgcgtaggggtttagaaagcctggaaacaaagttttccaaagttgtggatctattgggggaggaggggtagaaggacagttttctaatgatatcgctgggtttatcttctttttcgagttagggtttgcctgtgagattgaatccgagagagaggctgggagaggttggagattttaacctttgattgactttcggtcaaaaaggatttttttttttaagtcagcggagattttagaactgtcccttcttgtgttcgtagacactaaagtactagaagtagcctgaagaatggattaaacagtttccttaagcttcggtgctacaggctgtccactcttaaactcgtgtcaggtcgagataatgtgaaatatgagaggcttatgcaaatgtacaggaagttagttcagtagggtaaataattttacgatgtccgtctctgttaaacttgtttggtataatcattgtacactttagctagttacttactgatatttctcttctgagtgtattatccttttcaaaaacatggtcgtgaatagcttatatgaagggtgttaatcttagctctggaaatgtttaatgtgaagtgatttgggcttcatttgctcactggaaacctagttacagagcaagcctacctatgagctttagtccccctcccccctttttacaggagcctgaccgttttgatagcccttttcaagtcaaatagctgttggtcagtcttcctttttatgactcagacaacctgtggtggtgggtggaattgattcttttgtgttgctgaccgacactcaggtattagtacctcaccatggtgtttatgggagccatcctgctgctcagcacacttacactatagtttattagtcacacaagtaacccagcttagagaggctttagttttaaaagcatgggttattttgtttggttgggtttttttttttttcccccagaaggcagggaaatggagcttgtttgggttgagtttttatttgcacaaaatttcctaaatcttagaaaggtctctcccctatccgcccccccccccttctttctctcctctctagggtctctggctaccttggagctcttaagtatatagaccaggctggtttcaaactcaccgatctgcctgcctctggagtgctgggattaaaggtgtgtgctaccacaccttctgaaggtcacttacttttaagatgtaaagcccatttagtaaattgccttaaaccctggatgacagcctgaggctagtgcttataaagacttttgtaatgggggaaaaagtgagctttgagcaaatgcaggttctgatctcagttttctttatcactacctttggagtttgtcctggaagtttgataggcctgacacttttgttttagctgtatcagactcatttacattatccaggaaagtaaatttgtttccttttatagaagaagcatttcagtcattaaagggttaaggcttttcagtctttaagagttaagtaataaatacctggaagtatttagtaagatgatagaagctgtggcttgtgaaaaatggaaggctgaattttccaagtattggtatgtaagtattttagatttttttaattggaatgagtttttaaatctagtatttagaatattctgttctgtaggcaaacatgagtgggactaaaaattagctgctcagtgatccataactcagaggggattaggtggataatcttatggtccaccctagtaaatgggtgtatcctgcaggcgtgtacctaggtctccagagctcagttctagggaaaaaccttttgtcaacttgactctgaactaccctttccatttcccgacgacatggtggttttgtgtgaggtaggagccatcccactttttaagacttgggttaacgccttaaacttgaggagttatgtattggtttccttggttgaattttaggtgttaccacttcatcatttatcttcacttgtgactaacctttgtttgaggaatagcttattcttccaagaaacacctgtaaagtctctttcccttgttaacagtgaccggttcctagcaggatttgatggggtgggggttgtgtggttgttgttgccctgtagcctttggttacctttaggaggcagtgtaacattctgtaagaacattcttgggtcctggtcctctaaccgttattttgtatcatgcttattttattatagcttactcttagacaagcgtgaagacagtgtcttgtcccctggttggcctcatgcctgctttgaccctcttacctatttctcaatgtttggactcctggcccaccaggccccagtgagggtttaactagtgttgggtagctgatctggtaccttaccctgggtagacccaagctctcactgctgagcagcactccccacgcccaagattggtttatttcctggtccctcgttcataagtgccagcgtttacatttttatcttactacaacagaatcttgggtagcatggtttgacctcagaatgtctttgtgtcatccattttgaagccactttgtaatggtattactcttgaatggagagcagattatttccccattcatactttccaagactgaggcccataagcctgggcattttgagtttttctcactataaatgtaattcagtttcatagtgtcctgtattattagcttcctcattttaaaaatgagatggaagctgctgaagagatggctcggtggttaagagtgcttgttgctcttcacaaggtgaggtctggttgtcatcacatggtagctcatagccatccataattccagttgccagggcatccagcaggcgcaaatgtgatgcatgtgtgtgtggtcatacatataaagctcatgggaagtgaaaatatgaaggtcatcttcaggtatatacctgagagacagtgtaaaaataaaatactgtatgtgagttctgaaactcaggaagggctgagtttgacctgggcatgctgtcaacattctcttaaacccagtgctgtctaaaactcaaggcaccaggagctcagctctagagcagccaatagggctctgtaatgtaatgagaccctgtaggccggaagggtttactccctcctttcctcacacttctctttcctttgagacacagcctcactttggggcagactgagtttgaattcatgatcaccttgcctctacctccagttcatatggatagttctaagacttcctttcccctagcccctaggatttctctatgtagccctggctgtcctggaattgtgtatcctagcctgacctccctgcatgctgggattaaaggtgtgtgtcaacacatccagccctcattcatttcagtttttctagaggtaaggatcaaatttaaggtctcatttatgctaggaaatcactctgccgctgatctgctcctttttttttttttttttaattaaaagaccttttgtgatgtcataaatgtttaatttccctttttattatgtgtgtgttgtgtatatagtgggtgtgcacacttgggttgcaggtgcctgaggaagtcagaggcatgggatctgctggggaacttagtttctgggcttgtgaatcagtcacctgatgtgagtggtcagaatgagatgccagcccttggaagagcagcaagcgctgcacggtcatcgcttcagtctctgattgcttcagtctctgctgcgctgcttttattattattattattattattattattattattattttgctattggtttttcgagacagggtttctctgtatagccctggctgtcttggaactcactctgtagaccaggctggtctctcgaactcagaaatccacctgcctctgcctcccaagtgctgggattaaaggcgtgcgccaccaggcccggctgcggtgctgcttttaaagacagtattttactttgcttcatagcctggctcagtatccaacagaagaccccagtaccctggtcttgtaagtgatgggacttcaagcttgtacaatgctgggtgttcttgctcattagtgttttgagacaggatctcttcatataggcctggctagtctgaaactcactttgtagatgagcctggccttgaactccagagattactgacctatctctgcctcaggagttcctggggctaaaagcatgtgttggatttttgagttaatatgttgttattagtacattattaaagtttacttttatttctcattttcttgggaggtcaggtacgggaattgaaaagctaaggcctcttgcacactggtccaagctttactgttgaactgtgtctttagtgccccttttacacagaggcatggcttctttgtgtagccctgactggtcctcctctgcctcactgtgctggaattaaaggttgtgtgccgcctccaccaccaggccccccctccccccatttaagacaggatcttgtcaggcattgcctaggctggtctgggactcctacctgcaagccctggtaggccttgacacttgtgagtgtcctggttcaggctcctgagttgctggacctacagacatgttctttgcccaggacttgtttcttattctttatataaaagtcctttcttttccttctcttcttcctccctctcctcctcctcttcttactttgttttggtggtgaccaaaaacaaacaacaaaactttttggagctaggtttttgcaaggttccacaggctcgttggagcctaaccctctggtcatgtcctgcctgctccctggtaattggaagtccgagtctgtccgtgcacttgggttcagggcctgtctttttacttagaccttagttgttagggaccgaccccaaggagaagtggggctttggctttggtggtggggtttggggttttgtttttgaagcacagtttctcatgacctcaaactcttacgattattttaagacgtgtgtgcgtgtgtgtgtgtgtgtgtgtgtgtgtgtgtgtgtgtgtgtgtaagctggagggcagcttggtggatgttactctgtaagttgtgggctgccaagcaccattagctgtcaggtttatgtgatgagcactcttaaccagcttggggaatctctgggacttttacttcaaattgtgcctctattgctgggtctacagatacatatctgtaggcttggggaagaactgtgttgtttgggggaggcgttttgatcctagggttctgtgcatgctcgctagtcaagtgccactgactacatcctccctgggaggaatcgaagattcttgtaagagaggaccctccattggaaagtaagacacttgtttggtgctggagatctctatagtttttttaagtatcctcagagtcaatttcaagaattatctcattcagaatttggccatttggcccagaaagatttttaaattgctttaattatagtgattaccactgtagcttggttcagaccactttctacccaattgtgaaattctcagagcccagatcactcattctgtcaactctatgcagtctgctaggcctacagcgtacacccaaattattattattgtaagcttagttaacctttccagaaattaaacatgaattcaacccagtgatgtgattgaaattactagttggaatacgttgatgtcaggtggaaaagagaaaggtgaggcaggtctgccagcccttgctttggaaacaggaagtcccaaaggttagttgtatactcttgcttttttggctagtttttaacaacttagaaagaaagtgtttttttgttgtgatctatgtatacatacttggcatgaatacaggagcatgtgtgctatacagcatgtgtgtgtgtatggacacaaatggctaacaacatgatttttagtaagagaatcaaatgtctatgtgctcctatttagaagtaccagcatactgcatatgtgggtttacaatttgaggagaaagcttataataaagatctatactagccgggcaggggtggcacatgcctttaatcccagcacgtgggagacagaggcaggtggatttctgagttccaggacagccagggctacacagagaaaccctgtctcagaaaaacaacaacaacaaaaaagatctatactagaggccaggtggtgatggcaggacaggtttttaattcctgtacttgggaggcagaggcaggggaatctctgagtttgaggccagcatagtctacaaagtgagttccagaacagctagggctctacatacatacatacatacatacatacatacatacatacatacatacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagtggattccaggccagctagggctatgtagtcagaccctgcccttaaaggaaatgaaacaacagaagtagaatttctagggatagtgtttgagccataaaagagaataacatcaacacacaaggcactataatagagatgatagactgcagaggagaactgatctacttttttttttaaatcggcagttaaatgcgttagcaccagtagaagattgtgattatatttgctatgaccttgtttgtcttcacattctagaaattgaattttatttttaaatttggaaatagaaattattttctctcaatatactgttcctagtgagttattgaaacaaagcaatactgatttttatgtactttaggttcatatactgatatttgtgaaaatgtcttttctgctgattatcgtagacaaaattctgagcaagaaaggaaaacagccttttacactaagtgtttttctattgttgttaatgggctgataagctgtggtcaagtctgtatcagttagctttgctccttcacctcaaaggggacttgcctagtggtttacaggttgcagtgaagttctccaaggtagaatggggaaagagtaactgccatctctcccaggtctcatcgccccttaacatcgccttccctagtttcaaggtctttgcctcctctaatacattacatcacactctccccctttgtaaataagccaagaggaaacagtaaagcctggctggccttaaattcgctcttttcagttttgtgtgtatttgtctgcatgtatttatgtgtataccacatgcatatctcatattagctgagtccaagagagtctcctgtgagacatgacatggataccaggaactcagcccaattctctgcaagagcaccaaataatgttctgagctctctccagccccggaactcaaccttcttcactgaatgattttgaactaatggtctttgtctccataaccccagtgattgggctacagctgcatatatcactgtacctggtcttaggcagtgctgtggatcaagcacaggacacaggactttgtgcatgccagacaagcactctaccaattaagctactatgctagaactattaacagtaggttcccagctggtcatagcatttgtcttcattctctggtattgattcctcttcacatttctttcttcagtctgtcagccaatccaatgtatcttttgttaagcctggacctacacccacacacacacacacacacacacacacacactcacacactcacacacactctgtctctctacttgtctctttctctcacacttacaattaaaagttccataaggcatacataacagcagttcttgccctttttgaaagataagcttttatttatttgtatggcactgggatttgagcctagggttatcataggcatccatcccagctcattacgttttcatttaaagtcaggcatagtggcacatgcctttagtcccagcacttaggcagaggcaggcttatctttgtgagttccaggacagccagagctgcacagagaaaccaagaccgacaaggcttgaacttgagaccctcctgctttagcttcccagtcactgccaccgttatcagcctttgtcttcaggctcagcatgtgacacatgcctgtaatcccaacacctgggatatgaacaggacaataacaaggtccaggccattctgagctatatacagaaggaccacaataaactgatagagctgagcctgaagacaaaggctgaaagggtaaggtaaaacccacattaggagggggttatatctaattattgcaaccatcttaaagctacgtcattagatcctacattttctgaagtggtcccaccaaattatgtaattatgttacatttgtcacacaaaatgtccttatttttaaaaattacttgaaattgctttaaaaattacagaagcctagccacaacatacccatattatacaatgaaatactatgtaaccaccattgttttattgccactgtagaccaccacccaccgtttgctttcacagagtgactcctttcccacaactcacggaaggataagctgtgtacaacagctactaagacagccctttaccaagctggcagagctcagggtgcttagggacatttgttgctattagaggaggagggggacccaggttcaccttccccacacttagagattggctcaattgtatattccagacaggcctacaaaatgaacttcctgccttggctttccaaagtctgattatagggctcctgatcatactgcttgttatttaaactttaggtggttgtttactttgaaatgctaattcactgccccccacagacttcatagaaatgctgccatagtttgtcagattccttcttccaagggatctccccttttctgcactatctactaggtagactcagaaccaaacaaatggacctgcttgttagccaggtctacagcagcatgcatcacaatgtttagagctaggtctgtaccaaaaggaaagttgtctttcatgcttccaactgtctgaagagcaaggtaacattcagattgttttaatttaaacccaggttcagcccggcgtggtggcacacgcctttaatcccaaatcccagcacccgggaggcaggtggatttctgagttcgaggctagcttggtctacaaagtgaattccaggacagccagggctgtacagagacccaggtttcatcaggtctgtgtgattggctcttttcatagaaagatagaactttattatggacatttttagaattgtcattttatgtaactcttttgctaagtagtttgaaattttgtaacatggcttgtatatcagatttatgttttaaaaaatagcctcttagaactcgggtaggtctcatgcatattctttgccagggattgaggagagaggagagagaagggaaggggaggggcttattagtgaagctaaagcatttccctcccagaattcacactgtagtactggctgcctcgcctgccttaggagtgctgggattaaaggctttattctaccatgcgtgctccagctatcccctcatttttgaagcctcacttttttcaaagcaaaaagttaagacttacactaatgaataggtttgtttcacctacgttattcttgtagagtttttgaagatcattgagtcattttagtagaggaaaatggctactgtagagcatggagcattctgtataataggatgggcttgggatgtttgctacagcacaatggcttcatgagacttaatctccactaagattaaggctgccaaaggcatagtgcagctagatttctactgtgtttcccattcttcagtctggagcagctctttacactgcaggtccgcaggcgctccgtcctgctccgtcgtgctgcagcagcagtgagtactagagtgccaacagtctgtgctgctgctggtctcttactcgacagttaacaatgggaaagagtgcagaaatactgcgaaagcagtgttgaaggtggtggggatatacaaaactctgcctgcaggacttgcctgtctagttactagtgaagacacgttaataataagaacgaattttaataatattactaccactcaaggcctcagggaagacttgagttgccaaaggacacattctgaaattagatcatactctaatttttatagcatgtaaatcttgaagattagttttattatttggggtgggggtgtagttgctttgcaaccaaaagatggtactagatcccctggaaatggagttaacagatggtttttcagccaaccatgttctgctgggaattgaactgaacccactcctctgtaagggcagctaatgatctgaaccattaagtcatttctccagccatgtcttagtgttgtatgttttttcttgcagtgctggggattgtgccagagggcacaccctcctccccgacacctcctttaggctggtctcaaacacactgtggagttggggatggccttggactcttcccctctcagcttcaccagtatgattacagctttgaactacatggtagcttaattgctatataggaaccttatttaaagggatgctaaatagaattagaatgaatacttgcatacccaatgaaaagcaaaatttatatacatcaaagcctcttgaattcaggaatttttaatcaccttatagatgagatagtatttgtgaccataaagagaaggcattttgaaagttgactagaaaaataactggatatgctcatagtggaaagaagtttccactagtttagatttaattaacatcattgatctgaaccattctattacagtgtttgcctgaacttaagtttacctttctacttcctttggcatctgctttcctggctgatagagcagagtgatttgatctcaagtaaatgatcatttctttcttttgtggggggtgggggggtggtttcgagacacggtttctctgtgtagcaccagctgtcctggaactcactctgtagaccaggctggcctccaactcagaaatccgcctgcctctgcctcccgggtgctgggattaaaggcgtgcaccaccacgcccggcgataatttcttaagaaaataattgttacttttaagttttgaaattcattcttagcttatatgtgaaaagaagccaatgaaatcatgctgatccttggatgtctttctcttgcttgccccctcctccccttccccccctctttctctctctctctttctttctttctttctttctttctttctttctttctttctttctttctttctttctttctttctttctttctttctttctgtaatagcgagttgcgccagccttgatagacttcttttggagtttaatatggtgaatatttttatctcaaagtgtataactattcatgaattgtcatgcttgaataatgatttaacagttatatttgtttcccttggacttataaaaatttattataacatttatattataaaatttaatgttaatgtttttctccaattacaggagtcagaaataccatcagaggaggggtactgtgactttaatagcaggccaaatgagaactcttattgctatcaacttcttcgacaactagatgaacagagaaagaaagatattctttgtgatgtcagcattgtggtgagcgggaaaatctttaaagctcataagaacatcctggttgcaggcagccgtttctttaagactttatattgtgtttcaaacaaagaaagccctaaccaaaacaatactacccacttagatattgctgcagttcaaggtttttcagtcatcttggacttcctgtattctgggaacctggtgctcacaagccaaaacgccattgaagtgatgacagtggctagctaccttcaaatgagtgaagtcgttcaaacttgcaggaatttcattaaagatgccttaaatatcagcattaaatcggaagctccggagtctgtggttgtggactataacaataggaagccagttagcagggacagcctgccttcatcctcacgggaacagaagatcgccagcttctgggcaacgcggaacctgaccaacttggcaagtaatataaaaactgaaaacgaaggctgtgatgtcgacgagggccaagtagaaaactaccagatgaatgacagtaactggatccgggatggctctcctgaattggctgaaaatgaatctcaaggtaaaacaaaagtgtttatttggaataatatgacctctcaagagactggcaaagcaaggagaaaaaaccaaactacaaagagatttgtttataatataccgcctaacagtgagacaaaggtagaagattgctcagtgatgcagccccctgctgcctacccagaagaaagcaaggccttactcatcaaggaagagccaggtaaggttgtcagtccagttttgtacctgctgaagtttacttttaattattaatgtattagaactaaggatacttagttcttagttttgggtcttttgtgtgtctatgtgagtttaagttttagagtgggtggtaactaaagtaccacctgccaaaagccttattaataactatgtaacagactctttctgacttagggtaaggttgtatctctgtaaacaccataagatcactcacgctgtctttaatctttaagtcagaattgttaatatcctcagcccattgtatatcacagtttgaagagctttcttataataagtgataactgtgttatgtaaatttattagatgctaaccgaaactaaaagtgattttagggtttgccttttcataatttggaaacattttaaattggactctcaaatcccttcatcagtattgtcaaggacagtatcagtattatcctattggcagcctctgcactactttatgacagtgtttagttgtaatgtgtaactaatcactttgtctcctgaaattcagttgtaggatctagttcacatttaaacatttattgttacagaagtttgctgattccaagatgactctttagcgtgactctgcctattacaggtctccagaagcaggaatgcttttcttattgtcacctgactgtcattgtcatttgaacagcttgtggtggggtggactattagcctgttttctgggggtggggctgtttctgtggaattgcagtttttccttccaggccatggagctcttattttcagtatattcctagacagtgtatatactgtgcaagagtcgtagcatgtcatattggtggtaaagacctttttatctatctatctgtttgtttattttttaaatgaaccgagtgaaggacttctagaaaatggaaaatgtagacatttaccttattttaaactggctgtttctaactttgaaacatctcagggatttgacatttcctatccatattttaggtttgtgcaccattagtttagtgatttaatgcctgtttatctcaaggggcttgagttgggtacacttacacttcagcattttcatgacagaggcaggtagatctctgcaacttaatggccagcctggttggtctacagagcatgttccattacagccagggctgtcccaatagcaaacaaaaccatgcctgtttagtgtctatgataatgatggagtattttatgttaaatattcttttacttatccatttatctgctgtttctctctccctctctctttctctctctctctctttgtgtgtgtgtgtgtgtgtgtgtgtgtgtgtgtgtatgtaagtgaaccatagtacacacatgcaaaattcaaaggactgctttgtggaattctcatgttatgaaggttccaggaataaaacttaggttgcaaagcacctttccccattgctgttcttttttccttgtattttatgtcagttcttatcggcaagtccctactgagacttgtgttagagacaggctctaggacaggctggcctctaattcactatgtggctgaggatcacccttctatccatccttagactcttggctttaccttccaagaacagagagtagagggctgtgtcaacactaacagtagaccccttagctagcactttgtttttggcttactaatacagaagtcttaacaattcaaaactggtaactatcaggactttctgctgcatttagtgttccactgtggtagttaactctgtcaagtgtttaaacgtatgtgtgtatgtgtgcccacacacatacagattttgagcacctggaaatatgcatacaataaaaatcctttggaaaattaagcaggtattttgagtggtggcaggaccaatcagagctaacactgttcttaacaactaccatataatattggagtgacttaaaacaataatattgacccagattggatactttcagaagtctttagcatttacttagcaattattttagcaagcattttcttaccatccatatcaatgcaccaggtctatcaaaaattgtggatagtttaatgagtcagtttatcccatcctaaaaaaagataatttttgatgcttttaaatcattggttgcactttggtacctgaattcataaatttggtttcatcatgacaagctgcatatcaactggtgacacttttataatttgatagtgtctctaaaggagagttacagcatcattcagtggcagaaaagtgggttttctctcacctaaacagtatgcaagatacaggaaaataagaggtcaagctagtgtttgtgtaattcacatatagctcatagtctggccttgctggtgggcagccctgtgagcaagtctgcattttgtgattgctcacaaggctgttccagagccaaagtgctcctatcaaagctctgcctatagtggagaataagaatggacagttgtagggccactcgtttgttctgtatgttcatctagtacaaagagatgaagctggctcctttttaagaattcccataaaacatggagcagcactgagcacctggttttgttagtaagcgggtggcactagcttctcagaagccctcatgactgttcattcacataacaccttccagtgcactttccccagagtaatacagactttcacttccaacatagttttaaagagaggtagaaatatatttcttgtgactttttttcaagtcagtttctctgtgtagccctggctgacctggaacttgctctgtagaccaggctggccttaaactcagagacctgccttacaagtgctgggttcaaaggcatgtatgtgcctttcttgtaacttttaagaatataatgacactaatctttggttagtttctatacctttgtttatataataaaaatcaaaataaattctccaaaagatgtgtcttctagaagacttgagttaaattctcagcacccatatagtgagtcaccaccagctgtaagtcctgggacttaacaccctctgagggcataggcacaaatgtgaaaagtagcgcgcatacatgcaggtaaaaggaaacaggaaagaaaatagaccttattaagaacttgatggtcagaaaatagtgtgagccatttttcttggagtctcactgtgtagctttggctgatctggaccagctccccatgtagcccaggttggcctcaaactcacaaagctgctttgccttccctgtggtgtgattaaagatgtatattaccatgcccagctgggctttgaagcagccctgacaaaaaagctatactttatgtttggtatggttgaaaggcctgtatataaacagaaggaactatttctagcaaagctttgtttagtccttgtcaaaaaaactgtctattaatcttagccatagattggaaaccttgagcattacaggtcaggataacttttagcttagggattccagttgaagttctatgtacggtgagtctacaaatggttgaatccactggtggaataaaagcccaggttcagttagctcttgaaaactgctcctctctgtatagactatgatgggtgtaagttaagctgggtactgtttacagggttatatgaaaattaaatgacaagttatgtctgtgcccttaaagttaaaaaagactattgaagttatttataacagttttccagtgctatgtactttctgccaaatgctagatagatggtcttggcttgctgacaacgatgaccttaagcagcctgtgtgtataatgacagttattagaggttaccttcagtttgagtcaaaattaacttctataatgcccccattctgccatttatagtagaatttggacatagttttaatccctctatctggattagaaatataaataatacctctctgaatccatgtttttctaatttaagtgctatttcatctattattgaatatagagaactgacgtttaactttgcagggaagtttgaccaatataacaagtgtagtgtttatttaaggtatggttgcctttcccaagattagtctcctggtaaaagtaggagccttcaaaatcatgtctgctgttaaaaccttaaaaatgtagttctgaacttgaaaatatgttaacatctatatcattattgtgtttaatttttcacttaaaagtaaaaaatgagcgagacatgcttttgcatgattttaaagctctcttataaacatctgaaaagtactagtgaatattttgaaatctaaattcaatgcttggcatatttagatttgtgagcccttaaaagggagtgtgacttgtatagtttataacgacagctctaagaatgcaccctttgtcccgttatgctgaaacgggggttgcaccttgtaacatcctctgcaggtttgattgagatggcacattttggatctgtaagcaatcatatcttgttggacttaactgctaggcttgattctatccagacatggagggaaccggggaggggtagcatgcttgtcctttgataccgagttgatagatttaaaaactgaacactccttaatcaaataaagggaaaaatgatcttatgatattaaaaaattttaactatctgaaatgaaatctgagatttgaactttagttattaggggtttttcagtcttggtttaaatgcagggccttgttagtgaggtgtgcacttaatccttcatttttatttatttttaaaaattctgacacaggttggtacaatatatcctaccttttgataaattttgtgtatagcttaggaaaaatttgaacttgtgatgctcctgcctcagcttctgaaacattttggtaactcagggtgctgccacaacctgtcttttgattattacatttttgttgttttgaatgtgcacatttgcagagttagtgcagtgcacatttggaactcaggggacaatttgtaggagctggttctctccttgtacttgatggctcccggggaccaactcaggacagtaagtgtggcagtgagggactttacagactcacatctcactggccctggcctcacctttgtaattgatgtatttgcctcccagggaaactgcatataagctggtatttagaacgcagttttgaggaacccgggctcaagctgcatgcctttttgggaatcctaataaagcatatatctgaaataattagtaattctagttatagaacttttatttttaaagttatatgctaaccagcattttctgttctcctatatttatggtgatagttgttcattattatttattaagaaattaacacatctatttatttgtgtgtgtgtgtgtgtgtgtgtgtgtgtgtgtgtgtgtgtgtttgtgctttgcaacttatggagaattagttctctccttgccatatagctcacagggactgaactcaggtcatgtctttacccactgagatatagctcacttgccattaaaataatattttatgactgttagacatttttgatatctcactattttgaccttgttgttataagtttgttaaaagcagagtctaaagccatggggtttactttggttgaggtgtgagttttacgtgtagccctgtcactggagagtccccagtgtgcctctaatgatctctctaacaggaaatcacaaaaatctctaaaaacccaagctcttaaagaaaattaattttgagaataaaaagtttattttgtgtattttcaatttttttcttgaatgtgaatatacctattttgtcatggagaagcatttctgttgttaaggcagagtctggctatgtacctcagcttagccccttgctgcagtttccccagtgctgcttttacacatctagtctgcatgttgcactgactataactatactataactataactatactataacccagtagggtgttggattaatatgcagtctccatttatgggacttggattcaattccagatatttaggtaaatcttggttttgtttttgtttttttggttgtttggttgtttgttttggtttttcgagatagggtttttctgtgtagccctgtgtcagaatttttaaaaataaataaaaatgaagtattaaatctttcaggcatctttattgtagagtatgctgtgaaaagtaagccagttttgttttgttttttaaaatcacttttattagaagcatggcttactgcttactttaaaaattgggccatgaaatcttactgaacatacattttttttttttaagatttatttatatactactgaatatttggtttctggcagcaatatattagttggccaggttgttttaaatttctctctctttgaatttttgttttgtatgttatgttttgtatgaatttttgttttgtatgtatggtcactacgtgtatggttggtgccgtgggagctagaagaggaggccgggatggtgctggggattaattagatccaggccctggaagataagctggcgctcttaaaccctgagtgtgtgtgtagacaatgtgcctttcttgtttttttgtttttaataaggtggggcttgcttgcttgcttgcttggttcctgctttgctgactatgcttcgctggctggccagaaagtgtcaggggtctgcctgtagagaaagcccagcattggcgcttataagggtgacacaaacaattggtaactgagctaatcactctctaaccacagcagtttgaaaatttttattcttaaagctgtactctttgaaaaaggttataatataacaaatgatattttccccttttcacatcataagaaatcttagaaacaaaaattgtaaatctcaagataacaaacaatcacattaaaagaactgaggtatgctcagacttaagactactaatctttgtatgtcaaaggctaagctgtgatctttgttttatgacttggcaaaggagtatttgatctctaattagatttgagttatggagtgtactgactaggtctattggcataaatatgtctttgaatggtgaggaaaagaaactatgatgtctagtataagcaagacagggcagttgcagtctgtcacttgaatcagtgagtttgagtggaaaacaagtttctagggtgctacaggaactagtatttgcatttgggttgtaaatgaaattactgaatgggaaagactaaagagaaaaagatacctatgcctgtttatgaagagggcctgcttttagttctgcaactatctgcagacatttttatatgctatgataatttatgaatgctgtgtttatatgaaaatgaaatttgtgtagatcatttatctcgagttttatatgagtttcagctatttttgtttttttcctgccatcaattcacatgtcattcacatgagtattgggatcctgaagaagccaggctagcctgcgctgcacttagaaatggcgaatgctgaggaccctaagcaaagccaggggactccaccccagacagtgtcacacacaggctctagaatgattcctagccccccttttctgtgctgttaccttggtactaagattaccctcatttgatggtagtaccttgttccatgtgttttataacttgaaacactatactttatagtatttcatttatttcattttacttatggtttcacactgcagttttgtgtaaatattttaaagacagttttaataaaatgcccagactcgccttggacttgaccatcttcccacagagtttcctgattggctgggatcatgaacgtgtgccgtgtttcacagcaggggcaggggaacatggatcatttgggggcaaggagattacttgttggaattaatcatctccttagaggcagatttggggtcctcataggcttagggggaaacctgtcccacaggataccccttcacctcttttggggggggggggggtccgtgaagcaggcagcaacttatgtagcttagttggcctcaacttgattcttgcactcagtgttgcaggatatttgatcacactgtggaaaaacctcgagattgtgctgtgtactggaaaaacctgtttttagttgtagtgtggctcagccttagcatacatacacttttaatccaagagctttctgcttgaatattgtaaataaagtcagccataggtcaagagccatttgataggaagggttattaacaacaacaacaaaaaacttagtaaggagtcaagaggactcctggtagagatggcacaggaaggagagaaagaggcatttctgatggttttttaatgcataggggtgttttgcttgcatgtgtatctatgtgtaacttgcttgtctggaacagatggaagcttggatgccagatcccctagaactggagtttcagacagttttgagccaccacatggatgctgggagtcaaatgtaggtccttttgtaggtagagcagccagtgttcttagctttccagcccaagagtaactgctactctcctaacaagactaattcctaaataaagccacatacttgtgaaagcctattaacaacagctagaaaattggccctgagatgtagttttggaatgaagaacaaatgaagtacttggttccttcaagagtcattccttagattaactgtatcacagtgtacttttgattttgtttgtttgggttttgtttgtttgtttggtttttgtttttgtttggttttttgagacagggtttctctggatatccctggctgtcctggaactcactttgtagaccaggctggcctcgaactcagaaatccgcctgcctctgcttcccgagtgctgggattaaaggcgtgcgccaccacgcctggctttacttttgattttgaaggaaaacaacacagctgattttggggtgaggaatttcctacctagatctgtaggattaagattacacctggacgttaattttccttcaatgatgggcattgaatccaggggctcatgcatggtaggcaggtgttcactgatccccagcctcacaaaatgacatgtataatactttaggataggagataggaagatttaaagaactagttgatacgtatagatcatgaatgaagccagcctacttaagtgaccacccaaagaaccaaaaaagccagctggttgaggaatgcatgtagcagatcactttagtagaataattcaggaacagaacaagcatgtatgtcaaaccatcttgagagaattatgataaaaggttgtctgaacatttaagaataatgacttccagcagggcatagtggtagagcttttaatcctagcaattattgcagcagctccgtgtgcttggggctactattgggttgcaaaggtcaaagtattctacctcgtgtttaatactagtgtttgtgaagaagagtgaggtactctagctagttatctcctgtcccactgttgcatcctattgagaaaacagatactaacattcttaaaatgtgcctaagctctgctttcagatctctggtgtgtgtgtctgtgtgtctgtctgtctgtctgtctgagggggggagaggagggaagagagagatagagatgagagagatatgcctgaggaggatattttatatcctgctctgccatttgccaccttattcccttgagatacaggctctgtcactgaaccttgctagcaatcccaagcggtcctctttctgtgcgtgaacagtgctaacatacagaagcatccatcaacaccctccccatgggtctgctctgtgttgaatactcctttctctgttcagatgtcagtatctgtaacatctttagggacttagtttcttattgtttctctctcttccatcctatagtcaaatttctgaaaacattcccccattcttcccaacacaagccatttcttttttgtacttgccatgttaaccttccaagtattatcctaagagcattctagatactttgtgaatgggataattctagggtccttttatatacttggcattttttgagtggccttattctttgctccccctggcattgtttatcattatctggtaactcagaccatttttgttatcagcccaagcaccagatctgcagtcccttttttttttttttttaagatttatttatttatttatttttgtttttttcgagacagggtttctctgtatagccctggttgtcctggaactcactttgtagaccagactggcctcgaactcagaaatccgcctgcctctgcctcccaagtcctgggattacaggcgtgcaccaccacgcctggcctaagatttattttatgtatgtattttaagagtacaccattgctgtcttcagacacaccagaagagggcagcagatcccattacagatggttgtgagccaccatgtggttgctgggaattgaactcaggacctctggaagagcagtctgtgctcttaactactgagccatctctccagccccagatctgtagtcttatttattaaatttctgttcttggaaacaagtggaataataaaattcacatttggtggcatttatttaatttgagcacttttacaaaaaagaaaaaaagtccccacagaaagtcagttttcaacgtttagttagaattacttagttggcttagttgacttattacaatacaggttggttactgccaaccggctaacccttttgacaaaggtccctattagtgctggtatatggtctttaaaacccagtacatggatgaagagcagaatgacctgttaggggaaagcaagctgcccttttaaccatctaaacactacttcttaggtgtgttagactcaatgctctagactaaatgtcactctgtaccctctgtcccacctcgagtttgctctgctgccatcggaagatgacctagctaatctttccacaattctaattctgccaccaatccttgtgcttgctacactactgtacctatcagccctcagctttggttcctgagaactgctttccgcccaccctttcctctcttcttttctgcaccgcgacccctgcaaagggcaggcaggcattgggcagcaaatgcacagcctggggctcaggattgctttgtaattggtctctgcatcttctctaagtcctttcattctcattcaatgacaccatgaagtagatttttagaattcaaatagaagagctgtttcttatctaaactacttatatccttttaaaaaacaaagtatggaattcttagcataacccctcaaccactgttttatataactggctcacagtcaatgatactactagttcctcggtatttgagtgattggggttgttataattgtacaccggcgtgtgctgtatcacattccattgtatgaatgaggccatagcagtttatttacatactgtaaataccttctcagtgaaatgtctacttctttacagaagttgtatttactttaggggatccagagcagtcaaggatgatgatgccaaagatgtcttgaggcaaggagatagttgacaagggagggattttaaagtgttttcagatacttaactcccatgagtggaggagggatttagcgccgtaggcaccagctagtattagaagcaggaacctgagtagtaaagtcaggctaaactaaaaagcttattaaatcatattaaaagctataataaaccgttgaatcttaagatgttttattttaagatttgtgttttcagaaagatctttattcttaaactgcagactgtatttggcaagcaaggagataagagctcattggcacaagaggagtgaatgaagccagaatggaaagggtttacatacagcaaattactgataacactgaaaagcacaccccatcgtcatggctttaatagaaatactgcctctctaggtctgtccagtaaatcaagtcaactcttagccaacaacaacaataactgctcttgttaaatctccacctgaaattttaaccaggtctatttttgaacttagaacaactccaatctgcttttttagaacttgtcgttcatattacacgcattaacagttgatcatgattataacattttgttattcaactcaaattcctatatcagattcctatatatgctgaatatacatgagctaacaaggcgtgtagtcacatagccagttagaaaactagggttagtacctgagacacctgggttcttcacagaccattcctaacatttggacatgtctattttcatcatgggttaaaaattcaaattgtgcttaaaaaggtggctcctcctcaggatccaggtttgattcctagcacacacatagtggctcacagccatccacacgtcacgtacatgcactctggaaagacattgatacacaaagcaagtaaatgttcactgttttaggtatttttgtctgtcacataagctaagggtggttacagcatgcttacttacctaggctgtttagttcagagttctgggtttggttcacagcatcacacaacattgcaaataaaagcgtttaattaaaggtatttttcacataatagcacagttttcacaattattaccaagtcagaaataccatggcaagtgagatagcttgtaaaagggtctgctccacaggcctggcattccaagtcctggaacccacactggaaggacagactggactctgcaagctcatacacttacatatgtgggatgcatacagtattacatagttatcgggcattgtgtttagacaacgagaaaaccaaagacaagtaaagtattttatggtggcttcacctggagtttacacgctctgtgtgtggtgttgaaaggcttctgaaccaggaagaaaggactgttcttgggtggctggctctggtgcagtttgtaaatgaactcattgtgtgtcattttcagatttggatggtgcactactctcagggcctgatggtgataggaccatgaacacaaatttattggctgaagcctgcagtggtcaagatgctggggatgctggtaggtacagtaagatctttgtcaagaatgtatctgagaggttctgaagactgtagtgtgctcgtgagcctacttggctagtcgtgtgtaaatgcttccaattggagagcattcttaggttagttatggctgtgatgactttaggaactcggtaaatgtaaactggtaagtttggtttggttttgggggtggtgtctgacacatggcctcacatacatgcacacgtgcacagtcataaaaaaaatttaaaaactcataaaaataaatttaagaaaacaagatggagtctctcagagtttgcagtgtttactgatagaagcaagaagcagcaactaaaggttgtcatctctcatctaaaaagttaaaatgctccaaaatcagaagtttttgagcagcaacataatattctttaaaaaaacaaaatcctagatttgtgagctttcgagattccagaattttagaattagagatatcctacctgcattactatatgaatacgttttgtgcatgcctatattggaaaggaatgctgcaggcgagtcagagttaaaagtgccttgcaatgggagcatagttactaccatggaaaaactaaacagaggtccttattgttggaatgcagcagcccaaaggggcagttggagagaacgctttcatcaggttgtcttggcttggctatagaaagtgcagactcactgtgcgttacatgggtaaccctgttccttgcagcctgtcaggctttgtattagcctggttttgttttgtaccagttttttgaaacagggtcttactcttccttgtctgactttgtttcaacctcccagtttggggtttttattgttttaaaaaaagaatctgtgggaggtgtggtggtacaggttggtggtgaggcaggggtcccaagttaaaggtcattctctgctaccatggcaagttcaaggccagcctgggctgcataaggccatgtctcaaattggaaaaaaaatgaaatggctgtggctgaatgcaaactgggaaattatttggtggccactaaaaaagaagccgtacactagaattgatggttgattggatcaagtggcaaaaactaaagataaatgtatatatctatagatgtctgtgtatatatctatatatccttatacaggaaaaatctttgacccaataaattatatataaattttaaataggattaaattaagaaagaggtaattcctgactgtgttctggttttagttactgtagactaggcctttgttgctgttttctgtggcttttcttttttccattaagctcagactgttggaggttcaggtgtttatatccttagagtgtgggaattgaatccaggagctcgggtttttgttcgggttttggggggaagacagatgggaaggagttgggtagttttgagattgggcttccttgtgacacatagctgactctgaattcagtcttccaagtatgagccagcacatgcagcttgatttagtttatgttaagataacttatcattgttcttataattgtattttattttctctggctctaattaagagtttttcccaaccattacttcaaaatcacttttcaattgtactaggagcatcacatgatttcaagtatggtttgatgcctggcacttcaagtgatttcaagtatgggttgctaccaagtacttcaaatgacttcaaattcggattgctaccgggtgcttcaaatgatttcaagtatggattattgccagaatcttggcccacacaagaaacgtgggaaaatggcaagtattggtcaactaaacaactacaaaattctaaaattccatgattaagtgcttctgagctgtgttaataattgttattcctatatggttaaatatagtattgataggtgctttctctttaataatatattaaccagtacatttttccctttaaggtgactcatctctaatcatgaacaagttgaaatgccctcattgtagctatgtagccaaatacaggcgaacactaaaaaggcacttgctcattcattctggagtaagatcatttaagtgtgaaatttgtggaaagatgtttactagaagagaacacgtaaaaagacattccctggtaagtgccttgaaacgctgttgatcatggaggtgtgtggttttatgccagggatatgtctgcagatcgtggaggtgcctggcatatacttggcaaatttaaggaagtatgctaagctgctttaaacagaattatttttgaagtgatattgtacttcatttagaaatagtaactgtcctttcattactaattgtatggcttaatttgaatggctcaaatgctttctttatctgtactactgttatattgagttcttcctctttcaattaggtacataaaaaggataaaaaatacaaatgcatggtgtgtaagaagatcttcatgttagcagccagtgttggaataaaacatggttctcgacgctacggagtatgcatggactgtgtagataagtcacagccaggaggacaagaagttgtaaatcagggacaagatacagagttccctcgggatgaagagtacgaggaaaacgaaggtggcgagcccgatgaggagctggctgaagatggacaagatgaaaacgatgcacctcgatgggatgagtcaggaggcgtttatgtctctggatgattagctgacctactatgttcctcaagaatgctgcattggacatactatgaatcgacaattcggattgttgaacttgaaggcttgcaaaatatggtacatgctggatggtagttttgttgctgtgaaaaactgtagggttaaagccttatagcaaaaaagaatttttttatatttgcacaggactatacagcaaacaaccatgtggttggatacatggagtcctcacatatttcagtcagttgtcaaagtaaactattttttatttataggatatacagttaactatttgggttgtatgaaaatatagtccttgtcctttacagagcttgcttacattcatgtgccatttaacatgaatgaggaaatccatttatggaagtacaatgacagtgacccaatcgctctgccaatcaaaccactcaggctagtttgtactagtagagttttgtttctatttttattttattaattttattttttttaaatacagattttcagtgaggggctttttcaaccccattggttctattttcttgtattttttttttcattttatttgcttcataacttaaaccaagtctcctctagtcttagatattatttcttaatttcgtgctgataggcatgcttataagaactggagaggtaatttattggaatgaactgactggctccccgccctcccttccctttttgacatgaattttactacttcacagatgaagaatgatgttacaaagttaccatggtgacgctgacaaataccactaaactgattatgacttagaagtaactttctcctgctgctctgatctgatagatggttgctctatgatgtgttctgacatggggtctggtttttggggatctgttactttggcactattcttgtttgcctcttagtgtactatacctcagccttatttgaaatacagaagtctaattgaagaatagtcctaggaaaatacataaaatgatttgttttataattcatcccccatgtccagtttggttagcttgttatgcaatataagtgaagtatcaggttttttttctcctgtgcccatttttatcattaaaatgaacacaaaatgtgcattctctttttgtttcatacttaccgggatgttgagtgtttttaaattgtagctgataatatatttttccattccttaaagtcaccacaccttgatgaaatctttatagtctccatgattcagcaatctacaaaaaatactacaagtaaaatgttgagcctttattgttccattatctaaattcctcaggagtcagagttcttcacacagttgagacttagtttatgtagccaggtgacggacgactgagcggacagcagcacgctcagcagcttgtgacaggctaacgtgccgtgtgtcaggagcagagcatatatataaaaaacagagacaccatattttcaactttcttttaaatacaaattgagtatattttcctattttatatcaagtagctaaattatgacagttgtgtggagaaaccacagagctgctttgacagatacaatctttttggtgctccatctgttcaaagttgaaaagttgattttctttttgaaagagacaaacttcatcattgcctctgatttcagtagaataatggtttgatattggacagtgacttcctgcatggataaatcagagatgaagtagtcatgttacatgttgagacccacctattgccctctgactcgtatggcagtctctgcatcccttggggatggcagaagagtttcattctggtttctgtttgaaatgaagagaaccccttattctctgtgtttgaaacaaatgagtgaagtgtaattctagaaaagtccaaagtagactaagttgggcagagatattatgatgaaaaagtattttaaacgtaagatgttgtgctttgtgaatatgtaagtataacataaagatttcttccatcccacctatccccttcctttaaaataaaccatagtttacaattggtagatctgtctatatataaatatatattaaagagcaaatatatatatttaaaaaaagatcacctaaatctgctttattagacagtagctcactgttgcgtagaaactggacgtggctttacattcttaatgtgctttattttcctcaagataggaccttatcttgaaacagaatttcctttattacttaaatcatttatgtatatctggtaaattatgaccaaatttttgttagattgcacacagtaaattgaaatacacatttggtacactacggaattgttgtgcttttgtttggtttcagttggaaacaggttcgatggagatgactttattactgttaatttaaatagtctataattgtccgttgccttttatgtcgtgttgtgacagatttggctatatttttagtcatctgaaatatactttaaaaagtttgtttttaggtaatccaaaggaaaaatgtttatactcttgaatatatatttgcctcagcctatattaaagtttctttgaagtaaacactttaccagaaacagaattgacagatttttctacttgctgactgcctaagttattttgtttcatggtcttgagaattgccttttctctagacctttttttaaaagtagttttagtactaaggtatactactggacgctcctatttttttaagtatattccttttctgacagtacaacttcaggaagttgataaatctctaagaagttttgattggtctcagaaaggtaatggattgaatactcagaattttgtctgaaagtctggcagagttatgttgtacatttggtgaagtttttcatgtaatttatattttaaataaaatatttttagagtttttaattttaatgaaggggaagaacatacactttcatattccacagtggtaatgatactatgtcataggttcagatcatgtgttattctcccagacagtttcttccatatggtctctcatttgtcaaggttcttgactcaatttttttactagacaagttgctaaattttagcaccctacaagagctctgtgtgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnncaagagaagaagtaaaagctggtaggaagggataaatcagggaagtgaggggccgggacttgcaaagggccccaaggatgaggagtgggtgtgggaggcctgacaggaaggaagctctgggaaacatggagtaagagatgtagttctttggtttatgactcaaactttctggtatgcccacacttttgtgttgtctgccttactttaacctataaggtaggtgctattctattttacaaataaggaaaggctcagagagattcagacacttgcctaaatgaccgcagctttctgtggagcggggattagtcaggtctggttcgaagccctgatttcctccctgtgagatgctctgttaggagtcctgttctctttggaagttgcttttgtcacttttgactcaagcacacctcactgccatcctctgtgagtggctgggatagtttcacttaattttaaaaggatggttttacaatatgaagaagtagatagaagccccagcttgtgtgccgttcacacccggatccttaagcttaactatggtacccaatctacacagttagaactaacaggtgttttcttagtttaggatttaaagtaggattatttattttgtttcttccctatctgctgtatcccagtcttcaagtgaagttgaactaggtagtttaaaacatgttagggataagcacactttgaaagatgttttcttgccctgaatttgagggcactgggcagtaaatttggaatacactagctattgagaacaaaatttgggggttaagaaagggatgattgaggccattatgatctgggagaagcagcatcctaaacactgtaaacaactcttctgcctgctgtttgtaaaagctctctggcaagatcttttacaaagaccaattttcttttttaaatgtaatttacctacctaatatttaaatgtcctgagacatgtatgtaaacttccaaaacctgtttgtctgtgtatttagaaaatacacaagaatctttatcaaacataaaatataaacttgtgagcactaaactgcttctggctttgtgaattttattgacccttaattgtgatttatttgcaggggtgctagtttagactcactgggtaagggaaccaccgttggaaggttagacactgagatagatgcctttgtacttggagtttacgagtttggattacagagtctgaggagggttgctaatggttccttggtatggaagtaagaaataaagctacctctttgcaagaattcttattcattatacttttagaatttttacaggatttaagaaacactgaaaagttccctctaatcacttctaatcgtttctcttggaaatgggatcgagactcaaaggtgaagcactacctcatatatactgtttattagacagaacatcaacttgtaaacaagtaaatatataagattacaaatttcaagcctttgaaaatttacttagagagttgcctctttgctgggcagacctcacctcagactcaaggtcatgtgtcccacccagcctctgaattccaggactaactaatgccgtctactgcaaccaaccttttgagttactaatgaaacagaggttggtgatggcgttggggttacggaggcacggtgcatgtgttgggtatggaattaagatgtgttcggtgtggtttcaagagggaatgattaggagcacttaagattaaaaagcagatcccagcactcgggaggcagaggcaggcggatttctgagttcgaggccagcctggtctacaaagtgagttccaggacagccagggctatacagagaaaccctgtctctcgaaaaaccaaaaaaaaaagattaaaaagcagttttgaagttttcaaagatgagatggggcagagcagttccaccactgagggttctagatgtgaaaaagattgacagccaccctggctaaagcagtattagccaaataggtttgtttcacagtgagtcttaatacttctagagagttagaaccatgatagttgccaactttatcttcttgcttagtacatgaagtaaaattgataaaatgtgttctatgtatgtgcagacatcttaagacttgttttaatgctagtaggcaatttagaagtcaagtttagccttaagtaaaatgttatgtaagcttttcactacaaatcactgtcatagtgggagctggcaaaaaaaaaaatatatatatatattggacttatcacaaaatggttttagaactaagcgtggcatggtggctcactttaatcccagcctccttggaggcagaaaccacaagacttctgtaaagttgaggctcgcctggtctaaatactaggttctagagcagccaaaactacagagcacacatgtctcaaaaaaacaaaagaattctttagttttagagtttagtcactgccatgattatcaccctataaattctagagttattaaaacgaactggaggaaatctaaaacaaggtggccccgagctggctacgaggagactgcctctgaccctagtacacgaggtagagagacacctgagctcctaacagcaagtttttccttccacagggtcatagttcagtttcttcaaaatatggttcagtcttaaaacttgacaataagaaaaggtgctgattttcagttttattcggtgtctgctaggtcttagggacagaagactgatttcttggtacacatcacagcagttacaagacaagtggaaaattgagtcaaacagaacccgagagttccagggcccaggactcctgaaacgtccttcagtatgcctccaacttgttccatttggaagtgttgcctgctgtgagataacagtggtcacttgagccttagggaccaccttttctaccaagtatagaacacggctgacaggccatatttcaagatgaaatgaccaaacaacctgcagcaaacagcattgatttatatttacactatcatcaacgtttagaatgcttcaaaaccactggaccaggcatttttagttggcaagttttttgtacttgttaagaggcatattggattttgtcatacgagagttaacccctgtcaggttgtccccgtgtttttaaaattgtgtatgcaggcttggatgccgtggtccatataaaagttaaaccatgaaagactaacttagtggggtcatttctttctgcttttatgtaggttccaggggttaaaaaacctttattcactgggtcaactcccagcattgttttgagacagggtccttagctgcagctagcccagactgctgtaaggctcaggctgaacttgctcatcttccacactgctagggtttacatgcgtgtgccaccacgctgcttttgcaccccttaatagtcaagtatttgctcagttctaattatcttgacacgtgcatccgtacgagtcggtgattccttcctactcaggactctgatcagtgtaggaactagcagacttgttttaaggagacaacataaatctctggccatgagagcactccaatgggcagcacagactagccactgggccacatttggatattgaaaaatgccatctcctcataaccctgatgacttctttcctttctaaggctggaggtgtacagtaggaaaggctagcaccatcaactaacaagcataagaccctttctatcacagtattgattaagtagggagaccttaataggcagccaatggttccctgccctgctgtccaatgtgtttccctgtctcgacaccctggttcccaagagggaaatcacaaatccatccagttcagacttttacttgctgatnnnnnnnnnnnnnnnnnnnnnnnnnnnncctgacctttccctttctgggacatggtctcttgctaaatgtggttactctgttggccagcaaaaactcccagaaatctgtcttcacatcctcccatgcaagggctctggacttgcaaacactctaccaactgccttttccctgtaggtccagctgtgattgggtgttgtactgctggctcacgtccttacattaatatctattcaatgccattatttctaaagtttgtaacctgaaaaccctgggtagagctgccgaatgaatgaattcctaacaccgagtgctatcaaattgaaccagaaatctgttatcagatgtaccgatttcctgtaagaccatacaaggactcagattctgtggaggtgtcaataaagacatgctaattttttaagactgaagatcttactacatattttccatttaaaatacactttaaaatagtgatggtgcatgctaataaaccagcacaagtgggtagaggcagaataatcggagttctagtgattgactgtataatgagttcaggaccagccttgtttgcaaaacactaacacatttctcttcatattaagattaaacttaagagctgcactctggtttcttttcagattctatgtcttttactccgtagactttaggggatatggatgtagctcagtaaggattacttgcctagcatgtgcaggccctgggttcaacccctaaatgtccatgagtttggttctaaaggatctacagttctgttgctggggctacggagatggcttagcactggctgttcttgcataggagcctggtttaatccccagcacccatggggcagctcacagctgtaactcctgtcccatacatgcaagcaaatcacttaagatgcattaaaaacagaaaagttctgctgctcttccatctaatgagacttctagcaggagtgtctataatcagaaaaggcgtggcagaatactgctggggacatggtcactggataatgactgaggttgctatggggtcacatcctgctcagcgcatcacagcctcaatgctggtgtcagcaggtaaatgaaattagtaaatgaaattgaaaaagcttctaaaagctaattgctaagtccacccagtcagcattattgagcattactaatggctgcatccattgacactcctttatttgacctcatagaattggccgttccagctttgttcaaatggtgcatacctctaatcccagctatttccaaggctgaggcagaaggacctagtgtgaggagtttgaagccagcctgggctacatagacccaatacaaagtggaacaaatgatggcgatccctagcattctttcctgtagtgttcctttcagttatagtgaccacagtggttaatctttgacttctccccgacctcttgtcagagctcctgagtatttagatggcaccacatctaaatgtcatttggtgcgcacaggatcctctggcatactccctacttaagtaatggctccttagttgctactggacattgtttgactccattacagtgaactgatagttacacggcaaggccacttagaaagatgaactactttgggctggggaatgtggctcagttgctggaatgctggcctagcgcatgcagagccctgggtttgatttcctatgccaggtaaacccaagcaccattgtgcacagctgtaatcccagcactgaaccggaggcaggcgggctgtgtagcaaggtggaagccaccctgtgcccagctggatcagcacgtgcgtgtctctcacaactacaacgggaagaacatttcaggagtgccccacaccatgttcttttagttggaaccttcagtaattcttccttgagctacgtgaagtagaaatctactttcttggagctcccactcagtaaccctccctcccatctccagaagtcaccattggaagggatgcgctctcccgtgttcagtagtggactcgggaggaggtataatggatctgagccatgcttagtgccttagcagttgatcatgcctaggaaagagtccactttctgtgtgagaaccccatgttgcctgttcttggaatgatttaggcatcactttgagcctaagagttgaacagttaatgtgaaagactagtgcaaacgagaggggacagagcacctagagagagctctgtaaagcaacatgtgacttggctgtacttggttggcgcttggagaagccatcttaaccttatgttaaacttgcaacgtggaatcaatgtatatgtgctttaagaatttcataatttggtttaatgcagcatattttaatacatgtttaattactaaattccttccagaagatatattgcagaagatgaaaggctttcttctttaattgcatttcagatcagtatctaaaggaaatgagaaatacttttatctttcttattaaattcttatgaaaccaaatctcaaagtctcaagcctttttctttcgttcttttttccttttctttcggtttttcgtttgtttttgttttgctttttttttcctttttgagacaggttgtcctatgtcgctattcctgactgtcctgaactcactatgtagaccaagctgacctcaaactcagagatctgcctgcctctgccttccaagtactgatgtgaaggccgccatgcctgagtctcaagctgtttcttcctgggcttcttttgttctttttatacagtacatgcacacttgtgtgtgtgtgtgtgtgtgtatgcgcacgcaagatgtgcaagatgcacacatatgcatgacagaatgcttgtaagcacctgttgcatcagtgtcctgctctgtcactttccaccctattctcttgagataggtctctccccaaacctagaccaaggctgccaggcagcaatgatgtccccacacccagcactgctgggattacaaatacatagattcatgcctgaccttttatgtgggtgttggggtttcaaacataggac

SEQ ID NO: 14 - DNA, 2186 bp, Mus musculus
ggccgccgccgagacgtcaaggaagttgctgctgctccctcaggacacgggcggcccctccttgctgggcggcggcgcggggggccccctgctagcggaaaggaaccgtcggactctggccttccgcgggggaggcggcgggggtctcggcaacaatggcagcagccgcggccgcccggagacctcggcgtggcccctcaggcatttcaatgggcgagggccggcggccgtggatccggagctggacgcgctggaggggaaggagtggatgcaggacggggcgtccctgagctacagcaccgaagaggagggggcgagcccgggcgatggcagtggggcggaaggcggcagctgcagcagcagcaggcggtcgggcggcgatggtggggacgaagcggagggcagcggtgtgggagctggcgaaggagagactgtccagcacttcccgctcgcgaggcccaagtccctcttgcagaagctccagtgctccttccagacctcttggctcaaggacttcccttggctgcggtactccaaggataccggccttatgttctgcggatggtgccaaaagatccccgaggatgggggcggcgtggaccttacccaggtggggcatgatgagctttcgcgagggacccgcaactacaagaaaaccctgctcctgaggcaccacgtctccaccgaacacaaactccacgaagccaacgcccaggagtcagaaataccatcagaggaggggtactgtgactttaatagcaggccaaatgagaactcttattgctatcaacttcttcgacaactagatgaacagagaaagaaagatattctttgtgatgtcagcattgtggtgagcgggaaaatctttaaagctcataagaacatcctggttgcaggcagccgtttctttaagactttatattgtgtttcaaacaaagaaagccctaaccaaaacaatactacccacttagatattgctgcagttcaaggtttttcagtcatcttggacttcctgtattctgggaacctggtgctcacaagccaaaacgccattgaagtgatgacagtggctagctaccttcaaatgagtgaagtcgttcaaacttgcaggaatttcattaaagatgccttaaatatcagcattaaatcggaagctccggagtctgtggttgtggactataacaataggaagccagttagcagggacagcctgccttcatcctcacgggaacagaagatcgccagcttctgggcaacgcggaacctgaccaacttggcaagtaatataaaaactgaaaacgaaggctgtgatgtcgacgagggccaagtagaaaactaccagatgaatgacagtaactggatccgggatggctctcctgaattggctgaaaatgaatctcaaggtaaaacaaaagtgtttatttggaataatatgacctctcaagagactggcaaagcaaggagaaaaaaccaaactacaaagagatttgtttataatataccgcctaacagtgagacaaaggtagaagattgctcagtgatgcagccccctgctgcctacccagaagaaagcaaggccttactcatcaaggaagagccagatttggatggtgcactactctcagggcctgatggtgataggaccatgaacacaaatttattggctgaagcctgcagtggtcaagatgctggggatgctggtgactcatctctaatcatgaacaagttgaaatgccctcattgtagctatgtagccaaatacaggcgaacactaaaaaggcacttgctcattcattctggagtaagatcatttaagtgtgaaatttgtggaaagatgtttactagaagagaacacgtaaaaagacattccctggtacataaaaaggataaaaaatacaaatgcatggtgtgtaagaagatcttcatgttagcagccagtgttggaataaaacatggttctcgacgctacggagtatgcatggactgtgtagataagtcacagccaggaggacaagaagttgtaaatcagggacaagatacagagttccctcgggatgaagagtacgaggaaaacgaaggtggcgagcccgatgaggagctggctgaagatggacaagatgaaaacgatgcacctcgatgggatgagtcaggaggcgtttatgtctctggatgattagctgacctac

SEQ ID NO: 15 - protein, 723 aa, Mus musculus
AAAETSRKLLLLPQDTGGPSLLGGGAGGPLLAERNRRTLAFRGGGGGGLGNNGSSRGRPETSAWPLRHFNGRGPAAVDPELDALEGKEWMQDGASLSYSTEEEGASPGDGSGAEGGSCSSSRRSGGDGGDEAEGSGVGAGEGETVQHFPLARPKSLLQKLQCSFQTSWLKDFPWLRYSKDTGLMFCGWCQKIPEDGGGVDLTQVGHDELSRGTRNYKKTLLLRHHVSTEHKLHEANAQESEIPSEEGYCDFNSRPNENSYCYQLLRQLDEQRKKDILCDVSIVVSGKIFKAHKNILVAGSRFFKTLYCVSNKESPNQNNTTHLDIAAVQGFSVILDFLYSGNLVLTSQNAIEVMTVASYLQMSEVVQTCRNFIKDALNISIKSEAPESVVVDYNNRKPVSRDSLPSSSREQKIASFWATRNLTNLASNIKTENEGCDVDEGQVENYQMNDSNWIRDGSPELAENESQGKTKVFIWNNMTSQETGKARRKNQTTKRFVYNIPPNSETKVEDCSVMQPPAAYPEESKALLIKEEPDLDGALLSGPDGDRTMNTNLLAEACSGQDAGDAGDSSLIMNKLKCPHCSYVAKYRRTLKRHLLIHSGVRSFKCEICGKMFTRREHVKRHSLVHKKDKKYKCMVCKKIFMLAASVGIKHGSRRYGVCMDCVDKSQPGGQEVVNQGQDTEFPRDEEYEENEGGEPDEELAEDGQDENDAPRWDESGGVYVSG

SEQ ID NO: 16 - DNA, 41498 bp, Homo sapiens
tttgtttttttgagacagtgactctattgcccaggctggagtgcagtggtgagataaaggctcactgcagcctcctgggctcaggcatcctcccgagtagctagaactacaggtgcgcgccaccattcctggctaatttttaagttttttgttgaaacgggagtctcgctatgttgcccaggctggtctcaaccttttgggctcaagcaattctcccaccttgacctccccaaaatgctgggattacaggtgtgagccactgagcctggccgttattactcattttgatcaccaatcagttctcctttttataccttcagagactttgtggccatcaggttctttgaacattctgagcctatttctcatacatgcagtttttctcagcttcacaaagacactcttaatatcttgtcttaaaaacatggaaatgagagttttagaattctttaggcaagaaatcactttgagtctaggagtactaaactcctattttcccaattatttctcaaagagtcccgtttctgagaggaatttggccacatcttaacacagtcatgtactgcatgacgttctcaaggatggactgcatttatgataatggtcccataagattatagcggagctgaaaaattactatcgcctggtgatagcgtaaagttgtagcgtactttgttttgtaatcccagcactttgcggggccgaggtgggtgaatcacttgaggtcaggagttcgagaccagcctgaccaacatggtgagaccctgtctgtacttagtgtagcctaagtgtacggtgctcataaaatctacagcagtgtatggtaatgtcctaggcctttcattcagtcaccactcactgactcacccagagcagcttccaggtatgccagctctgttcatggtgagtgccctataaggtgtgccatatttttactgtacctttttcatgtttagatagattagatacacaaatactattgtgttacagttgcctaaagtattccttacagtaacatagtgtacagatttgtagtctgggagcaataggcccaaccatatagcctaggtgtgtagtaggttataccatctaggtttgtgtacgctaaggcacagtgacaaaatcgatgcatctctcagatcatatccctctcgttaagtgatgcataactgtatgtcatgaaaggttactttcctctaagtaagaaaagtatctttttgttaatcccttggtagttaccaaaaagttaatccttctgttaattggaccttggttattgtggactgttcatgggaaagtcttttaaaacatgctttctgagtctgtgttttgagccttctatttccgaggtgtccctgtatttataaggatgtgagggacaattaatagtttaattttgagtaacaattgactacatcgtcagagtcaggtttaatgattagctcattcagtatctgaccatttggcccagaagactttaaaattccttaataacagtgattaccagttattcttggtttagaccactttctacctaattgtgaaattttcatagcctaaatcacacatcctgtcaactcttcctgggagaaacatgcatccaaatgtattattgttgtaaatttagttaacctttacagaaactaagtaatgaattcagaccagtgatctgattgaaatttccagttggaatatattgatgtcagtagctgagcaaacaaaagaatgtaaggcagatctatcagcctaatttgtttatggcagaaataagggcggaaggttggttggttggttacttggttggtttttaacactttaggaagaaagtctgaaagacctttcactgaggaaaaatcgattagagttgagcctgtagcccattaaattccgttgtttcttatttatatattttacattatttataatttattctttgtgttttattcagtaacagctagttcatagcccttgtgcttttcaaacttgttagcagtgtctgactgtataccttattgtgtacctaggattagcttccttctccatcttaaatttagctgtattaggttggcaaagcactggagataaaaatctgtatgttttgttaacattcattctctctgccctcaaggaacttgtagtttagtaaggagagacagacatgaccgaaaaaagacacagataacatggtagcagtatataatcagggtacattgaagaatttttttttttttgagatggggtctcacttgtcacccaggctggagtgcagtggtgtgatctgggctcactgcaacctccgcctcctgggttcaagtgattcttctgcctcaacctcctgattagctgggactacaggcacatgccaccatgctaggctaatttttgtatttctagtagagacggggtttcagtatgttggccaggatagtctctatctcctgatctcgtgatctgcccacctcggcctccgagagtgctgggattacaggcgtgagtcacgcacccggcctgaagattcttaagggagtgatcagttctacctgcaaaggttggaagaagcttgtacaactgattcttgaattttaattgcatttaattaataggtgttgaccaggatggggagggcatttaggcagtgcaattagaaacagcctaaggaggagccaggcgcagtgagtggttcatgcctgtaatcccagcactttgggaggccgaggtgggtggatcacttgaggtcaggacttcgagaccagcctggccaacatggtgaaaccccgtctctactgaaaatacaaaaataagccaggcgtggtggcaggtgcctgtaatcccagctacttgggaggctgaggcaggagaatcacttgaacctagcaggcaccccactgcactccaactggggcgacaagcaagactgtgcctcaaaacgcgcgcgcgcgcacacacacacacacacacacacacacacacagcctgaggaaagtgaagaatggtatcttagagaagggagagtttggttgctgtgcaggatgaaaaatcaagtttgaatagatagactggaggtcatggaggatctcttgtcatgctgaaaacattaaattttattgtcttaacaaatgggcaacaatagcagttttaagcaggggagaatcattatcaaatgtgtatgtgtttcaatctagaggcacctgcgtagtgtgtatgtgggtttagagtttgaggagagaactggttggcaggatgttataataacctgaataggccgggcgcggtggctcaggcctgtaatcccagcacttcgggaggccgagggggatggatcatctgaggtcgggagttcgagaccaacctgaccaacatggagaaaccccgtctctaatttaaaaacaaaacaaaaaaaaaaaaccgagccgggcgtggtggcgcatgcctgtaatcccagctactcgggaggctgaggcaggagaatcgcttcaacgcagaaggcagaggttgtggtgagccgagatcgcgcccttgtgcttggacaacaagagcgaaacttcgtctcaaaaataaaaaataaaaaataacctgaataaccatcgtctgtctgctccctaacactcacaggattagaatttctggggatagtacttaagctaccaaagaggatgccatcactcagagatatagaggtgatcagaaaactgcaaaagagaccttcttgtctttttctctaccaactgttatgatttgtcattgccactagcatgtatttggcaaaacttgctatggccttgtttgtcttccttctataaaatgaatttgttctaaaatttggaaatagaaattactgtttttgttctttcagtatattccagtgggttgctgcagagtaatatttttatgttttcaatgcttttagtttacacttaaatgtttgtgttggaaatgtcttttctgctaattcagttattggaaaagggctgtaattgagtagggtagtaaatactaattgcttgtttctttaactgaataacattttcctattgttaacggattgactacaggtgtgctgtttgactttctattacttgtaactgaagttagcctctcttcctctacccccgcaaaagtgtaggagactgggtgatggtcttgtattctctacaagttggtggcgttgtttaggccccaagctggaatgctgatgaccctatgattctctccctccaccctttacatctgttttatcatgcaagttctgatgatttttagactatttttctaggctctgcttcacacctcattgacacctatcttccctaattaaggtcttttttttctggcatgtatgttgccctattaacagtagctttccagagggtacatggctcacacctgtaaacttagcactctgggaggccaaagcaggaggattgcttgagcccaggagtttgagacaagcctgggcaacacagggagactcttatctctacaaaaatttaaaaaaataaaataactgggcgtggtggcacacatcttatagtcccagctacttgggagactgagacaggaggatcccttgaacccaggaggttgagggtacaataagccatgatctaaccactgcactccagcctgggtgacagagtgacactgtctcaaaaaaaaaaaaaaaaaaaggaaaaatagctttccaactgatcacagtatctgcagtcttcattccctgataataaatctccaccttgctgccataggcatctctcctctttgctatttcgattatatcactgcttctgaaaactctgtaaggtgcctatagcaatggttctaatatttgggagggagaaggggattcaaatctctctctctctttttttttttttttaaggagatagggtttctctatgttgactgggctggtcttgaactcctggctaccagccatcctgtcgccttccaaagtgctgagattacatggcgctcttgtcaaaatggatggacatttacctctgaaatgtgcccaagtgcatatttgcattccgtagggctttttagaaaatcacattgaagttcttttacaaatcttaacttttgaggatgctatagaccatcttatgtttttttaaaatgctgggtttttgttttgttgttttttttttttttaaatgccgtcgcatttacttgaagtgctcatccacccatcccactcttggatcctttaaagctctgctcaggtcttgtttcttcgaaaaagcatccccacactttaaaaacaaaaaactggattagatacacatgctttctgctcttataacaccttaagagtcttacccactaacagtaacttcaaattagcaactgaatcattttgcttcctagtgtagaccctggccaaagtaggtattcatttaatgtttattaaataaatatgtaaagttaggacttttcaagcattttcctttgagtaaaatatttactattttgtagcctatgttctggaaatattgaacatctagataataggttataaggattttaactaactggacacttacctatattttctaaattttggaagacttgatattgaggtctcatccagactaaagttttactaaatggcatctttacaaataaaaaaattcaagatttcatatttagctctgaatgtctgtttctttaaaatctccttgtttagccagtttagactaatgtctgagctaattgtgttttcctttttgggagagaggttagaaaaggtcactacatttgaaaagaccagttgtggaaatagtaattttttttaacttatcagtgatatctgatgttatcagtatactaaaagtggacatagaacgttaaagaaggaaccaaagaggcaaagatacctggagttattagggacctattttgagattttgtctctggcactaagaatttattaatttattgagtttagcaaatgatattggcagtttattttagtgctttgtgcttatttagctctttaacccaaatcctctaataatgatctccttagagagtacacatactcttggaaatgattcattttttttgaaggtcatatttatttatgtggtttcttttttttttttttttgaagggcatatttaatagctgctgcaaacatatggaatagtgctttaatcagtggtgaacaagaaattgctgttgttggttataaaaacaagggacattaatgttcttgttcttgtaccatagtaatgagaaaaaaaaatagtggttgaatggtgtttaatttgtacagtttgtgtcaaagtagaatgggcagatattttggtggataggcttttgtcttagttataaaaattaggacatttggtatgataaaggcagagaatcttaacaattggcactggcccagaaaattcagggtgcagtgaccatagcgtgttatgactgctacagtaggcatagccacctcctgaagtgttttcaactgcttgatatacggactttaggcagttcttgacttgtacatgctaattcactgcttccacaaacagttcatagatatatgctgccagatatttagtgttgaaaacttttgcttcttccaaatattcatacaatattcatgcttttactataatatatagtagattgaacactgaaccaaatgagcttgggttcaggtacagcttgtgtaacaaagcttttagtgttgggcctgtatcaaagcaagattcttcccccttatttgtaatttctatagagagcataggcaaattaataaaatttactcagtctcaaaagggaaaccaagtaaacagaatgatgcttttgtggaaagttacactgtccaagtaattgttacaggtgtttttagtatcattctttacattttcacacaagtcctaaattgttcattcctctttgctacatgatacgaaatttcacaacatactggttttttttttcttttaaccaaatatttgcagtaatccaatacaacatactggtttaatacaagagcttaggttaaataagtctcattattaccttatttcctttctccagttccccaaaaacaaaaataagggtattactcatgaatggacttgttttgattcctctatccgtgacttaacagtttttgcagaattggatcttttggtaggaggagaaaatagctaatttagagcatggaacattattatatggtgggggggggcatgggtgggagttttttggtataagggctttatgcacttggcacaagaagggtatgggaaggttgccaaggatcagtcaaaaatgaggaaatttctctactttgtgtgcttcattctgtagtgatcatatactccagattcgtagagtttttcatactattccattttcacagtgaaacagttgaagtgtgtcctggaatctttttttttttttttttttttttgagacaggtctcagtctgttgcccagactggagtgcagtggcatgatcttggctcaccacaacctctgcctcagcctcccaagtagctgacattacaggcgtgccccactactgcccagctaatgtttgtatttttagtagagacggggtttcaccacattggccaggctggtcttgaactcctgacctcaaatgatctacccacctcagcctttcagtgctgggattacaggcgtgagccaccatgcctggccatgtcctggaatattatttgggttctttcagttgacttctcatacctgggagcagcactataatttttagatggactgggttagtttcagagaattgagatgacagcgtctgtggcctcctgtgacatgcacccaagtaaagctaaaatttttatgatttagccatgcacatgattgcattaagtcatgtttcgtgattgtttagggatccaccatttaggatattgtttgtgagactacttttgcagtctcgtcatctctacaccactaactctcttctaagcatgtcagtactttgagcctgtttacactctagtgtttatttctccatgtttttctccatgctcgtaaaatcatagatccatacatatgtgtatatattttattattttatagaaatggtctatgtttaacttaatattttgtgccaaagaattgacacttgaataaggtcagtattttcagttatcttttctactagaaatggtctaagcaatttttctcttgggaaagagatgattacttcatttgtttagcaaagtgtggcaggcactaatcaaagtgctggagggatattcagctctgccttgagggagcttacccacctagtcactgtatgaggaaagtcataaagttttaactaacatttgtaatactgacttatcgtttaaggaaaaggctcagggatagtgactttccaaggacacgcagttaatggctgatacagacagcattctgaattctggatcatacttttattcttacgattatatcacataattttaattgtgacgccaagtagaactataatgaatacctgtatgataagaagcaaaatttataaacatttagaattttgaattcaggaattttaatttaccttacagtttatagtacttatgaccctaaagagataaagcgttttgaaagttgataggaaattatataactagatattcctatagttgaagcaaattttccccttagggtcttacctttatctctagttagatttaattaacttcattgacctaaactgtttgattttaatgtttgccaagacttaaaatttacctttttattaatggtagatagggtgatatgcctagcataaaatataacttggatattttaagttcaatcgggggagactgttgcttttctatagagataaagcaaacatttaattcctataagagaaagtttcttttcttaagaaaataattgctctttttaattttaattttaagaaattctcaattcatgttcttagcttatatttgaaacatataacatgatgaatgttatttttaaaatgaaaccctgctgatcttcagtcagatgtgtttgatttttttcttttttaataatagcagtgggttgcaccaccactgttcactccatttcttgattactcacaaattaatatatttgattatcgctttttaaaaacttgataattgttttccttggtttgggagtttttaaaaaagtcaataaagtttaatattaatgttttttatccaattacaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccaggtaaatattatctatacaaggatacttccttgttcatcctaattctagttggatataatcttgaagtatatttttaattgaattattttagttataaagtaatactaaagttgtttacaaaagaagggggaacgtcattcaaatgcataacatatttggtatattttctttgtcttttttcaacacatatatatgtgggtttatcaaaagatgtattaatagccaggtattgcatatattgtcaaggaacgtggactctgctgcatgtacgggtctttgactttcctcatttttagcctctgtgctcactattttatacccagtgttgggaaagatagaatctttagttgtaatatataatcactgtcgtttcagagacccccttaaccttttttattttatttttggctgttaaaacatatttaagtgtttcaaagaattttgccaattatgagattatggtattctagtttgtttagggctactgttcttctgttattttttgtttatttatttttttgagtcggagtctcactctatagcccaggctggagtctcactgcaaactccgcctcccaggttcaaacgattctcctgcctcagcctcctgagtagctgggactgcaggtgcgtgccaccacacccagctaattttgtatttttagtagagatggggtttcaccatgttgtccaggctggtatggaacccctgacctcaggtgatctgcttgcctcggcctcccaaagtgctgggattacagacatgagccaccacacctggcctagagcaggtactgttctgttctcaccatagaagctattttgtttgtccactgtcacctgattttcattcacctttgcattcattgcaaagcctctgaggcctttctcttcaatatatttctctccaaaagttccgtaggaatcttagagaatcacatttacagtgggaatttttttaaaacgagaagaccattgttaagtctttagtttaatctggctgtgcatatctttatttgaagaagctcagtgggtttgaggtttcctatgcatgcctgaggcttgtccaccactgtcatacattatttaatgcttgtttttttcacttcaaagcactgtaactgttcagtgtctgatttatacgatggtggtcatctgaggatggagtattttctgttaaaggaatcactgtttttagttgccagagggcaaaatgccatagtaatcctgtgaaatgttcctctggctttttagatttgggttagctttcagtgataggaattttgtgtatgtatgtgtgtgtgtgtgtgtgaaatttttactgtgtgaaaaatcaagtgtgtatatataacgaatactatatatctttttccttgtactttatatcaagttttaacaataaaatccctgagacaatttagttaaatgaagtattaagggtagatagactccttagctagcactttgttttgtcttaatgtagaagaccttgacagatttctcattagagctacgttgtctttgtgctgtatggattatttctgtttaacagtatggtgggaaccctgtagtgtttttaaatacacacacttttccttaaaggaataaataacatcttttgggtgtagcggttgtttgatggtaactagtcagcagtaacctcatttaaaaaattaatgccacatataattggagtgatttaaagaaaagcattaataatgaaccacaatgcatactttcaaagatgacattactagcaatttttatcaagtatctcctagccatggttgtgttaatggactagttctattataaattaattggtggtctaatatgctttatctcttacatctgttttgtttgtttgtttttaaacggagtctcactctgttgcccaggctggagtgcagtggcacagtcttggttcactgcaaccactgcctcctgggttcaagcgattctcctacctcagcctcccaagtagctgggattacaggcacatgccaccacacctggctaatttttttattattactagagacgggggtctcaccatgttggccaagctggtctcgaactcgtgacctcaagtccacccaccttggcctcccaacatgttgggattacatgggtgagccaccgtgcccagccgtctcttaaaaaggattattttcatttcattgataccagtttggtatccgaaccttgcttaactcacaaatttggttctatccatgccaccagtgttatttggtggaaaaaataaatgggtctcaaaagagcattatggttagggtatataatatgatatagaaccaaggactggtaaatttttactgtaaagggctaaaacagtaaaaaaaaaaaagactttcacctttgttggtcataaaagtcagctcatcaactctgccacttgtgacatgaaagcagtcatttgtactatgtaaacaaatgaaggtaggtgtgttccagtaaaacttgccaacccttcgtatatagcagtggttcttaatcatgggtatgcacgttggtatcacttgggagcattacatgccgtaaagggtctctcttctgtggattccaatttaattggtatggaatgtggtttggatgtggaattttttttaaagttctacaggtaattttatgagttaaggctgagatcagcaaatattactatattggaaagagcctaaattgagtcaaacataatgaatttaaaatttaaaaataagctgtgccacctaccccctgtagtccatgatcaaattaagctcttgtcctcagtttcctcattaaaatattgtgttgattttatagaattattatgaaaatgaagtgacaaatatgaaataactcttggtcatggcaatcctccttaaacttggaaaagactattgaggttattcatatcagttttccggtgctgtgtactttctaccaaatgccagatagatggtcttagcctcagcttgattttttgactgcttgtaaagacttccctaagcagcttccagtgtaggatgactgattattaggtagtcattttaaatgtagccaaaatttgcttctctataacttcctaattctgtcgttgggaatagtgtaatttattatttatttatttatttatttatttatgttttttgagagacagagtctccctgtgtcaccaaggctggagtgcagttgcatgattttggctcactgaaacctccgcctcccagattcaagcgttctcctgcctcagcttcccaggtagctgggactactggcgtgcaccactgcacccagctaatttttgtattttgtatttttagtagagggtttcactatatgttggccaggctggtctcaaaaactcctgaccacaagtgatctgcccactttggcctcccaaagtgctgggaatacaggcgtgagccactgcgctctgcctggaatagtataatttaaacctaacctaattcctctaatctacctgataacccttcaaatgttagacgtttaaagagtcctgtttttgtaggctatgtgctcttctgcccatcttgtgatgaatacacacaatttactctttccaggcaagttctgaccaatatagaacatagcctgtgtttaccaacgttaaggccttcccaaggtcattcagctagtaagagtagaaagaggcaggttgcatatttaggactatgctgcatgaaaaccttgaaattaactactaaagtagtagattcctatcttttttaaaaaattagttccttttaactttaaaatatttttatgatccccttcatcattagttatgctttaatttccatttattgagaaaacagttgtccatgaaataaatgcttttaaataaatttgaagttctatagcaaacatctgaaaagtcttagtgaattgttcaatctgcaaacaatgcttggcatgtttggatttggcgggggtctcttctagttactgtgtcttccctcaggtcttcagcacagagtttgtaagatacagttctaataacgctgtcttgtataatgttgaagcttttgtttgggtgccttttaaagattgagataagaaggtgtacccatagctgcagggtttttattcagatggtatttttttatcttgaaattaacatatttgttgtttgactcactacagagtcatatttgttgtttgacttcacttcagatcatttcttttacacaagaatactttgaaggtagaactcagaaaagttagaaatttctgtcctaagagaatatgcacatactgggattatggaataattaaaactgtcagcaaaaactaaaatctgggtaatcaaataagggtaaaaatgatgtcgtgagtgaattgctctgataatgtaaaaatttcaaaatccttgtcttgctgatttgcaaccaggaaacattaaattttagccaaataaagtagataacctgagattagaaattgaattacagaagtacagataactagtgcctaaatttgttttacaacgtgtattcacacatgttgtgtcccgtttaactagaacaagtcaggtgttaatctgattttttaaaatcactttattttgcgggctcatggaacatggttttctgagcctagatttttaaatttatacctgtcatactagcaacttctacctattataaataattttactctgtatgtacgttgcatgcatacataccttattttgaaatgacaaaagaaacaaattagcaaaataaagtaaaattggcaaagaagttaagagtgctcatcatggatataaatgtggttgccctaattaagcttttaattggctctaagatacaaaacagccttactcaaaagagaaaaacataccagttctaccaggatgacaaacttcctggtactgacttctgaaaggaatttctccagtgggatttttttatgtagttgacaccaagtaatataatggacagtttccttagatgttttctagtaaatgcagcagtcgattattatatttttaatctttgccacaagctgatgtagttctatgtaaatgattttttttccttatgccatacgaatactcaaatgtaaggtaattttagttgattaaaagataaagtttagaattcttttaaataacctggaagtttctttcacctagacttatgatggaaaaatagttttgcagcatttttaggtttgcgttaatccttacaagtagagttgaaatcaggtttaagctttgcacttatttgtgtaattgcttttttggtaaaaaagcatacaatttggtactttgaaaactattttgagaaaagaatatccaaactagatagatataagaaatcgtaataaggcatatatttgaggcagagtcttgctctgtcacccaggcggagtgcagtgtcatgatcatggcttacagaaacctcaacctcctgggctcatgtgattctcccgcctcactctcccgcaatcagccacacagagtacttggaactacaggtgggcgtgcaccactatgcctggctaattttttttttttttttttttttttaagtaaaggtgaagtctcgctttgttgccaaggagactggtctcaggctcaagggatcctccagcctcacttcccaaagtgctgggattacagccttgagccactgtgtccagtctaaaatatgtttcaaaaccatgggacatggctttggtgaaggagacttgggctttagattcagttttgccacaatgctagccttgagtgtatcccagacagcctccctaatgggaaagaagtaaaatttctaccttaaaattctgaaatcttaatagttctgaggacccaaagctttttcttaatcattttggcaacaaatcagctatttatatttttttacttccttaaatgtgaatattcatgggttttttttctttttttcttttttctttttttgagatagagtttcactcttgttgcccaggctggagtgcagtggcgtgatcttggctcactgcaacctcacctccagggctcaagcaattctcctgcctcagcctcccgagtagctgggattacaggcatgtgccaccatgtctggccaattttgtatttttagtagagacgagacgggtttttttcatgttggtgaggctggtcttgaactcctgacctcaggtgatccaccccccccccaacccccgcctcagcctcccaaagcgctgggattgcaggcgtgagccagcacgccctgcaaatattcatgttttattgtataaatattagtgttttgtataaatattcatgttttcattatagggtgctactccagaccccacatggggtgttacagtcatagctataaaatctgaaaaattctgcattctaaatcttaccccaagggtctcacgtaacagatttatggatctgaattagtttttattctcttaggagattccgagtgttttgctaaacctcttaggcatcctatggagtatgctatgaaggatgagatgcaagtcagaatttaatttcatttttcattagcaacttgggggggttctaataattagggggagggtgctgaaggccagatgcttacttatgtatttatttattttattttattaagagacaagatctccctctgaggccgggtgcagtggctcgcgcctgtaatcccagcactttgggaggccgaggcaggtggatcacgagggcaagagatcgagatcatcctggccaacatggtgaaaccccatctctactaaaaatacaaaaattagctgggtgtggtggcgcgcgcctgtaatcccagctactcgggaggctgaggcaggagaatcactttaacccgggaggcagaggttgcagtgagccaagaccatgccactgcactccagctgggtgacagagcgagactcagtctcaaaagaagaaaagaaaaaaaaaacagctgggcacggtggctcacgcctgtaatcccagcactttgggaggccgaggcgggtggttcacaaggtcaggagatcgagaccatcctggctaacacagtgaaaccccgtctctactaaaaatacaaaaaaaaattagccaggcatggtggcgggcacatgtagtcccagctacttggggggctgaggcaggagaatggcttgaacccgggagcagaggttgcagtgagctgagatcgcgccactgcactccagcctggggcacagagccagactccatctcaaaaaaaaaatctccctctgtcacccaggctggagtgcagtgatcatagctcactgcagcctcaaatccctgggctcaagtgatcctcctgcctcagcctcctgagtacctgggcacacctacaggcatgggccaccactcttggctaattttttttagatttttaaaatagagacagggtctcgttatgttgcccacactggtgtccagctcttgggctcaactctcctcctgcctcagcctcccagagtgctggggttgcaggcatgagccactgtacccagccctgatgcttatttttaaaaataaataatagttaatgagttatatgatatactaatgcataagaatcttcagtatttaattttaaaagatggtagtaggcaaccatatggtaggtgaaatagtagtctgccactgtttccccttttgctgtgcttactgttgctttccttccctgtatcatacttgacccaagaagtggctacactgttgattattacctgtaagttagaaactctttaagtggtcagaataaagctgaagagctgaagaagtcttatgtgggtcagttaaggcatttttgtgacttcttcctgctgaaggtgttaagttgtctaaaccatataaatgccagtccctgaaagttttttatagaactgaatttttggtttctgatacagacttaatatatagtagggtgaccagatagtgtaaattttcattcaaagctttactcttcagaaatgttataactttctgggaactccaaaatagctttccacatataataggaaatttggaaacgtttttatttaaaatctaaagacactgagcaataggccacataatgtcaagattgaggagtcccttatgcggaacttattcacaatagggtgactgtggggtagaaacatactcagtgccatgtgataaatgttaaaattagattatttaagatgcatgacggggtgcagtggaacagtcctaactgcccagaggagttgggaaagcttcatagagaaggcagtgtgagtggatcttttgttatgtaggagtttgctaggaggggaagaagagcattcgttgacttgcaagatgggaagaaattggaataagtgggtcgaagaatagaaaaggggtagtgttgtggggacatctccaatttcctactaccttgtctataggtataactagttatttttgtattgtaataaattctgacttgttttacagactctgaagtagtgagtggtttttttaactagagatttgatctgtttatattgcatttaagactaaaaagtttaagagcatttttcatggattggaggtggggcatgtactggggggacctgttagggagaaataacagcactttggaataatgcaaggaagaaacagttgagcctagtctaagtaagatggggcagtcacttgtcaatgagtttgcgagtgaaagggaagctattttgagtttaaaaggctgctacaggaactgtaaagggtggtttatataatacatttgcaactgaatttactctccactgaaaggagaaaactgaagagaaaaaatctatacctgtttatgggggggaaaagcaccaaacacatttacttttagttctgaaactgtcaccgtaagagaaacttgtgctaatatgtgtttatatgaaaatgaaagttgagtagatctgagtctgagtttttatacaacttgtttagctgtttcttaaaacttctttcccagggtcttgtctcatatcttttcaagaatatttgtgttctgagaaaatctggattagtctgcacttgcctaatggttggaatattgagaaccacaagcaaatagtcagggaaacctttccaactcagtcttgtttaatttagcattcacaggcaggtgctgtactactcacttcgcacgtgatttggaagggttgctagcccaccgtgatctaaaattcctgtcatgaccaaggcaccaagattagtcttgtctttaatgataccttgttttgtcttgtactttgctcaatattttcatttactaatatcattggtcatgggcacatttttgggaggtagagactgagatttagaccagtcttttaatcccatctcattctttttccactgttaccagattttcaaaaatctatggtaatattttcatttttttttaggagatagggtcttggtctttcacccatggagggagtgcagtggcatgatcatagcttgctgcagccttgaacttgtgggctcaagcgatcctcctaccttggcttcctcccaaagtgctgggattacagacatgagccattgtacccgtccttccatgaatagtacctctcatgaagatattatttaaaatgcaatacatggttaattagagaagtatataaatgtgaattctaaggaggagattgctttaaagtagacaaaaagtattactgtaaagagcaatgatagctagtaccttggtatccttaagattttggagaatatattgttaaataaagggaaggtaataaagtggatgctggtttaacacagagtggaattaatgtttatttttgttcatttcacaaaaagagcatatcaagtatcagtagcaaagtacgtgtgaatatacttctgcactcgtgttcccagcattgcaaattgtagttttttgattgcctgcttatgtgccaggccctgaggcttggtgcttgtgataaactgtcaggaagcaatgtaatacagttactaaatagtgcagacctctgccactagcttgttatttaacctccctcagccttagtttactcattgataaaaagttgaaagattttactgccggatgcatacaatccatttttgttataggggttgctactatctgttcactgagaaaagacatttttttaaaataggagaaatcctacatggcttgtcatttagctctggtcatttgaatattacataccactcatgtacctgccaccagtcagaaaaatagccgtcattttgtgaaaccagtgtgtgtgtgtgtgtgtgtgtgtgtgtgtgtgtgtgtgttttagacaagtgcagtagtgagaagaggggaaaggaaactaatgtttgaattagtcttcagaaaggatttctgctgtttgcaaagaaatcttagccctttttttgctacctttaaatgaagcataagattcccataggaagatgctggatatcacaaaagcaggtgtattagagtttattttgtaatcttgtaattttagagaaaaagatgatgaccaagagttgctatcatgcttcctaatgaagcaaaattcattcgtgtcaattaagtggttggttgtttggtttctattccattcacatcaacatctctaataatgagttgctaggtggtttggctggttttgaataaggtaagcagtgacgtaatatattggttcctgaaagttaagcacactattgtcaaaagattgtcaacttggaagaactcacctgtttttgagatttgtttttgatatcaagaaccacgtagttggtgcctttcaaaagagacacaagacaaatatacttgatatttattttgtaaggttttggctgaggaggtctatacttgttgtccatgtagaattagaaatcacaaattctaatataatactttagggctagggtaggagataggaaatgcctcttaagagttgaggaaagccttcaacaattcactgtagaattttgcataaatagaaacctgtatttggaaacccacttggcagaattgtaagacatgtccttgaacagactgcatttcagaataatgacttttttaaaaaaagattgagaaatctagtgaaattgaataattgtattttttatttttatttcaattttgttgagacagggtctcactcttgcccaggctgtagtatagtggtgtgattgtagctcactggagccttggactcctgggctcaagccattctcccgcctcagcctcctcagtggctaggactagcacatgcctggccaattttattttttgattattgaaatacatttaactttaagaaaacaaaaccactaaatttcaattaaatattttcagttcatgataggttttagtttaattgtagaccaaaaaaccaaattattcttcagataccatgaattaaaactaaactttgtttagtgatataagttgcaaagggcaagactattcaagccagcatttaactctaatacatatatatcccaaagtgctgggattacaggcttgaagccccaccatgcatggcaaacgatatttttaaaagccttttatttatcatgcattatgataaatactaggaaaatacctaaatagtatcctatctagctattatcctagatacctgaacagtatccccgttcttaaggattgggcaaaggagttctgtatctatttactgttatttaatgtggtaccacattaaataacatttaccacatttaatgtggtaccacattaaatacttgttcattgttctgacttccaacccatttactctaagcaataatgctacattctactaatttcaccttacagagaaaagagaagccaacagcctggtggaatatccttaagttctggctttagctctctctatgtacactgcttgtctctgctgtctctcttaagtacccagacccgtgctcctgtatcacaagactccttaggaatcttacacaatggataattccttctcttcgcagcaatatctttagtattctccctttagtgactccttcctgtcagtattcacatatgtaattttcggccgggtgctgtggttcatgcctgtaatcccagcactttgggaggccaaggcaggaggattgcttgagcccaggcattcaaggccagcctgggcaacatagtgagaccctgtctctacaaaaaattacaaaaattatccaggtgtggtggtgtgcacctgtagtcccagctatctgagaggctgaagtaggagaatcggttgaacctgggaggcagaggttgcagtgagctgagatcgtgccactgcactccagcctgggtgacagagggagaccctgtctccaaaaaaaagtaactttcagtttcttaaaaaagaaaaaaatcagtcgttaccctatttctcacacttcccttttatagctaaatttctcaaaaagattgtcagtattttttcttaattgatcatcatctcttcagaacacagaccactcttattttttctgcttgccccacctactcaccagtatcgctcagtaagattaccagtgacatcctaggtgcttattgaatgaaagtgatgtccatttttagccctcatcttgaattctagggagcattggcaaagtggactacttttcccctaaaagtcttttatatattttttgtaactcattaaatgttaggattattcagtatacttaatcttttctcactgtctcatctgtttcactcccatggttttatttgccatctatattctgtattctgacaaaaactgttttttcttttgagttggggtctcactctgtcaccccaggctggagtgcagtggtgtgatttcagctcactgtagcctctgcctcccggactcaggcggatcctcccacctcagcctcccaagtagctgggactacaggtgtgtgccaccacacttggttaatttttgtattttttgtagaggtgtggtttttccatgttgaccaggctgatctcaaactcctggcctcaagtgatctgcccacctcagcttcctaaagtgctgggattataggcctgagcccccacttccagctaagcagtctagctttaattggtctccacttctgaaccaatgtggatgcaccagcaatgttttatacatctagtacttactagttagtactagcagtattgtttgagcgtcaagtaccataattgtaacacttggcttgttatattatccaattagattcctagatcacatctacgatataggtggatgtaaattagggagaaactaaggcatatggtcacatagcctgtaacagaaacaggagtggcacctaatttaccctggttctacagcccattcctaaccagtacactgtactcactgtacatgtcttaggcttctgtgagccttgtagtattgaacacagtagataattcattacttacagatggtactttttatttaagaaacagttccaagaaagagtggtgttttgggtggtggctatggtgtggtttgtagataaatttttctatgtttccttttcagatttagatggtgctctactctcggggccagatggtgataggaatgtgaatgcaaatttattggctgaagctggcactagtcaagatggaggtgatgctggtaggtacagtaagattttagcaacagtacatttaagattgggaagtgttacatcttacctgcagcctagtgtaatttctcttccataagggggttctattgtatataactactttcaatctatggtagctatgtttatgatgactggaaaattggtaaatgcaaattgatgtttccggttttgtatgtttgacggagtcatttgtttagttttaaaaactcctacatataaaaagtaattgagttaatatggcttatggcttcctgctggtatatagatacggaacggaaatggtaattacgataatggttgaatttattttaattagtttttatgcaaaatgatggtgtagttaatggctatagaaaatgttgattagttctgtgtgatgtcagcagtgcattggaggaagcttgatgaatataaaaacaaagaatccatgagtatgttatgaataaaatagagtaaaagaaagtcattctttacagaagaatgccaagctgatagaagaatgatagaattggaaaaatagctattttgcaatccccacaggaaataattcaaagtcatcagtggatgttaagccaccgttaatgggcttgtccccctatgattgggtgaaagattgttggggaatatcatattcacatggtctcaaattattcccatggattcccatagatgatttccacttgcaaaggggaaaaggtaaatttacaataaggagatctgagaaagattgtcataactaagtgattaaacttagtgccattaaaaagagcacaaaccaaaattaagggctggctgatttgatgtgccacctggcatacaacatttcctatgcagtattcttgagaaactgtttagcttgtatctaatgacaaaggaaaacccagacattgatgtatacgacaggtagtccaaactctaaaatgttaatgttacgacagacaagtggggaaaccactagattgaaggagaccaaggaagtaaactaaagtgcagcatggatcttgattagatcatgggaacaaaaaatggctaaagaggacattttggggccaactggaaattagaatatgtagtgtgtgttaagtgatattcagttaattttaaatttcttatacggtggttatctaggagcatgttctagaagatgcatttaggcttgaagttatgagcatgcatgtttctaaatagtgcatagaaagcatgtatgtgtgtacataaaaacttgacaaaactagtatttgttgaagatagatatggatgtttattgattgtttcaattttattagctttggaattcttttcaaagttggtgagaacagagacagtgaggtacttgttactaagagtagtcgtgggctctgaattcagtatgtactgaccaaaataaaaccacatttctaaagaaactgccttaaggtggtttcccctgactgtttaaaagaatttacaaaacaagttttgaaattagcagtttgtacgtcagatgtcttgaattttaaagatttttttgctcgtacagaaagttgctaaccgcgcaagaagatgttactgcacttgctttctcagttttgaaatctagtccaagaatgggtttaattagggatatttgaattcatatgtaaaattttaaatttgtaaacctttgatatagggttattcctcttaaaggggacatttcgattcattagtatttttgcatctgagatcagcctttgcttgatgattttgatgtcaaaaacttacattgctttttccttagttttctattgtggaataatgtacccagaaggatattattgatcagtaagcaccattttgaagagatctataatgaccttaatgatccttaagtgtattgaattacaatgacagtacctttatttaggccactcttgtaattcctacaagtattctctgttataagaattaggagagatgaaagaaatttggggcaaggtttacttaatttgaattaccattttgtattccagatagagtattcattccttgttatcatggatgttgaatcttggattttcagtttacaaatggttttagggatattcttctgtctcctttttcttttgagatggggtctcactctgtcacccaggctggcctgaatctcatgggctcaagcgatcctcccacagcctctcaaattactgggatgacaggcacgagccactgtgcctggcctatttccttattcttacatgttgtgaataatatttaattgtagatactagaacatctaatgtgtcttttggtactagttttccaagtattttgagcaagtcagaagtatgtattggcatttgctagataacatttattctacaagtaattgtagggcatgtgtcttaaacaatagaaaaaccaaggcaagtaagataggcgcaggagtttgtactgatttagacaagaaatatggatcataaagctcaaactttgtttagagatgtgaaactaacagtaggttgacctccacaggctaccacttccgttccattctttatccctcacacagaaatgcttcactttaggattcttacaacttactcccaaacactaattaggtgcagctataatgagttatagttgaatttatgtagctatgggttcagggggctttctttacatcaaaaaccggtgacggtattccaagtacagcacagtttacagtaatagtaatgatgtgcagttttaaaatattttagagacatttttactttgttgggtattaagactttcaccaaaaaggaatcttaagttatcttaatttttaagagggacagcatgtctgagaacatatatgggaagtgattcttaggaaatccatttgggtaaacattctttacttttaaaaccgtgatgcccatgggaggaaaatgtattattgctgcttgagtgaactgtatcttggcaaggagtgttttaggcagaggaaagcttaagcactttgaattgggagcatgcttattatggacgaggaacagaacagaggtcagtatagttggaatagagtgactgaaaggaaagggtggttggaagccagggctccaccgggtaaagctttggaggatattgaaagtctctagcttttactgtgagggtgggtagtctttgcagccttgtaagctgagtggtgacctgacttaaggtagtgttttaaagaatctgtgatttctctgctgagaacagactctaggaaggcaacagtggaagtagggagacaagtttttggtggctactgaagacagtccaggggctagagctcatgattgattggatcagggtggcaatagttgtggaagattctggatatatattcctattgccaaaaggttcctggtccaaggaattacattaaagatggaattaaatccagtggatataattcctgtccttgctaatctgaagatccttaggcacatgtattattctattttgattctatcttctgcacgttattttatttaaggatggagttagaaagaaatttcagggaaccctgagagcattcagttaccttgccctaatatgtctgaaacaaggatctagtaatagaactttacatttttaattatcctatatatattctttattcttagtctatttttctgtaccaattaatcttaaaattatgtgcctgtcctggattcgtaataaggagaatatcccatttgatagctgggctttagggtgataaaatcttaagtgatagagtagttagaaaaagcaactattaggagttctggtttgaatatacccatcctttaaaagggtaatttcttgtggcgtctgcacaattaaatgatattcatgtttttttctcccgcccgccacctttttttttttttttttttttttttgagacatgatcccactgtgtcgccctggctggagtgcagtggcgcaatcttgaatcactgcaactcccgggctcaaatgatcttccccagtagctgggactgcaggcacacaccaccatgcccagctaatttttaaaatttttttgtagagatggagatggagtttctccatgttgcccaggctggttgcaaactcctgggctcaagtgatccttctgcctcagcctcgcaaagtgctgggattatatgcatgagccactgtgcctggcccatgattaatttttttaactgaatttcttctactatagttgaatggtattttgtttaattgtgataataaagtaggaagacatctcaattttagactaaaatacagttttatttaactcatactatgaaattctatcataatgcctgtaggatataaatataatttctgttttctgactctgatgagagacagatctttattaccattattaattcagaatttttacttgtactaggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggcaagtattagtcaactaaacaaatacagaattaattaaataattgttaacaattaaaagctttcatgttctgcattttttaaaaaccaagtagcagtagctccacataattgctgttctcagagatagagataagaagttttgatagcaagttttctgtttaatgtgtaataagcactttctctttttttaattctcataggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtaagtaactttaaatacagctgatctttgagataaactatatttatgtcagtgaagtttaaagggatttaaacagttaattgtgaatttaaggaagattgtctcctaaattgctttaaacagtttgactttatgaactgatagtgagctttttacagagaaactggtgtattcactcactattaaatgtgtggtttaatttgagtggttcaaatgcattctattatatataatatccttatattggattttttccccctccaattaggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaattgtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggattatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatgtagagaaaacataactagctttttaggttatttcaaagttagtaatagagcaaaggaaatcagaactggccagatattcagacttgacttagaaaaacaggagtttgttgattttgtttggagaagggcacaataaaggggagcccacatagcattataatgcctagtatctttaaacatgtaaagagctatcatgaggcagaagaattaagaaactttatatgtttctaaggggtcatgattgggaccattggctcaagattgaaaatcggtttttaattatccaaagatgaaatggggctgcttcagaaaaaggtctaccactggagataacgctatgaaaagtgaaagagattacttaatcattttgacaaaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagataaacacaagacagtcttcttggcgcaggtcctaacagttggtgagataatacataagatggtttcaggattattgtagaattatttaggttgaaagagactgtaagagactaatgaagcatacccagagaggttgctacagtgactccagtcagttttaggacccaggactcctgaacttcaatttcagtattatttttctgtaccaaactcattcaataaatacttgagattagggataagtttgaagttagaagattccagagtacactcaaatagtatttggcacatagcttgttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatacgtgaaaaaactagaagaaaagccctgttggagttttgatgtagagtgcaataatacatcaataaaggtattttaaaatgacctaatgttttagttgccaacatgatttttgtatttgtaaagaggtatgttgggttttggcatttatattttaccgtatgaaagacatattcatgtaaaaggtaatgtgaagcttagcatctcttgtcaacctgtcccctgtttccaagtagtctccttggatatttgtagcatctggattcctaataatccagataattaggattatggcatttatgtacagacatgggtaattctccaaagcagatcttcccacactaatttttcaagtacttgtcacctaaatcattaataaaatgtgccaattccaaataatagcaaatgtaggaattgaatcagcatcccagagtactagtcctgggccatatcctcattaggcaaaggaaatttgaagaagttattttaggactttacctaaggtgaagtctagaattttacatatgtaggtatgtttttgttagtcttatatttgcctaaaagttatacgttttattatttcataggcgtaaatatgtttttattaaaatcttagattagactgaaggcagtgttttggagccaggaatcattctaaacttttatcctgtatttgccttttaaaggtagctgactctgacaccccagtctgtggtggtctttcattgctccgggtgacttgtaccacactcaaatgtgagctcccgtttcattctgtggactcttcctctttggtcatacatgcattccacagatatacattgagtgcccacttgtgagaaaatgggtaggccctttgatgaataaggagaccatagggtatatagtgttctcaattattactatactgcaagtcaagtcagttgggatgggaaaagatgaaaaattagacaaatgggaaattttaccaaaaagaccctttgtattagccttttttttttttttttttttttttgatggagttttgctcttgttacccaggctggagtgcaatggcgcaatcttggctcaccacaacctccacctcccgggttcaagtgattctcctacctcagcctcccaaatagctgggattacaggcatacgccaccacgtctggctaattttgtatttttagtagctacagggtttctccatgttggtcaggctggtctcaaactcccgacctcaggtgatccaaccacctcagcctcccaaagtgctgggattacaggcatgagccaccacacccagacttgtatcagcagtttttaaaagcaggagtgtttgggaggggtaacaggttacaggatgaagacaaatataaaatagtgcagattaagaatgcatacaggcagcactttacattgtcccccttcaacataataagaggggaaataatactttcaccttaaaaatgcactacagccttttgggaaaaagatgttaactattaattttggcatgtgcttgacatttttgtattaactggcatagacattaaagttggtcagttaacgtctttttctaggataggaatatatttttttaagtgctgcttgtttccatcagctatattggataagtctgtagaactagaaaagctcttttctcagaagacttggtatatactcagggaaactgacacagtagagtctacctaccattttaggggtgtagatgatggagagggtttaaagacgtagaggagttttcctatccaataaagcagttcactaaaattgcaggtacttaggttaatgttcatttcactttttatggggtggtagagaaaaaaatcaccttacaggatgaaatcgtaagcttctgtaagtattctcaaggaaagtgatagcctaagtatctgtatttaattttaatgtgtttttttaatttaaaaaagcacagcatatttacatcctccaaaattaatatatcaaatgtttaataagtttaaaattccaattttctcattggttggaatatattattctggatatatttcttattgcctattgtatatgcgggtgtattttgctttttagtcaggattatttgatgtatgtaggaatcaccaaactttctgtaaggggccagacactttggtttggtgagccataaggtctccatcacaactattcaactgctgttgtggcataaaagcatccatggacaatatggaagtgaattgtaaggctgtgttgttgtgtttatttacaaaattaggcagcaagccacagtttgctgatccctgatctataggttccccttcccccgcaccttgtccctgtaatacatacattgaagaatgatgtgccttcctaacatcaacgtattattcctttccagagttacaaatcttgagtagcaaagagacttaactttaatggcatcgttttagctgcaaaggataaaaaccttaccatctcagctttcttaaacagcaagaccttaataggagtttagttacaccatatctcagtacccaaggtgtccccccaacccccaccaccaaacaccctggttcctagatgaaagaaataatatatctgattcagaaataacattcagaacttcatgagaggagactttcacttgctaataaaaataatttgctaatttagacccttttgttgccacatttatgttaaaagagccttttattttcaatcatgcttcaaccttgagcactgtaacatagactttctgtagcctttcaaatgttgagtatctgattaacatctacattcataacaaggtgtcactaaattagacttgtcagtcatcttgggcatagcttgagaatgctaagtctgtgaatcaaaacagctgacctgaaaaatactttccatcaagccctcagtaaagttcccaagactaaagactatcaaactgaataataaacctttatgtcatgacacactgattccccattggaacccctaattgaggactttcttgtagactttgtgttgcccagtctggtggaatagtaggctctcagtaagtacatgccaaatatacaaattcagtgctgagcacaactctggagtcagaaaatttctatttaaaacacaagttgacctaacttgttccaagagttttcccataatattaaggctaatattaatcagaagttagtttggttctaagggatgtagaaaaatttctattgtttttcctgtttaatgagatcctatcccatcaggagtgtcagatataatcagggaagatatataagggaactctaaggaaaacataaccacttaagattatgagggcattccatgcactgtccaacccatagcaatctagattctgtcttcgatattttagtggaactacccttcaaaaggccactagtgactaattgtcaaatacacaccccactctgcagcatttagcattattaatgactagtttccttcagataacactcctcttatttgatcctgaaagcatcgatattcccctatttctttgctgggcactctttttttttttttttttttttttttgagatagggtctcactctgtcaccaaggctggaatgcagtgatctcagctcacttgcagccttcacctcttaggctcaagtgatcctcctggctgcgtgctctttcccattgttctttccattggtgttactccattccattgatcacagtggcttaaactctggtaatttttatccctgatctctttggagtttgcaaacatggaatgataccatgcactattgcttggtgcataaaggatattcaatcacaatcctaatttgggtcacagttctttagtttctgttggatgtcctcaaggtctttagatttacattttactgtacggagtctcaccatgggctgatgttgcatagtaaaatcactttcagaaaaattacaacctcagcttttctgaagatatttaatgcatgccagccatgttaacactgtttgatgaggtggtgtctagctgatttcatcatgtctcatcaacatgtatgtgtctctgttaactaagatcaatagaatcttagagctgaaggaatgttagaaacaaatactctgtactttatccagcctctgcttgaactcatgccataaatgtgtacctcccacttactacctcatataacaggtcatattatcttgaggtcctatcagttcttccctacatttgaggcaggtggaaatctgcctctctacaacttccactggataatcatttcatcccctgaagccactcagattaagtttgagactacacataatggtttatgtaacagtggagattggaagggagagaggagtgcttgggatcttaaaatttttctatgcctaaaaaacaatactctaggttttctttctttcttttgagagaggatcttgctttgttgcccaggctgaagtgcagtggcacaattgtatttcactgtagccttgaactcttaagctcaagtgatccttctgcctcagccttctgagtagctgggactacaggcatgctccaccactcccagctaatttttttttattttttgtagcaacaaggtcacactatgttgtccaggctggtctccaactcctgacctcatgcaatcctcctgcctcggcctccccaagtgctaggattactggtgtaagccaccacacccagcctctgttttcatttctgtaagaataatgtgagaaatccacgctgtttaccctttttcagttgaatgttttacttttcaagactaagaattgaatatttgatatcaaaaattgatgcccaaaaatacattttaaagagaggcatcaagaattattttttataaactaggatgttaatttgctggcactggtataacacttatcttggagaagcaagtttaatcttaagtttgcagtttgatatcaaaatttaaatgttgcttaatcccaggcattcaagaatttcataattaattgacttaaggcagtgtaattttaacattcataaatttatgcaattcctttagaaaatgtattacagggatgatgagaggttttttctttaattgcattttagattatagtctaaaagaaatgaggaatatttcagtatttattattaaattcttgtaaaacttcaagtccctcaagcccaagtcattcgcctctttagcagcaggatagattcaaaattatagctactttgttatttttatgctgtccttcttttgaaaaacattaagagtatatgtctagtgcatttgtgtcactaagatggaagaatttgaatattctcactagctaatttacatcctaaaagttatcaatgctcattagcaatttttgaacttaaaaatatgagttaggaaattccctaataataaacacccaaatgcattttctaaggcttattgtgtgccgtttgaaagctaccaccatagatgtcattgttctcttggcataaaatctacgaatatgagagagctgagaatcctaagaccatccttcctgtctaggtgattcattttattgccatttgcagcaattgattgatatgcgtgacaaagggaagtttttac

SEQ ID NO: 17 - DNA, 3039 bp, Homo sapiens
tttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcaaatgatttcaagtatggattgataccaggtgcttcaaatgatttcaagtatggattattgccagaatcttggccaaaacaagaaacctgggaaaatggcaagtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggt

SEQ ID NO: 18 - protein, 185 aa, Homo sapiens
YQVLQMISSMDYCQNLGQNKKPGKMASESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 19 - DNA, 113633 bp, Mus musculus
  misc_feature (1)...(113633): n = A,T,C or G
tgccatcatcaagaacagttaatgtcatttgcaaggaaatggatgggactggatgtaatcatactaaataaggcaagaagacaaacttcgtgtgctttctttcaaatactgaatctagacaagtagactatttggaaagaggaaagggagtagcagggggtggggatggggtgagtgggtgctagggagtggacaggagagggtaatgagggtgaatatgataaaagtctatgatattcttcagagaacatgccacgaggaagcccatcactttgttcaatgaatatctgctcacagatttctttttaaaaaaggataaagtaacataggagaacacataacatagtgttaagtttcaaaccggacaaaggctgagggaccaatgtaatatttcaaagcgaacctggcctggagattctcccagcatccttcagtcctacctactacatgtctgccttctaccctgaactctctagcacaggggctgggctgcccttcccccagaggctcttccctttatgatggagacatggtgagtgcctgcccttctgtacctttggccccttggctactgcactccattcccctctttccctctcccttcccctccccatgtcatcccatgactcagtccactctggactctcccagatgttcctgcctttggctatactcatacttaagagtagtggtgttgctgggcggtggtggcgcacgcctttaatcccagcacttgggaggcagaggcaggcagatttctgagttcgaggccagcctggtctacagagtgagttccaggacagccagggctacacagagaaaccctgtctcagataaaacaaaacaaaacaaaaaaaccaaaagagtactggtctccgtctctctctctctctctctctctctctctctctctctctctctctctctctccctccctccctccctccctctctcgttttaggttatatgtaaacacagcaaagccatgatcattcttaagtagagcaccaggtgcctgggggctctagaaccaatctctgcctgaaaacagagggatagcattaaagtttagatgtttgatttaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcccacaggggtcacccaagaccatcagaaaacagatgtttacatcacaattcataacactagcaaagttacagttttgaagtagcaacacaaagtggttttatggctggaggcagaaggaactgtatttaagggttgcagcattaggaaggttgagaactactggatacggctcataaaagaatataaagtccccggaattgtaatctgggtgaaggcaggttggtgtggctgtttttttagacaaggccgaagatgtcatcagaacaggaggctggatgaaactggagaggaaggcctgaagtatctacccagctgcaagcttctccccagaggttgcaggagcaggtcagacgtgtagctggtgacgtgcacgcgtgctctgcacagctggagaacccgtggttccggacaacagtatttagaggcatccacgaactagttaacataacacttgggaagcctagcactggggagcatgaaacaaagggctttattgtgaagcgtggagggacaagcgtggaacccagcagagtggaagcccggaagactagcggggtgcccactacaggtgtgcaaggcagagtttgccctaggagtagaagttgtatagaggacagattttttttttttttttttttttttttttgctccccatcctgcaaagtcaagcagtctaaaggctaaagaacaaagacccacgctatctgtttaagtcaagccttaaaacacatttgggagtctggagagttatctgaactggcagtaagaattttactgcctagcttgataggggagtaattaatctctctgctttgctttctgccaattcaacctaagggaagtgggcttgggatctggaattggcagagtgggacttcaggacctcttaagtcaaattcagataaggccatttagatttattctgccaaataaatgcttactcgagccaatttacagtgctgtagtctaaactatttgtattggcagcttcagccttctgaattctctgccctaattgatcattctaagttttaagtgtagctgtgcaagacacagttaagagctagaaacagtattttgcacaaacacacactcactgccccccccccccacacacacacatactagtaacgacaatttcatctggtgagtctgcttttatggacagaagcactttaaaacaaaagcttcctccaggtcaaacgtaggtaggcaaactccctcccttgagaagtaaatgaaaatttgggacacttacccagtttctaatgaaaacaagcacacattaagcacaaggatgaaaaactggaggctcgatcattgactgactttgaggagacccacgctgaaaaactgttccttgccgtgtaaggcagtgcccgtggagatgggttttccaggcattggatgtagaacctgtctgtcagtcaggcaccttctcagaacactaaactgtctagatcacacacatcaaaggcaggccgcagtccccgtgggtgaaactcccatcacctcgtgtgctaggagtaactgggtggacggagagactaataatgacctggttctgcattcatctccctggggttcggttggttctgctgctgccctgaggcaagaaggctgtggctttggcttcagaccagggatttgaagcttgcccactgtcggcagagccctggacgctgcagaatacaaagtaaggctgaccatcttacacattaccaacattcaagaggcccctcgggtaccgtgtccactaaggagacagatgtacaattcgatggaattcctcttcggcatctcacctccctcagtgtttctttccttaaagagagaccatgggtttgttgttgcccctttctatattctcagggtttccttaatgactggctgttcaaacaagacaaagcaagagccattggtgctttgcactcctctggccaagattaaattttaaaaagtttgtgtctgtagaaatatgaaaggaaagattgctgttggccagctacctggactggtacccacttttaatctatgactcttggggaaaggtacaaacagaagatgccccttaagtgcctgtcaacccacatggctgtgtgtgccttcaagggaggctcctcaaagccggaggctggagcaggcggcagcagaaagctgagcacctcaggattctgtttcctttggcctggaggtccccagccagggcaaaagaaaccgaaagaacactggtcattcccattctgactacacattcctcagtctgtacacaggctaccttgcaggtttatactgagaaactgaggccagaagatggctccgttgatagttagcatcacacgtgagcttactggcctaactacgctggtcctctttccatttcacaagtggtcttcgccaccatcttcaccacacttagaacctgggatgcctgggcttgagacaacatagttagtctaaatcacagattctggtgagatttacagttcctcaaagcaactcttggacatcttttaggcttcctctgccattgtgcctgagttctttttttcttttttcttttttttttgttttttaaatattactctaatttaatgtaactttcttttttttaagatttatttattattatatgtaagtacactgtagctgtctttagacacaccggaggagggcatcagatcttattgtgagtggttgtgagccaccatgtggttgctgggatttgaactcaggaccttcggaagagcagtcagtgctcttacctgctgagccatctctccagccctttttttggtttttcaagacagggtttctctgtaaaggcctggctgtcctggaactcacattgtagaccaggctggtctcgaactcagaaatccgcctgcctttgcctcctgagtgctgggattaaaggcgtgcaccaccacgcctggccttgtgcctgagttcttactgctatacttgtgagtacattctccacgtgtgcgttgtccctacacctaccaactctggggtaattaattgtggttttgcaattaacagactctcccccttaaatatgtaccttgcctcctaatatcttgcgttttgcataacttcacgtgtattatctcacagacaggtagactactgcacacccattagcaaagaaaatgaatcttatggaggttaaatggccactcactgcaagggaggcaggggctgagcctgtcttggaccagggatgtctgtttctgcatcacactattggacattcctgcatccctatctctgcagggaacatcattcaagaagtgcttcggagaagacttaaagacttttcaccacagacacaaacatttctgtggagtcttgtgaatgaaacatgggggtggggggacgggggacagacttagcaacaagataatttcaaatcatcaagactaacagggaaagcgtttaaaaatggtattaacatcagttttcctgaacctgatttctgtgaaagaaatatgcagtgtactgtaacagtgtacagggattaataagaacgtgtgttaaaaggcaggatgcccaaacagcatgcacgcacacgtgttgtgtcagagcgctctctctctcatacacaaaacgtggccgcagaagaaagtgtgaagcaggctggaagaagacaatatttatggctaaagaaattcagcctcacataacggtaattatgaacaagatattttccctaataaaattactgcaaaacaaaatctggagaatctaagtgcttccctatgttgtcattattctatcccatgtgcttgagagtgatttcgagaaggaaaaaaaaagagggagctgagagaaagggcgccatagtgagatggcctctgcagagggtttggttttgctttagaaactggaatgcgtccaggcttgatttttattttcaattcacatttcagatccagctccccaaactctttgatctttctccctgtctccttacccggaagagaacccttggccttctcagctgggagctgggagcacacgtggaaagactggctgggatccatattcttgccaaatttagtcacacaaaggggcctgagagggaaaaaagaaaggatgaaagccgcagccgccgcgacttcaaaggccgcgccgccgcgccgggccctgcgcaggcgccgccctccgccgataaaaggcgagaccggcgtgcgcgggcggttcttccgtgtgcgtcccggctccagggcggacggagggggctggagagtcggcggagagggtccaagggggcgtgattttcacaaatctgtgcccacgccacattgaggcacaggaggaaagttttgagaaagggaggaaaagaatgtgatgttcgggccccctaaactagcggatcctctgctggcacgtgtataccagagccgaagtccaagtgtggcatccctctgtcctgatgctacgcaggatcttcggtgcgggatctcggcttcccggtgcagagccaaacccctgcacccccttttagttcattctgttcccctgaaatcattccctggtccccaccactgcctgtcctcagccaccctcaggtccgcgctgctgtggcgttaggggcaggcactcatgcctggggttgacgtcccacagggcagagtggacagtgttccctccaccctgagaggagggccgtccactctgctgaccgcgccgccgatcccgtgcgcaaattaccgcgccgagctgcagacgccaaggggcgccgggcgcgcggaaaccgggcgtctgcaggcgccggattggagaacgagggtttcacggtcccacgagtttcctgactctggaggaaggggctttggggttttgtttttcttaaggaggaagagcccctgggacacaaactgccacttccctcgtcccccttctccgagacgtcggttaaactgaagatgcccacagactgagcgtcctgctgaagctgggatggaaaaccgaggtctcggttccgcccctggaatcacatgaattcgtttttctagtcctttctcgcctgtctctcggagcatcctcttccgtaggccccgccacctccttcctttggtatcccacctaggttgcagctggcagagcgtctaggccacacaaagggaagacctggggcctgagctgatgttaggacctaggggacagagagggccgtgcaggagaactgagcttctcatccctgtaattaaggactctccggactgtctgcagagcactccacgtggctgcaaaatctctaagggagggagggtcttcttgtgtgggtgtgggtcactccccctgttccctgcccccacacccgctcagcgcactgggctctgcggggcagaacggctaactctgctccccgcagcctgggttccggctggggttgggcgccttgcccccaagactctatcaacctacccccactccccagaggcatagcactggcgacagcgccttgagcaaaaggaagtgttgatataaaacaagttcgctcccaaactaaacccaaagccaccaggaggagaaaaaccaacagcagcgcagccagcccttagcaattgtttcacggtcggaattaaatcacatcaaaacgcccccctgaaacccacatcctgaaggagcaaacctactacagccaacctccagtggttcgctagagttcatatgaacaacctgcctctacatccgaggaaagggggcggcgaggctgctcctgcgccgcacccaccacatcccagacctaggatcccactcgcccaatctcaagaagcgaagaagctgccgcttatgctaataacagccccacaggaattaggagagactgcccggcggctggaatgcttttgccaggaaggcgaagtccagagacaccacttcctggggttacttcgcccctcctgtgactccttgtattctaagagagactacttcacagggaaatgtcaacctcctttacggacagatctttaaaacacgtgggcgcatggttttaagggtagccctgtttaaggtttgcaacattgctaaagacagcacactgcggagaccactcacgcagagcgaggccatttggagatttcgttagaaccaatgcttccaaagagggttacagcaaggtaccaaatgcagccacttattccagcccttgtaataaagcattttcactagtcattgctccaaaaattcccatctcgagctcctaatctctgggacacctagagctgagcttcgtatgactcacatagtacagataattaacgcgaaggagaaaatgagaattcgaattagttgcaacacttaaacagggaagatgtagactcgtcatttaatctcctcttggctttcaaaaaataccctctggctattcttcttgccccctccccccttctgggtttgatgaaaaggaccggtctactccgacttctttgatgaagctgcatcttccaagggttcttgtgctcagtcaaattggctcactcagaggaggaattctgactttgttaaatttatgttagcaggagctgtaaacgtctgaaactatgtccctttgctcttcaccctatcacactggaggctgcatagattcactctaaaaatggatttattcccaaccttccttttattctccctggtaccctgaaggaaaaatgccatttttggcttttgtaaggtatagtcttgacaattatttaatttttaaagaaaagtttttgttattctgacttctttcaccagccccttgttgtacctaaatctatcagattacatatgaccaaccacgtcctatgcagcaaaccaaactatacatatatttcaaacatatatatatatatatatatatatatatatatatatatatatatccacctcctagccagctcccaaactggtagttatcagtaagcaaagttttaaatgctgacttaaagaactgttaaagtctacaatgcccaatagcccacactttcacctttaaaagagagctcttgtcctaagcgttcttatgtaatgaaaccaacacacgattcgttggagtcttattttccatttaagtaagatggagatacaattcttcctgtttactgctcccaggttctacagatggctgcctcactggtctaatgattttgcctgaatatttgacttgaggggaggggttgagagctaaaagacaatgtgtttccaaacttaagccccacttacacagtgactttcacaaagcgtcgcccttaaaagtcctgtccaaaatgcaccaaggagacagtgggaaccggagaatttttgaggtttgattcgtatttacatccatcctttaaaggtccctttcagcggagtctccaggatgtcagcaactgcccagtgctgcctgcctctcctaggttgttcttctccctccttttgggatgtattttcctttttctacgaggtctctacacgctgagtcgagaatctccaaaaacccacgttcattcggtgataaaggcacaatgaatgtgatagcgtagaagcgatatttaaggctcagtcttcatccacacccttcttactgatccttcccccctggtaagcctggagattttattttcgctagggtggtgtgcccttgtctccgaagtgtgtgtgattcacggttagtagagtcacaactcttctgtttgcctttgctgaatctcttctctctggttaggtgagcaatgtgttacattttctccttttccttcccctagtccctaattctcgccttattccctctgtcagagcatctatcaatgtggtgtcgaccacagcgccagcggctttctctttcatcttcctccccttgcctgagtgagggggctagagtgggcggcgggaaggaggttgaagaaagactggcaaaggactagaagtgaggcgccgggggcggggtgggggggggtcggcaagagaagaagagatgctcagatgatgaagttaagccattcccgtagtttctcgtcaattttcacgtgggccacactgttctttggggttgggttacacacagcacccagtctatcttcaggttgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcaactcgctcacctgcggggcagcgcgcaccggagggaccgggctgcgctttcgtgggccctggcattcggacattcccggagccttgcaagcggctacgctccgggtgttccccggccggtctgcccggaggagccgaggggccaccggcagctctttgctttgaccgaggggaggcggggagagaggcgagccaggcagaaactcgagccgggaacaaagagggatcgggctcgagtgtgtgtgtgtgtgtgtgtgtgtgtgtgtgtgtgtgtgtgtaagtgtgtgtatcggcccgagctgcgggctggaacatttgggcccgaagctcctgctgtgactccccaagactccgccgtgccagccaccgccgattcccagcgctcatcatcacaaactttattcttggcaaacttctctttttctcccctcctcctccgcccctccccctccagcagattaaatgctcctccagaaggaaaaccgaagcgaaagggaaggaaagaagctctaacgcggacgtctgcagcccggtggctctttattgtttactctgaaggaagtggacttttcggtattttctgattcttctcgtacctccgctggggcaaagggagcctcttggcccagctctcctcttctcaaaaacaaaacaaaacaaaaccccaaatcaccgaaatcagcatccgaggaatccgtggagaggttttgcacggtgacgcaccacgggaccctcgtttgcactttggcaagtcgtgtcccctccggaaccggtgtcctcgaagcacagaccccagcaacgagtgcggcgtggggtggccacccagccctggcagcctagcctagtgcacgcggagcggcgtagacgctctcagaggcgccggcggctgccgccctcgcagtctggtgcccttcgccccagggccgggcgccggcgtccttctaagtgggaaagcgcggcaatcgcagaggctcctgcagctgctccagccgtgggcccctcgcttgcccacccggcttccattcacagtcctcccgcactcagtcttccaactcccccacctcacatcgaccctcccttcttgctgtctcggagtgctcccgcagcggagcggagattacacagccgccgggatgccccaactttccggaggaggcggcgggggggacccggaactctgcgccaccgatgagatgatccccttcaaggacgaaggcgatccccagaaggagaagatcttcgccgagatcagtcatcccgaagaggagggcgacttagccgacatcaagtcatctttggttaacgagtccgaaatcatcccagccagcaacgggcatgaggtgagtgggcagctgtccggagaggcgtggcgggtcccggggaagcggaggggaagcaagcagggtgcgcgaccacggtggccattgagccctggtccctcgcgggctgggtggggaataacggcccctagtccatggtgcgcacgtgtgtgagcagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcgtttatttggggttaggctgggttgggatcaggccctggatctctgcagaagaaaggcgagccctcggcggaagccgggcggcggctagggaggagggacgcgctttatcagatctccgggccagctgaaggcgacggcgctggtaacccgagtagagtaaatagagacacgtgggtgccggcgcgagggagcggggagcccggccgcgcgcgagcatcggatgggcgtagatccccacagcccacaccttagcggccactctgtctcagcagctgaggaaacctcacgggggcatccagtagaaaagttctgatacccaaatgatgtgcccaacgttttttccttccagagaaacttggagagtatagccttttccttaaatggcaactttctgcccccacccccaacccaaagaaagggtggtttcgggggcggggacattttgggtttaaagagtgcttttaagaacacctcagagttaccttctctgtcccgatggcaggggtgagtacgcatctgggaaggctggggggctgattccaaaatataaggaccctctctagtcccaaagtcctacccccccccaaaaaaaaatagaggaagggggcgagaatgcattaaaagtcaggtaaaaagggtctccggacgagggattgaaataccatctaaactctggtggttttttatttttgtttgtttcattcttgaccagactgtagagtagcctctttctttctactggagtagtttacacatttcaatccacctcacatttctacggttttgtagtctgaggagaaaagccatgcttaggagactgtcaactaccggggttgggtgtttgaactgttcatctttccgcggtggaagtggggcgagcagagagccccggaagatgtaaggcttagcccactgatttgcacgtggttgagtcgggtcgggagtgcttaccaaaaccgatattaactgggctaccttttagatgtctataacccgactctcaattttccctcccattaaccacagaccagttctactctgatagcctgatagcactcggcctgaaagttgtaagtgaacgcagtttcagctaggactcctctcaggcaatgtccctaggacctcagcaaagtagttcttttgtttacgtttccagatctcattttccattacaaaatgttgtttctggtgaccttttaatcaggtcttgttagagtaaaccaaggctgaagaggcttacccatcctagaagctgggcaccctgcaagcattgatgggttgttagaacagagcacatcatttctaaattcacttatttttttgccaccttacttttgatccagagtacctaataatcattcaaaaatacacatggaaaaaaaattttccagtactcaaatctagtttgtccttaattttaaccaaatgagtaaatcgagttttacctgaatctttacctttgaattaacagcagacccatctgttacaaactcttaaggtgatcttctttcttttgtgggtggctattcatgccattaggtggtcagacaagccccgtcctctcaggagccctaccacgacaaggccagagaacaccctgatgaaggtaagccagattctctctctcccccacgtttaccacagggcacaggctgatgggaatatctgcttttcttttgatacttctgtttgagtagggtggaaccagatatgcaagacttccccacatactgtttttaacagaatgaccagaaattcaaagctttttcacggtgtacaccacattcttttgaaacatgccttgcatgagtctgggcctttgggtttctattggctttcagatgcttagagaagggatgtttctaaagagtatttttcatttacaagttgctgcctgtgggttctcagtgcagtgaaggaaggcagtgtgtaggcagatatatcagagtcagtaacttagcttgtaaaataagaaaactgttagaagctacatatattagatggtaggcacttctctcattgttgactcttgtcaacactttaaaaaaatcacatgctcacacagaaacatacaaatatatacacacatgttcaaacacccaaacatacatgcaaacatatactcccaaatacacatttattcattctctctctctctctctctgcttattccatgtttaatcggatcaccatagggtttacttaatcagttggcatttctggtctcctgcaattccttaacaactggcctgtctagaatggagcgtgcgtgcattcagtgtgtaaagcaggtggcaggggaaagcgctatatcatatatcagccttcctttctggcaacaagcagatgcagtaacttgtatacaataagttaaagtaaataaataaagtccatacagtcagtccaggaaagcatcttaaaatacatgtggtattttaaaataaatgcagtaatgcaaagtacgtaagttccttgcatgcagtaaattaaaagtaagaaacatttcattgatagactgtaaatttaggggtgaaattattatttccaaaggttaattcactacaaatttgggttttaactgtacactaggtccagttttctccctcaataaaagtctatttggtagaaattcagaggcataggaggaatttttgaatttgcctaaaagaagaacccttcaatgtatagtaaatgtgtatgtgtgccaggggtagatggccttgtatagtaacatttcagtatttaagtttctgtgtgtgttcccttgtgtttctgtatttctcagtccagtttgttagcattagaacaaattaggttagatgaataacacttatttttgtaaaaacatcagtcagtagtggaaataaattgaaccacatgttttttaaagcatctggtttgctgttaaagccattgaggagcgtcaatactgtcattctaaaatagagcctagtagtccagttacagtatcttctaagcagatattttgcgtaaagtctgggctgtcttagcagcagaagattttctgatgagagacggtgtgatgtaaaagcagtgctgatgcagcatctctgattgtcctttggattctcccaggaaagcatccagacggaggcctgtacaacaagggaccctcctactccagttactctggctacataatgatgcccaatatgaacagcgacccgtacatgtcaaatgggtccctttctccacccatcccgaggacagtgagtaacatgctgatgttgaaaattattctcagacgtgcaaattaatttgtgtttcaacagaatgcttatttcctcaaacgcactgcccaaggcatccttgcatgagacttagtcatcccatcgttccataagagctgtgcgtggagtggcagcctgagaacagtgctggttttatgtctcccgtttggatttttagatttaggctgagatgaatgaagtagagattcatgagttacgaaatcaaatggagccaagtcggaggagccatgataaaatatatataaaatatatatatatatattctgtgtttctgtgctgatgagtggagggaagtggattccgtctttccgtgaactaaggaccaggtagctttcaaagccctaaactgtttagagtcagagctgctgaggctcatttggatctagacattcagaatgttattttggcctttgaaaatgtcttgcttcattaccttagctattgttttaaaaggggaggcacaggggagccattttcactttgttgtcaactggggaaatatctgaagttgttgctttttcgttcgttatttacttaaagttgtaagaaaaaaaatgcagtgtcgcacaactgcactatgctggcgtgtacaacatcacggacgtcacgtgtggtatttggtgccatgtctctttaactggggtaagatggcacctgtgtcttgagaacgagtggatgataacttgtagagggtgtacacgtgatcacactggcgaacacacccagtgtacccctccccgccccctcttttggagaagctgctggggcggtcataattagttgcctgttcccagtcccacgcctccaccaccccagcccagtgagaacacagaggagtgagtctccctgagtgacttctcgggggtgaattggggtgaatctcgttgctgaaaagtccctcagaagccctttggggcaagggtgtcagggatgccttatggcagacagagtttgagagctgggagggtcaccaaagaggcagcccaggagatggttggccatcaagtggagggagagcttgtggggttatctcagtggagtgagcaagccctcgatggttacaatgatccgccatgttgagttggtgggccttgtgattgcagactcactgtgagaggttttcagcaaattccaggtggatatttaaactcgggcagggaccatggcttttctcactgtcataaagcagttggtctggggctcatggggatcaaatcttggagatttttgtgacgttggttacaaggaataacccccccccccattattttaaaacatttcaagtatttaatgatatttaatgcctgtgtggtgtgagggatcttctacctgaactgtggatgaactgataaagcaatcatagtctattgtttagagtttaacccccacctccccaaacactgaaagcactcctgggttctaaaacttgtagagaacttgttgagccatatagagaaatatatctgatttttttttaatagctgtgcagatttttttgtttgtttgtttgtttgtttgtttgtttttatgggctgcattctgggtaaggaacagttgaaggtttctacggaaaggctaaaaggtcaacaaatagtcttttccaatcaagttagagttctggtaacagaagatcgcttcgcttcccaaaccgtttacgttttatcccatgagcacagtgtgtactgaatggggtttacgccacagggagaccggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaatgtcagtagaatgcaaaggtatttattatttattgttatgcatgtgttgaactgttgacatctgtgtcatcagtcatcgcttagggacaatttgtgggctgagcaaatgtcacgaggtgtagactctgtccagagaacctgtcctctctcttctgttgtctgtgctgaatccccgtacatgtgaaaatgcattcgtgtcaggtatgttttattgagagaccctccagtttgcacaattccagaagcctttcatttttaaccacaaggctatgtcaattttttttaaagagtccaactgaagtgagttacaatctttggtttttaatatttaacagctgtttgtaatgtttctgagatcaaaaacactttaaccggaaggaaggcagcctctcttcttcggtctaaccacacttctctcttcctccttctttctgtcccctggcaggactgtttgtgtcactgacatcagtgaaggtagactttcttagagggtgtcaggagctggtggaccatttgtgtttgagtctcccaagtaggagcagcctggtgacttgaatttgcattacaaacaatttccggtttattgcatctgctgcttgtgagaactggggagaaacatctgtgggagggtgaggcaccaacagggcccttctcctttctgtgactaactgctgtcctgagattccagctgtggccaagtggcacacacagggagtcctcttctgaagtctccccagaaccatctgcccttgctcctgttttcagccaggtcagacatcatggtacctactcaggagaactgcctttgcccatccaccattttcccttctgcgaggacattttagttgggacctccttttagaactggaacctttaagggagtgtatcaataccaggtatctcatgaacgagtctctcctggaatcttaactaaatatgagttttcagttcaaataaacaagaaggcagctatggtgacctacttggcgtcagtgtaagttcttcaagcacagaggttgaggagatgcgcaagcctgctaatatttcagaaccaggaccccaggaaagtttattaaaagcatacttccaaacctttcttcctctgaagcttatgtttgaaaataaagccattgctgagttataaagacaacaacaacaaacaccaaagcccagtgccttgtgtcccagtcttagtggtggagcccagtgttctggcacggtgggaaagagctctgagcacagctgctttaacataggaaaggtccccgtggggtaagattatcctgtagttaatcaccctgggtgtcaaacttccatttgtccctcctgcagcccaaatggttaacaccttacaagagaagccttccatgtctctcctgaggcctgggagagtcaggaagctgcctggtgggcccgggccacagtagctctgaatcaggagaaccttgaattttccagttttctatgatcttcctcagagagaccttgcgggtaggagagggaaagacgtctatggcctcgttttagctgccttgtaaattgttatttttaaagtgggaatagctgtcggaatgtaataggcttttatttattcagtctcttagttatttagaatagctccattgtgctgactggtatgtttcttttagggaataaacatttgagtttccagtgaacagatcgaagtctagtagatctcccacctctgacttttgtattaagtttacaaacaactacgacttgatttttgtcaccgttcacttctgggacaaagggactgaggtagatttgcctctccaagaagcttctgaacacccatatgccagtgttgtatggctttgaaaacaaatgttaaaaataaataagtaaataaaaagatagtagcccaggggtaggtattgtatgcctgtggctcacgcctcaggtgaggagtctgaggagggaggctcttcgtgctgcaaggagcaacctgatttgacttcctgatgaattcatttgaattttctcattccagctaagtatgcgggctttcccccctttaccctcaagcataggatatatttttcaagtgtatttcgtgtaatgtttgcatgtggctatcaggagaacgggttgggtagttcctcttcagagtccctggacattctgtctggtccttcctcacgacacgaccgcaaagcaggggaagacttatgattgacaggaatttggagcagtcaccgtccctcccctcagatagctccaatctctaacgattctgcttactgtagtgtgccagggagcctcaatcccaggacttgatgccgtatgtactgattcactgtccctcacttggtcgttgtcttttgaattgcccctggcaggtttttttgtttgcttgttttagaaggacatgagggtaacccctaatgtagtgatctcactaactcaagaccaccacacactgggagcaaatcttttgctgtcgtttgactggttttgattttgttgagacagggtgttactatatatggcctcgaactcacagatatgcaactacctcttcttccccagtgctgggattaaaggcgtgacgggcagcgtttcttcagcccccacgtggcttggctctcttctctccagcctccttgttctagctcagtcttcagcacaccccttagaatgtttagcagagctggactctcccatgcatggagagattttggtttttcgagacagagtttctctgtatagccctggctgtcctggaactcactctgtagaccaggctggcctcgaactcagaaatctgcctgcctctgcctcctgagtgctgggattaaaggcgtgtgccaccacgcccggcgcatgtagagattttaaaagtaattctgctaattctgtaggcagacccattttggatttatttacttaaaaattgtaggcagtcagccccactcccgccccccttttcctccttcctgactcctttgttctccatttacatattttgggtaagatcaggattttacagatcgggccccctttgattttggagaattacttgagagattaaaaataaaacatttgcgtgctgcctgtggcgagcaggaaaagcacacgtgtgttatttccaggtacatagcacacgagatgctgtcatgagactgaaggttggtttttcaatggaggcatccatttaaaagtggatctcattaaagccagtatctaagcaacttcgacaagctggtccaggctgtgggaagtcacaacttgtagtcatagctgcttagaaggctgaagcgggaagatttgagtttaggagtccaaggccagcctgagtcagcagagcaaggtaggtgtgtgtgtgtgtgtgtgtgtgtgtgtgtgtgtgtgtgtgtgtgtgtgtgtacatacattaaatcatggtttctttttaaatactacaacttcagttttttaaatttaattttattcatgtgtaagtgcataccaatgaattccggcatgtgtacatcacaacgggtgtgtgtgtaggggtcagaggacagctttgggaagtttcttgttctctccttccactgtggaccccagggtttgaactcaagtcattagatggccacagcaagtgcctctacttgctaagccatctcacgctggtcctattgtgattatttttttttaagaaatgaaatcacaatataggaatcatagttttccttataaccctgcaaatcattttaaagatgtaaataatccaatatgtaaaatttgggagcccaaagctaaaaaaaaaaagtgagttaatgcccaacagcaaacgcttgaagaaatgaataggggtggagaaccagggctctgaatcagaggctgtgcagcaagtggggaccactaactcagcctctggcaagtcagccgtgtgtgtttctaaccatcagccaatgataggggaagagcgtgcagtccaaagacgacattgaagtgcagtgtccattctggctaagcccactggaatcctgaacttgctgtgtgtatcatcccaaagccccacaggcaatgatagtctccgtgggaagctctctggggcaccaggaagcaggaggaatctgcgctgcctctcccacttcctgtcagaggtagggaagatgcaccacagaaagtctaaaggtagacattttcaattttggggggactgtctacaggcaatgagtctctcgaagttctggtcattgactgggacttctacccaccagtgatcctctacggcacctggtgacagttttgcagaaatcacattttgatctccatcattaagtaattactgagatgatataaagtttggttcagtagagatgattagccaggcctggaggcaaaggcctgtggtccaagttactcaaggggttgaggcaggaaacttgcaagtttctcaggacagcctggaaaaaaaaatctgtaagatcctgtctcaaaaaaaaagaagggaaaggagggctgggagtggcccatgctagatgcttgtccagtatgcacgagaccctgggctcagtacccaggatggcaatatgagcgaatggaggaggttgttgctacgcaaccctgagaaagctagaatggagaagctgatgtggggaggctctgtgatgtgaagagagggatgcctctagggatgccctacttgggaaaaaaatggctgtcagcctctgaaccaaacaaaagacgttaaatctgatctgatttttagtttttaaacttaaaaaaaaaatttttttattacatgtaggtgtgtgtgtctgcatgcaggtgtgcacacatgagacgagaggcatcaggtcccctgcaactgtagtcacagatgcttttgagccacctgatctataggtgctagggacagaacttgggtcctctggaacagccatctctccatcctctaatctgctaagctttgtcataaacactgtcagccatgatggtagttgatcatgagttggtcatgagttcatctgggactgagatagtgacatcagccttgaccagaagagatgctcccagtcagcttgcctaatcaataaattgccaacagggcctgtatacatccttctctctacttttatacttctcgtacgctcgttttctatcaaaccaagtttcttatgaaatgtagtctctgaaagtatctgccaagtaaccctgccttgtatgtcgtattttctttattctcttatttgttgttaggcgccattagaccggccgctgtgctcaatgaaagtccgtatctcgtagaaggttctgtttcaagtaatgcctgaaaccagctcatgggaagaatagaaaggatgggaccggagcctcaggaggaagattcttgtctctggatccttgaaacctagggcaaatgcagaggatagaaacgtgctgggggttttttttttctccctcaaagaatacttgagatgaaaatacagctgtataaaaacaaaaaccatccaagacacccagaaccgaagtgccttctcgaatcatgtcactcatgctttgccgattactctaaacccagctagacagcttctcactaacagtcagggcatctttagatattagaaatgttgtaatctttgtgatacgtctctttgtggtgttttttttccggctccctttctttctctcctggatgtagggagagcccccttctctccttaacacccctctcccctctaaggaaatgagatgttgcaagggaataggcgtccagattcttgctgacgtctcttatcctttcaacatttgatagggagttatcaaataacctgtacttccttgcacagcatagggagagcgtatattttgagttagaaggggtttcccccttaaccctttagattctggatttctttcccctgtcgcaggggaaattacgtggagaggaacttgagaccatgagaatgtgaggacaagggccaggctacatttttctcattacgttttcttctggcttgcatctttctagctctcttggtaccaaaaacaagatcaagctgaagggacaggttagctgggtatagagggaaaaaaaaaaaaaaaaaaaaaaacaacccagtgtgtgggaagttccagtttctctgatgtcacttgcaataaggcactttctaacgttgccctgggagactagctccggtgacttggatcatagaaaagacattgtaggagatgacggtttggcttgacgttagacacagcaagggcaatgacttgacttccaaccagtactacagagagatttacaaaaaagaaaggaaaggaaaaggcgctgtaactttattttatcttagatgtattagactttaaatttaaatgattaaaatctgagaaaagaaaaggagaagaaaaaaaaaaagcaaaccaaaagtaccaaaattgaaaaagagaaaaaaaaagatttcccacttaccaccattcggcgaaccattcagcatgcctgtaggatcaagagaataaatcctcaaacattgctcactgtgtttgtgtgctcatttttatgaatatattaaaatccttagcctaatagttatattttttttgctttaggctaacatatcactgttttatacttaatagtgacagtggaaagcagctagattttaaaaacctactacctcataccttagtttactggttccatgagaggtgtgggttaagattgctatgttaaagtcaagcctcacctaaggagggaaggagcccacactagctcagtagatctccagggccctttcttaggtatagagaatagatttcacaggcaggatctttcttaggtgaaggcttgtgtattgtcattaaaaatagtcacatttgcatcaaaggattaaaaaattgtatcaggccaagctacttggtttggttcaaaatttcttttcaaaataactgttggttttttttgtttttttgtttttgttttttttttgttgttgttgttgttgttttgctttggtttttaaatgaatataaaagaaacattttaactaaaaggccttcctgtgcagccctcgagattctctttcttccctcataaattaaggcagtgagtcttgggccccttcaatcaatgtcagacaccccgggtctacaaactcatgttctcaccattcagtcctgatgaagcccaggcagtgggtacctgcagtcagattgcatggggttctcccaaggtgccttgccctgatgacctcagagcaaaccccacactgctcagcatcatttggaagtcttcttgcagtctggaacctctgccctgtagacctcaccccctggcttctcggtcctacagctgcttttccaggcgcgtatcctaaaccttactccagatccttgactctgggttctggtgacccagtgtccctgaaatacccagctcatcttcttgtccatacttaaaggtccagggtagaaggtgccacctccatgaagcatctgattgtgtccctttcaactaggagggccttgctctcctgtgcaatgctattggatcttcattgtttcttcatacattttaagatggttttttcaaaatcttgtgcatgttttgagtgtctgtgaggttatgtgcacgtgtgtgggtatgtatatgcatgtgtgtaagtatgtgaatattagtatgtgtttgtgtgtgtgtatgtacaggaacatgttatacgtgcatgtgtgtgtgtgtgtgtgttggtacctgaagaggccagaggtgttgggacctcctagaaatgaagttataggcaatagtgagccacccagagtgggtgctgggaactgaactcagatcctccacaaaagcaataagcactcttatcctctgagatgtatgagttaggtgtctctatgttaattttttttattgtgaatccctttgaggatagggagcaagtgttaatcttgttatccacaggtttttttatactgcacgccatggtccaggttattctccagatgtttgtttaatggaataggtcaggaattttcaactttaggagtaaaaggtacgaataccagataccagtccatatttaaacgagaactcttaaaaaaaaaagtatagatttgtgctgaatcataaagctaagattgggtttagaaactttcacgccatgagacaatattcatgacgttgacgttacaccatcagttttgagtatgtgctccatgccagagctgctctctaccccatccacatgaggccatgtcatcctcaaggcaagtcagtgctggcctcagcacctgccctcggcagtggatgagggaactgaggcacagagagaaagtcaagaagtgggaaaccacagctggcccgtagatgagctatcagtaggaccgaggctcagctctcactgctggctgatccctgcctttgctctcatcaccactggtacccgggagatgctggaggagattcaggacagcggctctatcactagaaatgattcacagggaggcgtgtgatgataaacaagacgctctgggaaagtgtgaccgtgagagctgttacagtgtgggtggacaagaagccgggggaggagacggaagaagttggggagtgttgtagctgaggaggggcgttaactaaatagtggctttataatgtggagtaggtttgtaggacgtatattcatgacttttgcttaggcattgtcagaaatccacctgcctctgcctcccaagtgctgggattaaaagcgtgcgccaccacgcccggcttgtcttcatttttttttaaagaattatttattttatgtatatgagctgacttcacatgcaccagagggtgtcagatctcattcaggatggttgtgagccaccatgtggttgctgggatttgaattcaggaccttcggaagagcagtcagtgctcttaaccactgagccatctctccagccccatatcttcattttacgtcaagaaaacaaaacaaaacaacagcaacaaaactgaggtctagaaccaagtcatctatctgtgttatgagcatccttttggtccatccttaaatataagctagtgacacctcacaaagtcacctcactcacctctgaagcttcctgatctttgactgtttatgtgtggtcatgagaaacaagcacactgcccatggatgacgcaagaagtagaatcggtaggctaggacgttcactgctggctaatgagtgaactttgtacatgctttgtgtcaaatccccactacaaaactgaggggcttgtgataatgctcccatgtttcccatgaaggacctgtggcacagagaggttacttggttgtctgtagagatgcagttcagcgagcgggaaagcttggtttcggggacaagtgtctgcctctggagacaggtccccacctacccttaagctaatgctctgcacgaagggccttgcgaggacttccagtaaacttctttgagcactgagaatgaccactgtgctttgggataatgtacatggctagccttcagggatggcttaaataggagatgctaagaatgtttgaagactatcatctgatccactccacacataaccatgtcattgccccgtatggctttgaaaattcctcggggaacatttgttgcttggttatttcacatatcacttttcttttgcatattattatttttttattttgggttttggtttttttttttccgagacacggtttctctgtgtagccctggctgtcctggaactcactttgtagaccaggctggcctcaaannnnnnnnnnnnnnnnnnnncgcctgcctctgcctcccaagtgctgggattaaaggcgtgcgccaccacagcctggcttgcatattattttaaaggagatcttaattgttcacttggcccccagtactaatactaaacaagttaatcaaatagctgtgcgtgcggacagttcacaatgctcggattctttggtcaatgaatcctataggagccaggcctttacacacagaactcttgtaaagagtggtttttgttttgttttgttttttgcacagccagtgactgtgttgtagggcgtgcttcacctccagcagttacagctgggttttctgatgtcatcacagaaaattaaggtaaataacagaatttaatttaatagtaatgggaaccatggttgttcccaaagcactgcagcagtggctgctttaagaagcgaagaaacctttttaaagacctatttattaagaccagtcttttcctctcaaaaggaaattttctcctcctcttctccttttccttcactttgctctccctccacctcctccttgtttgtcacatatataatgagacacacacacacacacacacacacacacacacacacgtatgtatatataaagtcagggggaaacccgtaacagaacagaaaaataaagaaaaagtacctagatttctgccattcagacataacagttacctgtgtcttcgtagctactcacgaactcatagaattcttctctactaatcattttgtttttattcaaaattccatgtgcttattttcctatgtgaataaatatagacccatatctcagcagtacgtgctgactgtcacctactgtttttaacttccgtcttggctgttagggaggggatctgattagttttagctaacgcctcaatgaagtcatgtcaaaatgaatttagaacctatttttgtccgtgtcgcttactgtttcctatcttgcttgatttagtaactattaacactgtaaattaattactggttttatttgttcgtttctgttctcgtgttaagacagggtctttttatgtacgtaaccaggcgggcccagatttataatcttcctgcctcttcttctggagataacggtgttttaggcacaggttcccgcctctgatcccctcaagtactctggataaatgattcaaagctacttcgtgcaaaatgtatgccgcctctccatttcttgactgttgcacagttgaggtctaccatattgtgcagacagtcaggaccttaacaagagaaatgcctcccgtccttcatttggctctctctttacatcttctctcaggagagccggactgggaaaggtcctttgaccttggtaggatgggacagtaaatggaaacacctgaatctacccaacagcttggggttggctaggttttcttgcagaatggacaggcaccaaagaatgttacgcgacttaagagcctccatttttcacccgtattcaccgaagaccctgtcttggcagtgggataagtcccatcctggagaccctcaaggggcccgcagttcagcatagggcagaccggatggatctggagaggcagcagggagcagagacacagctgtggacctggcatgtggcagcctgctaccacaggcttgtggaactgactgtgtgtgtcgctctttccctgaatccaggacagcatgattaattggaagtatggtcaaaaatatttgagtcacttgtttttgttttgttttgttttctttagtttttcgagacagggtttctctgtatagccctggctgtcctggaactcactttgtagacctggctggcctcgaactcagaaatccgcctgcctctgcctcccgagtgctggttttaaaggcgtgcaccagcacacccgactgagtcacttgttgaaatgattttgtagataataaatttgaggctcaactagcaaagcagattgggatttgctgctgctgctgctgctactactactgaaaggacatgagtggggatggagagttagcttagcagttacaagcaatgctgttcttccagagggcagcccgggttggattcccagagccatatggtacctcacaaccattatagctccagtttcaaaagatctaatgtcctcttctggtctttgggcaccaggcatgtgtgcttacttacaaggaaagcacccatacatgttatatatatatatgtattttaaaggacacacatcttaacccaagatgacttaagaaaataacgcagaggtatttatggagcctttgaacaagtttattactgcaagttaactgggaccccctcctggtgtttgtttgtttgtttgtttgtttgtttgttttgatggcccctgtggaactgagtattcagaacctcaggagggaagcgggtgtcacttccttactgtgacttccctggagcctcacgccaggcagcttcagcgctcgatcccaaccagcaacagctgcctgtcctgtctcttgtcttgtcgcttctatgcgcatataagcagtttgttcccattgcctgctctcgaatacaaaaaatgtttgatatcctaaagatggttggggatgtgtgaaaaataactgctttaaaaaatggtataacttagttactgttgatttttaaaaaggagaaaagaaaaaaaaagaaagaaaaacttggacttggtcaggatccgtgccaagaaagcacaatacttctgggcataaaatgccagctttggtctatgcagactaggtagaggtctgaaggtgtttgattttatgtctcccgtactgtttaataatacgaagttgagatggagagatggctcaacggtcaagagaacttgctgcccctgcagaggactgaggttggttcctggtaccacatagcagcttgcaactctatgaatatagtttcaggggagctgatgccctgatcagatccaggcaggcacatggtacacagacatacacgcaggcaaaacattcataaaataaaaattaattttaaataagtgtgaagttaagagtaaagttgaataatgcaagtttaaattaattaggctccacgagggcctaatctatccaactgtagtaagtacggattctgtgtttcaaaagaagacctttcttaacctggctgggactctggaaacagcagacaccccaggaatggtggaagaactgtggcatccacagtgctgatgagagacaagtcaccatgcaggcatatctggactgtctgttctcattcttgttggttattttagtagttcttagatgagctcagtgatgtctatgcagtatgaaactggaaaataatagctgcttaagaaagtcattccaaaggctttttaaactttttctttctcttttctttctttctttctttctttctttctttctttctttctttctttctttctttctttctttctttcttttttttttcttttcttctctggtttttccagacagggtttctttctctgtgtagccctggctgtcctggactcacttcatagaccatgctagcctcgaactcagaaatccgcctgcctctgcctcacaagtgctgggattaaaggcgtgtgccaccactgcctggctaaatttttcccttcccttcccttcccttcccttcccttcccttcccttcccttcccttcccttcccttcccttcccttcccttccagatttatttgtgtatgtgagtacactgtctctgtcttcagacacaccagaagaggacatcagatcccattacagatggttgtgagccaccatgtggttgctgggaattgaactcaggacctctggaagagcagtcagtgctcttaccgatgagccatctctccagcacccactgtgtgtcttgaatcatttctttcttgctgttttcttatctggaaaggggtcacagcaaagggctgttacactaactaaggaaggcacattccagcccgaatgctttctggtttaaaagcccccagaactcttgggtacccgatatttaaaccagctcacagaaggaaccccatctgtagtgttttcatccgtgttttgtgagatggaggtcttctatgctttggaggggaaactcaaaggaaggaaggcggcaagcagaggtgtgtgaagcggggaatgggccatctgcattagtggcaagtcttacgagagaagttcaggcaaccacatcaggcaagaaacctaaggctaacctgtcccatctaagctaacgtgattccatctaacctaacgtgattccatctaacctaacctgtcccatctaacctaacctgtcccatctaagctaacgtgattccatctaacctaacgtgattccatctaacctaacctgtcccatctaacctaacctgtcccatctaagctaacgtgattccatctaacctaacctgtcccatctaaccgctggatgaaaaggacccctgcacactctcctgcccccctcaggcaagtgccagggttcccgggccttgccctgtgtttagctttctccggggtggggttaggtgggggggtgggggcgctcccctgggatggagtgagccacatgataattttactcttggagaatatgtccaggagttttcccttgtagctgtcctttatgtttatttttaaatttaatggatttatttcattttaacaagaaaacaagggatgtctttacattggtcagatcagtagattattttttaggtttcttatttttttttaattggtccactttttactgagttgctcacacaacaaaggttttacccattcaaagtacaccatttgaggtagggggagggggagtgtgttagtatactcagggtggtttttttgttctttgttttttgttttttgtttgtttggttggttttggtttttcgagacagggtttctctgtgtagccctggctgtcctggaactcattctgtacaccagactggcctcgaactcagaaatccacttgcctctgcctcccaagtgctgggattgaaactcagggtttcaaagccatcaacaccgtcagttatagaacattcttgccacctcagaacataactgtctaattattttaatcagatcacagtatatacctatggcaacgttagtgatggaaagtgaaaaaaaaatcttattatccataagcttaccatttccttttttttcctcttgcctccttgccaattccatgattttggtgtgaatataaatctataaagagttgatatcagaagaactgtcacctttgcctctttcttgatgtttatcttgggctgctagaccccccaccccgcccccttcagcccactcttggtcatccgaggcaaagcaaatgaggggaaggaggtggtgataatctacatactacacattcgataaagcttctacgttccctatggaaagctgggatcgcaacattctcttcctgtgcctcgttgtcttcaagctgttctagatgggtggccagagaacccactgagtgcaagacttctgccagtgccagtgctttgtgtctggctctggtgaaggaactttccagcacactatggtcgccaggagactgctcttcctctggttgggtcagtggttcagtgctgctcaggtctttggctgttggttggtctttgatgttttgttgttgttgttgttgttttagtttttgaagcttgtctagggtcacatgggttgttggttccagcttgctgtgggcatatgctgctctgcctggtcctggtcctgggggtgggggggggggtctagctgaattccatcatgggagagtccgccccaccctgacccccagagtgtctccagtttttcttctcatggccctgctctccagcagctgtgtgggaaccctgctgtctgcctgtactcctggttccagctcagactcaaccactaaactgtaggtgcgctgtgcgggtgatgaagccactgacaaggaggttctcataagctggttgagccacgggggctagcctcttattttctaggcctagagaatcctgttttaaaccccagacctacatagttcttattagtgtgcactacatgcataaaacgatgtctcattatgacattttcattgatgtataccatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagtctggcttatttccctctactaaaaagatctctgggttttgtctggttttcctgaaaatggtgcgatttcattctttatgaccgagtagtactcctttgtgtgtaatccataccacattttcttcagccactataaatcacaccatagttgtgcagacagatacctttgtgctctgcctctggatccattgggaaggagccccccccccccccccagaggagacatggctggattacactatggttttagttttcaattttggacctagtcttgtgtgtcctgattgttagcattctgtctaagctccaccccatatttacctggcaatagccaggtaggcctgacccactataaaaggggctgtttgccccctccttgctctcttgctgtcttctcgtctgttcccccatctctccccatgtgagattggtttattgttgggggagggggaagggggcgacagagacaaagggagaaaagagagaaagagcaaagctcaagaggatctgccttttatttaggctgtgacgtaactggttgcaggtaaacgtgggagataaactaaatggacactggggatgtatgatgattgccatggcaacagatgcacgggtgacatcaccaccatcgctgggtccagaggcgatctgtaaagctggttcctcacaccaacatcgatgacagaaccttgtccctaggggtgtctgtctaccttaaaaggcagcttgccacttgccctggagagcgtaggcaggcaggagagaaatgatctctaaacagagagactgtttctatcactggagtctgtgagtagccttgcccctcactgaagcaagaaccaaaggaaacgggacttcagctgcttctagaatttaggttgggagaatgacttcagagggaggggttaatggcatcggagaggtttgtgaaaggcaagcacagaacctgattatctaaaggttttaaaactcagtgtttgtctgaagcaattgaaatggtcacctggagggacctagggcttagaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgcttttgctttgtctctgcctagctcagtggcggctcaagggttggtggctgaggaaatggtgcttgagccccacagtgaggtgacaaaaatcctaaatgcagatttttctgaggtgagccctgaagagtcttaggcacacagagaagaacttaggggaaaggcaaacgcatggctgtgagcagccagatagcattttccctcaggtgtctgtgagaagcccagctgctcttactgacccttctgttgggtgctttactgcatgttggctactaaagatagaaccatacataaaagaagtgatttgggggctgataaccggaagttagattggggtcctgggttgccgaaagtcgaagaagattatgaggatgcagctagagaaaaaaaacatttaagaccaatgggtcattctgtcaacattttgactgataacaaattgaacgatttcatttttccaaaagaaaaagatctggacttgaaaatactctgattctcgcttagtgttgcctttggtctcccggtttgtgcagtgtgtagacctctagaatctaaagtctaaagcaaaacaaaatacgattgccccgtaagctgtaacctagtcaactgagctaagcaggcagtacacaccaagggtttcccagctcggcaccaacccggcaaagttgtcaaagaaaatttacagttggttaccttacaagcaggtctcttgcttccgaatcctaccacacaaaggcagcttttgttggtcaattacttggtctttcagaactaagaggtcttgtgcagcttgaaagggggcgggcaccgtcgcagccatttctccagtgtcagtgagatttagaacttagcacacttggaaaagttcaaccatgaaggatccattggctactgtcaacactcacagtactaagacaggactttactgaacaaaacgcagttaatttcaaaaaccccttccagattctcctttctcactctttatagaaaagtcttgtcatttcattatattcgaagtccctgaattgaggtggatgtgttcactagggtaggtatttttccaaagcatcaatttaaacgttggaatcgcagttatcagtagttgtcttgtgactgcccaagacgaattagactctgtgtgtttctgtttctgttttttttttttttttctatatgttgttctttttgggtgggtgtccttttttttttttttttttttttttttttaaggagaagttaggagcacagggatggggtgggggacctgaaaaaagttgggaagaggagagagtatgatcaaaatatattgtatgaaattctcaacaagtaaataggaacataaaaaaggatgtcttgctagacagtggcagttagcagacacaaacagcactgtataaaacactagacaatagtatttgacctgctggtctatgttgattgtaaatgtaataacgagttaaatacaaaatgtacttctttatgatagagtccaatatgctttaaagataagaaatgggtgtattttgttttaagaaatagtggactattagtgctgatgtgttttggtccccatgaccttaggaggttcctcggcatatttaagcttccaattgcaaacgggaaggcgtggtcttggcagactgattagcagctctgcgtctggagccaggcacaacttctgattttggtcctcctcctgataatcagggatcacgtgtttgtttgcagtttcccagagaagcccgtgatgtattcagaatgcagatgccagctatgcctccttgactgaaaagggaacaggttagggggaggagccggccctgggattccaccttgcatccctgcctgcctgtcagggtccctctcccaatctgaaccacttaccccctcgtcttcattttaccctttctgcttggaagagtgtgtatttagccatcagttcattttgtgtggtctgagttataaaatgcccctgctggttttttccatatgaaaagcatgtttttcatttgtggaaacttatataattttttccccagtctctctctctctctctctctctctctctctctctctcttttgtgctgctttaaattaaaagcaaatgtatttccctccccttcattctggctctcccgccccacccccacctttgcatgttccaattacggagttgtgaaaataagtcatctttcagcttttgttactttagaacagctatcgtgatgtcagagtcaatactaaaagcactaagaatgctggcagaacaccgtgcagctgcagtccaacatgatgctggaaatggggttgagagcataaaggctttccatattcccagggcgcacaactgctcgcggccttggctttgatctcttcaaaggctgctgcctcctcctagatggggagacttggctgccactcgctcacattgaaaaaaggcagaggtctctattcaggcagaaatcaatcactgtgcagaaacaattatgtgtaattcaaccatcatgaaaacagggcgagattaccgggtttgttacctgagtgactgtgcggggacggggagcagagaacactggagtcccgctgacatgccacatctcgatgacaattatagacacatgaatgatgtggcgggcgggggaggcccagtgacaaatgctggtcacactgtccagcagagcagaaaatgaggttacaattgggagataatgtttgcatatgtaaccatatttcagcaagctgaacaacttcagggaatagacccttaaaaactcccgtgaatatctgcatgcttctgtctgtgtactagcatgcgacttcgctatcggcaggatcaaagatcaaaataatccaaataatttaggattgtgccagatgagaagaaagaaactttaactttgggttgtattggctcatttggagtgtactatgccggcacaatttctaacctaatacatgggtcagtctttagacatctgattcaagaataccattgtgttttagaatctgctaatctgtctcacaaaggccttagtgcttgctcattggcatgaatcttctggaaagtgatttttttttgtcagttgtaccatcttcccttgttttcataaagcaaaccttgtgaaaagcctctaaatttcctttcattgtggacaaaaacaaggccgattttctacataggaaataacttcttgccttcagtagaggtctatttaatctcgcagccctggcacacaaagccgtcgaggttttttttttaattatttttatttttaactcattcttgacacctaacagaagcaggggagtcacctcacacttggctagctagctgaggtgcgcaggggtagggtcggggtgggggagggcagcacaaaaataagatgaaaacctggatagctgattataaaacttggtattgctgctgcgcagtttgatacccaggccctgggtttaccttttatgcggctccagcttagacatcagaggcgtgagagcctgctttgagttacagatcttcaaacaataagtcaaaacaacaacaaaaaaaatcaatccccctccggtccctgggtgcagttatggaaagataaaagagaaaagcgaggctatgctaaagcagatataagaggaggcgagcagataggctagggagagaaacatggaggacaagtccgagttgaagtgggcctcttgtgagccagcatcagtggactgttatcttatcaagaagtttgagggtcagttgacagttctcttcaaactggatccagtctggtcccaggctgcctggagcatcggcttctataaagtcacttttccccatcttaaatacaatcaacttggaatggggatcacattccacccagtgtataaaactcgccactgactgcaggggcgaattagaggttttgataatcccttggtattttgaatataaatcgagggtggtgggtctgtgtgttttgtgtgcgtgtttattgaaagctgagggttatatgaaatgctaggcaaatctctacaccgcgtgtgcattctgtggccaggtttctaatagccggaaagccccttaagatgtctgtacttgccctgtttcttgtggctaatatcaggcataactggaaaatagtcactggctattttggccagcatttcaattcacgggccaacctgtattttgatgagtccaagacaggaaaaaaaaagctcacattttaaggatagtcttctaaaatagcatccattttacctattagttccttagctaagacacagtgcatttatttgactccctgagggttcccagatggttcccagtctcctttctcatccttctctctcggagaagagcagtgagctgagttaccatgggcacggcagggtgaggctctggccttgcatccactactttagctactgtcctgcccaccccatgggagcccagggaagcagtggcagagctcacagcccttcaggattttggtttcaggttttacaggagaaaaggaagtcatcttggcacggtaagagctggaggctgctatttcaggaacgggtgttctatatataactatagttaatcatttgagtaaagccatcccaactttcatttgcatagctcagatgactcactgttttgaaaactaaataaactcaaatggaaaacaaccgtgcacactgtctgctgctacttttatttcctactgtggagttaatgagcagaacagtggcagagccatttccatacgtcttaaagagaaaaaaaaagcattaatgactgtactttagagtaaacctcgaagctgggcggtgtgtgccctaggcctggacaagagaggtgtgattatttctggtttcttaaaaggaagctgagatggggcaatctcaggctgtatttttaggtctttgtcctccgactctccttcaggctggctgcggccagcatttccacgccagtctcttaccatttcctatcagtaatcccttcttgttatccttccaggctgccacaggatgttgttgtaagtggcttcgcgttgacccgcaaggaaggaagtgaggcgaggtggcatgcctgctgctctgggtgcagcaagttccctcctgtccttgcttggaaacaccttcaaattccccacactgtcagccacctaaatattcagcggtgtctccaaaggggttgggaaaagagtggagagcttccataatctccagaggggtcctgagccaccgctgatgactgctaactaaaagcagtcttcaaggcacaacacccaactccttgtaccaaccaaactgctattcttaagccttctctaagttcaagtcacctctgtagctgtgtacacgtgtgcgcgcatgcgtgcctgtaagcatgcatatgtaaatgcagtatttaaagctctggagacagactgccagcactcaggtagatcaaggtgagagagaaatgcaaaacagccttggatgctggcatgccctgttagtgctgttgaaaaacacagtcctgccaggcggtacgcctttaatcccagcacttgggaggcagaggcaggcggatttctgggttcgagaccagcctggtctacaaagtgagttccaggacagccaggtctatacaaagaaacccagtcttgaaagaaaaacacagttctgtttgccatacaattaaaaagacttggcttctgtcatatacactttatttatttatttatttatttatttcatgtatatgagtacactgcagctgtcttcagacacaccggaagaaggtaccagatcacattacagatggttgtgagccaccatgtcggtgctgggaattgaactcaggacctctgggagagcagtcagtgctcttaactgctgagccatattcccagcccctgttaggtacactttttaaaataactaacttactacgttaaaaaaaaaatgactcagtgtgtgcgcaatggcatgtgcacctgccattatatgcaccatgtttgaacaccatgtgtgtgcagtgcccacagagatcagaggagggagttgggccctggaacactagagttcctggtgttgtgagccactcatgttaggttttgggaactgaacctgagtcctccgcaaaagcaacaagcactcacaaacaatctaaccaaagacagacatatagtcaccagccccattactggctcttttgttgttgttgtttgagatatactatcatttatttttgtttgcttgatatttgaatttccacatttgatctgtttccagagtagagcccagggttgaggacggaagcttgcagtccggcatgtgccatctaagcctgtatttccactgaagaaagatcagatttgggttgtattcctaggggctcatggccataggtgcatatgtgcacctccaaatgtcttaaactcttagggtccagtaatttggatttagggaagcagaaccattctttatattttctccctgccttttcatacacccaaggggagttagctatatatatattttttagcagaaagtagttttcaattacacaagtactatatttttgcatattatgtgtagaggggaatatagagtattcctgtgtggttgactagatattgcaatagttaaaaagaaagctgtcttcaggttttttgaataacaagtaaaataggagtttaaggtctaaaacataccctgagggtacagcagggctggcagatgtcacaaacagaaaaggaggtcacagattttcagtnnnnnnnnnnnnnnnnnnnnnnnnnnnnnnnnnnnnnnnnnnnnnnnnnnnnnnnnnnnnnnnnnncctccctccctccctccttctctcttctttctttctttctttctttctttctttctttctttcttaaattaagcacctatattcacagcaaacttgtaccagaaaactcattatttcaaagagacacttagagtttcactggtaacaatgttttcaatgactatacatctctgtaataacttgattaaaaatactggaaatactctccttggcccttgcattttcaagttacattatcatttttaaaatttctcaaacttagtatgattgataaataatcacaaatactgatgttttctaagcaaaagaaaaattaatgagggtaaatgatcctagatttaaaaaattttattattcctgcacaccaagaattaagttgtttcctgtatgcaacatgtaaaccatgacactggacttgttattgcaagatgcagaagaggctgacttccagaactcaccatgtgtactgcgcattgtgtatactgcacagcgtgtgcatggctcatcatgtacactggcacatcatgtgtcctggcacatcctgtgcactgcaccccttgtgttctgcaccctctgcgtactgcccagcatgtgtgctgcacagctcccctaatgtgggcagagcattcaaatctggaattgttgttctatagcaagggacctaactctgttttacgaaaaggaaatctgaggaggtggatgttgtctcattacaagtatttgagctgccatcatgctctgcagaacatagatgtttggggggacagaaaccagaaacccactcaccccactcctttgctctacttttcgggtgcctgactgaatcgccaggggacttatctgtaaaagtttgggagacttattcagtagaaggagaaagtagggattactcagtaaattggaacttttatcaaatccagtatcaaatagagatttaatagatgagacttctctatggtacatacatgttggcttctgtatcagaaaagatgaatcctgattcataacttaaaacttttactacaatcatctcaaagttcttctgcatggagtcttcccctgtccctgttcacccggctgagttttcttttcctacctgaaatccagcacctggaggacctgcctctttctgcaccacatcccaacctttctctgcacttgtgttgctcccaggcaaactgaggccagtttgtcttcatttgaccagttaggttggccactgcatgaacgattttcttttaggctgagtaagacgaagttggcttcgaggatttttaattacactgtttgatgtatgttcccatctgggcagggttcaagaagggagtggagccaaaatgtaaaggttccttggagccaggcgacaggaggagtggaggggggaggagaggaaggaacaaccatcggagaatccaagcaggtcattccctgaaggactgaaggagcacggagcgcggagcaattacctacactaggtggctggaggaggcccacaagtctccacttgcctaaaacccttctgctggcaggccattgaagtgtcactcagcaggcttactccccacctggtgggaagccgactctagccctggaagccaggtgggagtggggtggcagggggagtggtctgcatttttggagctatcactaaaaccactccaagccactctccctgtgagttggaggatgttgtcttttgctgcctggcactgtttggacaggacacactttggtcttctaagccctgatgttgctcaaaccctttgccggtctggcaattctttgtgtgacaccctctatgctgactcaattctgactatcctgagcatttgaaagtagatctgactccctccagggcaaggctggcatcaagtgtccctccctcatggagttccctagatgcagtggtggccttttagacagctggacagcttttagaagcttctctttgtttgccgtgctggcgtttgggcgcattacctcacagcatcacatcatccgacctgaagtttagggaaacttctccacgtcactcagtcgttcttagccattttgggtcttttttgggtcaagtgatcacggtcagttgttctcttcctcttgtcatgtggggcatccatatcctctgtagccactgtgtatctatcaggctgacagcaggtacaggggacagctcagcaggagagtcccaggtctacttcagaatcctggatctgcctttggcttacagtatgactttgaaaaacttcactgcccaggctcctaattttctcctgtaaagaacgatgccatcaccatcttcacagagctgtgtaaagatgagatgcacgcacatagatcatcaagctgcctaacgcattatggtagccaggtagacgcttttcctattttgtaaccacaccaagtgactcacgaacttgtctagaggtattcagataagtttatgcttcctacacctctgaactgtaaaggcaccaagtggactgggatggagctatgctttgtttcctagctttctttcattgcaatggattagtttagcaggacaatgggacagtggtggtacaggggaaggagggtgacagccatcccagctgggtgcaggacccctcctgtgaagaagcaggtaattgtatcagtgttttcagtgagagcagagcagtagcaggccacacatcctgtgtttgtagccttgcagttgacagagaatctagaaatagaggattttaaaatttagtggaaaaaatcctatgctcatcaatttgaagttgtgtgtgtgtgtgtgtgtgtgtgtgtgtgtgtgtgtacacacacaaacattcattccactaattgtgaggatccatacatccactgcaaaaaaaaaaaaaaaaaatgcccagagccccactaagagcaacatatactataaagtatgcttgtcacgtgacttttctaaacttgagatttaaaatcatgtgacgaatggcccttgagggtatgtgattaaaagttgcaggtccacactaggtagatggacatcttgaccagagaagtaccccatgtgtgtagggaagatttcccctgacacatttgacaataagatgaggtgattctttttttccagtgtgagaggttatgggcttgcactgggtagatggacatcttgacaagacaaataccaggatctttaaggaagacttcttccacgtcattgacagcagaatgagatgactttccaagggggtggtgtccaggaacagagcattcacggttgggagtcctacgaatcttttaaggatggtaccggaagagcctttgtgtaggaagctataccttcagggtcccttccagccctgttactaatctaaaagacgatttagtgtggaggggcaaaggctccaaggaaggttcctctggagacagagcccaaagcctggacccagtctgagagcaaaagccagcactctcatgtggagaacgcctccccaaggaggagcccaccactgctttacatttcctccttgactcccctgattatgttctcatgataaagtttaaatggaagtctgataaagccggttcagaagccggttttactcattgtgggtctcagagtgtgttccccaagtgcctgggagccctctaggaagctccttctaagaactcggtaggccaaggattagaaatctcggtttacagccaggcgtggtggcgcacacctttagtcccagcactcaggaggcagaggcaggcggatttctgagttcgaggccagcctggtctacaaagtgagttccaggacagccaggactatacagagaaaccctgtctcgaaaaaccaaaaaagaaaaaagaaaaacaaaaaaagaaatggtgttttactaatcagtccagcccatcctggtgcaggctaatttagtaagcattgtgtattcttcatgaaggagtcttaaagaaagtttggaaaacaggtctaagttaccttacccactatgtgtagggggtggggcagtatgcagtacaacactcaaagtaccagagaatgaaaaagaaaaaagcataattggtccaaggcggagggctgttgggaagtctgagctgtgagaagtgcagattggatttgaggggtcagacttagaatggcatccctctcttgcctagattgagatacaatgccagccaaatggtaccaaatgggactccatttcccatcctgtggatacaaagacctcaccccatttctccttgttatgggcagtgcattagtctaaactcctttgctttcaatccttaactgtctgcttcctggtttgatcattgagatcatcagccagaaccttgaacctgtgtctgcaatgtccttccaggtctacctaaacccaagacctgtttgttacagagcactcactaaacaatccctgctgtgtctctgtctctctctgtgtctctttctgtctctctctgtgtctctttctgtctctgtatctctgtgtctgtctctctgtctctgtctctctctgtctgtctgtctgtctctctctgtgtgtgtgtgtgtgtgtgtgtgtgtgtgtgtgtgtgtgtgtgtgtgtgtagtcactgcaagctctaggtaatctgtctatctctgccctccccagtactaaggtcactgcacctaataacttttatgcgagttcgagggctccaaactccagtcatcatcttacagagcaaataagcaatgtattcactgatccatctccccagccctttcctcttctaagcttaatgattctgaccccctgcttctcaaatatccccaatactgaagggaataagttaatgggttatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatactcacaatagctctttttccgtatttgaacaactctggagttgacttcttacatgccggtgcatatcaaatacttgcatttatgaattgcactgaccagtgaagggtgatcagtttgttagaggaggccgagtatgaaggactatttgtattttctctattgttgcttcagcacagattgaaaaacaaaaggaggtaaagacctttaagttcttagaagaatcagaagcacatatttgaacctaattaaggccactggacgcagtaggatcattcactgggaaggcagtaatagtagctactacttcttatgcagcctgagagcctgtgtgttctccactggaaggcatggctcttgcttgtgagttttggccatgaaaaatctgatgagtgttaacatagctacagttagtaactttttgacttttgaataaactttaatgtattccaggttgtctcatacatagattacagtaaccatcttttatagattacattaagttcccagataaactgtagcctcaagttcctgatgagagagaaactataccgccacctattgcacttatacaaactatcttgtgggccagcccctaaaattttactagtaagccattaaaaaatgttcctaaaaactttatttggtgatgtcatgttatgcagcagattatttttctacgagatctcaaagccctacacataccactatgtgtcatgtaattggcacatacctgctgatcttacataaatatcttctagtttatacaatgagttttaaaacagatctgtgaggatcctacttgcaatggtaggacattggaaaaaaaaagattgcatgtgaagaaacatgtttcaaagaacttgttaccctatcattttcaatgatactagtattttgttggctgaattatattgaattgattactgcaacgaataccaggaaactcagcgtacttctacagagaaatagtgtcacttgtctatgctgatgttctcatgttctcagtcaggaggaaccaagtcctctgtgtggacgactcacatgagatttaatagggcaagagcaatgtctccccaagcttagtgtcatcattgctttattaaagtatgtgccacagatctggcctgtctagaaagcagtgtctggcgatggaggccatggtcttaggatcatgctacttgtagataaaagaatgtcaaaatctacaaagtctgaaatctaaagacatcttccaaaatatttggtggtgaaagtggaaacccctcctcaaaatgatgtgagagcttttctgttctttatcagtaccagtgaatgtgattttttttttaaattgagtttcactaagaaaaagttgaagtatctgagtgacctgttacactctccaaaccagtggttcttcaccttcctaaggccaagagagaccctttaacagtgtgtcgcgttgcgatgacccccaaccgtaaaattatttcgttgctacttcataactggaaccttgctactattgtgaaccgtaatgtaaatatctgtgtttccctgtggctccaaaggggccatgaccttcatgttgagaaccaactgctgctcgggccttcactgaagagttatgtaatgtgctgtgctcagtctgtcctgctcaggtatatgggtattgtgaagtgaagttcgttgcctctgagagttcacaacacacagagcatcagtgattgacctcttaatagttctaggtggcttctctgatggaacagatggagttttcttctgttttgtaaaaatttaatacactgtgtgtatgtgtgtgcacgtgtgcgagcgggcattaacttgctagtgcacatgtatggaagccagaagataacttgcagtaatgagttctcccctcccaccctgctccgtggcgagcaccttaactcacggagccgtcccttcagcgcttgcttttgagacaagttgtcattatctagctaaagctgtcctcctaggtggtgggatgcttggcatgcgccaccatgcttgctgtgacagaaaagtatgtgatatcacgcaaagctggttttctatcttgattttgtattccactgtgtggctatcaatgcataggttacttaaattctgaaataacagttagtgttcattacttttttacagttcaaaaacaggatagatatacagcatccacatacacatttgtttacatatgtacatacattattggctcgattctgcctatgaaggagacaacttttttttttcctttctaaggttgcgtggcaaggtttagtataaattcaaggtctaaaagaacaagaaaggctaaaaatgaagggataaggaaggaccatgtatgtgcaggtaatcaacctaagttatgaaagggttataaagctctagtttgaacccagtgctctagtttgaaccctgtcgtgggtttttggaggctaaaaatgaagggataaggaaggaccatgtatgtgcaggtaatcaacctaagttatgaaaggggtataaagctctagtttgaaccctgtgctctagtttgaaccctgtcgtgggtttttgggtttgatggtggataaatgcatacaactgtggagtccggtgggacgtcccacagcctcccacaccgtgtaagttcacggagatggatagacagacttgtggactggatccatttattgtgtgatgtttcttatttgtgagtttgtttgttttttataatagaagtttattttagccgggcagtggtggcccagcagcacttgggaggcagaggcaggtggatttctgagttcgaggccagcctggtctacaaagtgagttccaggacagccagggctatacagagaaaccctgtctcgaaaaacaaaacaagttaatttttaaaaagagcgtttccaaaacagtgtttgatgtgtaataagtcaagacagctaacttatggtggctttattaattttagatttaaaatcagtaccgggtgtcttaaaatggttcctgtggtctcccatcatggcagacgagataagccagcgttctacatgaaagaactgaaagcaggagacatagtctacatatgtacacatttatacaaacattcaacatgtgcacatatatatgtcctctgtagccagagacatgattgtgtatatccagtctataaaacatttttctcaacaatatacatttcgaatgcatcccagggctgactggaaaggagggcaaaggacaaagagagaccagcaaagaggggaagtgggggcccagggtgtaaccagcctgaccagggctgctgttggctgcatgtggtgaggcaaaggtggttttaggtcttccataataacccaagagatagactagagtggacacttagcaggaaaactccagcagaaagtggggctccttagggctacggaccagcctctaggtgggggtgaactagatgtaaacacactttgccagagaagtgtgtcacacgtttgtacaaccttgaggaggaagactatgcccccgggatctgtgaccacggctgaccctcgctgagacttacgctctgagctcgtgcacatgaataaggaggaatgaaagtgtcccgcctgttaattgtctgtaaggaacctccagtttgatgatggtcactagcatacggggagaagaaaaagtctttgccagcagcacttccctccaagaacatctgtagagaaactgaccagaggatgctcatgggtaagaaatggtaaaaatcacagcgcgatagccaccactgggacattcagctgagccagacaccaaaacctaaagttgatgttgtcttatctctcagtatggatgtgataacaggcacggaactacagagacacagataccaggtgagacgtacgtggctactcgtgagacagtgtagctttataaaaatggccacctacgtttgaaagacagaatccatcctatgggagaaaaaaaattaggaaaaactaaagtggataggtttaatagcaggctagatttaggtaaattaatgaaacatagaaactgaaaaggcatagcctacggagagacaaaaaggacaattttaaaaactacgatctggaaagcatttgcaaaccaggcaggataagcagtcatgatagagcctcgatgtcaatcacagggaatgtggttctgcgttttcacatatataacaagagctccaaggtcaatgacagcatcatatataacaagagctctgaggtcaatgacagcgacacgaggaaatatagagaagtgtacttcctagtaaggaattttaacttgaattctccagtggctgtgataagtcaccaagccctccctcgctaaatgttatttatcgaacaagtatgtcaaccattagtgtgcaccattagtatgtgtgctcacaaatatcatatggattgctacgttcgaatagttcaggacataaaacactgggccacgagccatgtgttagcaaacttcaaaggattaactgtaacccaccatgttctctgatcacagagtcaataatttaggagaaagcaaccaaagaagcccttttctcagtgaagaacactgtccgagggtccccaaagtcaaagcaaatattcaagtctgaatgacaataagaaatttatgaatcagaaccagtggtaaacaagggggtgtgagagggaaactcacagtgttctatgtgtagcatggcaaatgagagagaaatgacagagccggagcccaaatccaccagataaaagggagaggcgggtgataggagtgaacgcaggttggtgccagcatcctttgctggcggatgctggtccctgctcaataactttactggaggtctttggtgatcttggctagaaagtatcatccatgttcatgcatggcctagaagacatgcaagtggaaggcatggctctgcccagatcctgtcacacaattttatgcttttgctatgtcagccttttttgtcaagagaggaaagaccaacaaagtcaagttttttgttcttttttggtgtgtgtgtgtgtgtgtgtgtcagtctttttgatgtgtatatgtgtgtgtatatatgtatgaacatgtgtgtgtgtgtgtgtgtgtgtgtgtgtgtgtgtgtgtatgtgtgtatgtatgggtgtgggtgctttaccatagatcaaattcagggtctctccgagcctctgctgttctaggcaagctaggcgcttaccagcgagaccctctcccaagcctaggtttgatcagtgtgaacagattcactctaggacacagatgctctaagtctgctctctgaacttctgggatcccagagtcagtttcagaggacccacaagatcaaagctgtcttcacaacaatccgatgtcatctttctcccttcagtcttcagtgttgacatttggactgatgttaagaaagcaatgaccggccaaacttctggtgactgagcgctcgccaatcatggcagtgacccccagctctgaggataccggggaactctttattactgtggactcccaaagaagttgtgtcacttaacaaagccatggaagttaccaaggcccctgaatacacgtccttgtattgtcctggtaaacacacacctgggcctaatgttttttgtaagtgattgacaggttgaatatggggttcagttgtttggtaggctgtcttctcaaaaccatgagaatggggcctgtggctttagaggttgcaattctcaccaagaataaaattctggctcaaagaacaaatttagcaaatgacttctaacacagagactcgggtatctctgtcgggtgtggtgggcgctctgtggcttgacatttgggctcctgtgctgtgtgaggtagttgcctgccaccaggcaagggtgcaatcacatctttcctctgggcccctaggcctcagaatcttacaaaacaaaacacagttgcagaggttagaggaagacagaaaatcaccttactacgctccagaaagaagcatattaagccactttaaagtaaattctatgtagatgacatgcttcagaggcaaatattctcgccttctcccactgtaaatgtttactcccccccccccccccgcacctctttggtgtgagttgctggagaataattaattggtcagaaagttggtgctggggctctcggggctgtttcctaatggtgtaatagctgtcaaggtactcacagaaagtctgtgtttggaaaaaaaaataatgaccaaaacaaatttttgttgccccaaccaaaaataaagctcaaggaacggagcaacaagcaggagaaggtaacccagaaaacaggtctggtggatgctgggctctgcagcgtctcattaaagaaaacaagtcaagattgatctaattaactccacagattgagcgcatcctacttgcagagcaggtggctgtggccttctcctgcctgccacagctgtttgcttaaactgttcacatgactcattctgagagagagcctttaaaaaaataagtaaataagctacttgaaatcttccccttccacctgctaatcaacttaggaggaacattataattacacacacggagtccccggccctctcgcctctcgcaagacccgaagtggcctcacagggatggacagacactcacgggacggacagctgtcttgtcttatcttggtgttggttagttagttggttggctggttggttgattggctggctggttgggtggttagttagttggttggttggttggttagttggttggttggttggttggttggttagttcagctgtggcagtggacttggaggttccccttccattgacatcctgacagttcccagcaccactaccctacaaagaggggctgaccacaggccaattggtgcgttgagtattactgatgccactcctgagcagacagaagcctgaggcgctgtgaaatgatgactctctgtcaccgaaatctgcagtcaaggctgctgagtttatctagtaaaaataacttgtgcttgatcagagcatgggcttctcccgcgagtctcaaatgggtcctaattcctacttgtctctagccatgatggtctcagacaacctgtttcatttttgcaaggctcggtattccccctccctaaaacactgagaagggctgtcaacgaggattacacatttgttgaatagtgcctggctcctggtcccccaaatggcagaaattgtaggtcttaccatctgctgatatgaacgctagtaggaagttgtgtttcacaagtgctccttatctcttgctgtcttcccaaaccttggtgccctgatctctaaaatggggagttggtaggttagttttcctccctgccttcagccaccaccccgctgccccggggtttgctggccatttccagtcagcctgaatcaacctccctggaccttttgtggctgtgcagagaagggtccttcacactgctgcggtcttcctccctgttctcctgctgttgtctgtgtcgcttccctcctctcaccacttagagctctgcgagaggttcatagatcaaagccccagaagggtcaggccttcctgaagtgcctggagtgaccctgagctggctggccctccctcacctcctcagggcaggcagctcctgctctgagggaaaggaagaaactggggcagagctgagctgaggagaaacttgagcctggagggcctccatcaaaaagctatgctaggcttctgttgtcctttggaaagaagctcatcaaatcttactggaaagatgctgacaagcagtttatagcctgtcagacatcgcggccatcaataaggtgataaaatacatggtcaaaggaaaataggtataacacaacctcagaatacaaagtaggattgcattgtctgttctcaaagtcaggtcttgcaggggtcctgcagccttcatctctcacgtgaccgagattgcaagggtgcgccctaccccacctcacagttttgctaatttgattgcacacaggaagttataacagatcaagaaaaggtgtttatctctattgaagctgttttgtcctcagcacagcgccaagatttctttagttacatttggattttctgtgtgtttttacacgaattaagaaggtacagctgagttttcagttttaaagaaagaaaccagattgtctcacatgggacttttcacttcttcagagaagaggatgcaagcctgtgagttgtgcagggctgtctcacgctgagggcacctgtgctcacaggctcacaccttggggcttccgcggcctccgagctttggtatgtaacccctcccttccctgcgaggccctgcgggtgcttgcaatccaaccagcactgttcttaggttcaggattcctctacagagctctgcggggcgagggcagctggcctcatttcagaaactgagccaaggagaggtgatcatagctttgggcaacacagccaccaccccccagccccgaagcaaagccgagggctcagccccaggctgttctttccccagagtctaccacagctccacagtgctcactgagctaagattcctggaactcagcagggagtgtacaagttagaggggttttgtgtgtgtgtgtgtgttcaagttagaaggttttttgtttttgttgttgctgcttgatatttatttatttatttatttatttatttatttatttaatgtgcagccatagtggagctcagtcaggacactaagctcaaatgtgctatataaagtggacatggcctctttgggcccttttactcatcctgggttctgtcagctgggtctctcctggtccccctgtccgcttagctcttcaggtcccaatccaggccccaaagccacctctgctgccaggttctccccttattttctactaagagagaaaaagagaacctcagattgcttttaacttgcatgctgtctttcattcttagtcttcagagtgggaattttattttactttgttaaaaatgagtttagggtccagagctagattttgagagctgaaaatagaacagaaatggacttggatctttctgggtttgactctgtgattgttcctggtgaatgcctggtgacattcgggttcatgtgtcattgtgcagagcttcctgcccccaccagcctcttgcccccaccctgaccctgccctgcccttctctgcccacagggtcacagtcaccttgtttgaccctttgaaaaagtaccagaaagttctcaagagcgtactagaggatgtttggtattttgtcagccctggaagcagtcttgggtttggggtgcctgcattgtgtggcaaaacaggatgtttggggtgagcctgcctgcaggctgtgtggttgtggcaggatgggcgccctggctttgcccctcactccctcgccaatccattttctttgtgtacaggcttgtcacgctggggcccgtgtggctttcctccccagtagccacacctcttgccatcgccacatgggtcccatctgtctctatcaaaacaccagagcacagattaatgtgatttgaaaactcggtgaggcaccaggcctaagcccactttatacttttcttgtccggcagtatctttcttgaatgccagctgcatcttgcttgcttgccccatggtcctccctgcatcctttctcccttctcccagctgttagtcaagaacagagaacagttggggctgagtctctgggaacagaggaaggggtgaaccagccacctcttgctttcccctccatcccctgtcccccaagactgcagctggcctgcttgatgctctgtgactaagccacctgagtcgtctatggccgagtctctgaaatactcagcaagcagcaattgttgttctcaaataccagcctgtgggaagcaagataaatgtgtgtaaaccgttaggaattacacagctttagacacattcaggaggaaaatgggggaactgaaggcagaggtggatatctcattgatatctcattgacctgacacatctcagaaggttcctcgttgacttttatagggcttggctcaggtcactgtcacttctggttctcaagttctgctggtccctttgggggtgtgggaggggagttgattatctcttagattctaaagtacctcaggaaggctgctggtcctaatttgacctggttgttagggccatctttctccatgaagaagtactatctttctcatgaagctgatcgcctttcaaattcattgaaacaacataaagcaaattgctacccagagtctggacaaatctcaaagatgctctgatggtagcacccatccaagtggtcagtaatacaaaggattgtcctgacttgttcctgtggctgggataaaacattgactaaatccagctcagggaggaaagggtttatattatatttttaccagatagggtccattattgaagggagctgggagctcaaggaagaaacaaaaacagaaaccatgagggaacactgctggcttgctctccatggtttgctcagttggctttcttatgcaacacaggactaccacttgcaaaggggatggcaccacccacaatggactgggccttcccacttcaatcactaatcaagaaaatgctccaggagacagagacacgcccacagccaatctgatggaagcaatttcttgattgagaaccttgattgagatcccatcttcccgggtgactatagtttgtgtcgagttgacagtaaaaactcaccggtgcagatagccgtgtcgttaccgagcagcgactaagggttgtgaatgttataagtattctgttttttgcatttattgctttatttatgcgcttgcttatttagaaacagcctcactcaatagcaccaactgacctgaaactcactatgatgaccaggctggccttgaactcacagaatcccacctgtctctgctcccaagtgctaggattaatggcgtgaaccactaaacctggcttacgagtttattgtctctagtacttcctgcagtaaccgacacacaatcgtctccttttacagctgaagaagcagagtttaagctggtaggcaagggttccagaggaagccagtcacacaaggtctgcagcaaggcccctgcagggggtgccgccggtgacagttgccaaaggctgagcactgaatcaggaggttgaggaaatggcatttgtgtcgttcctttcgacacaagttccatctcgaagacaattatcctttttagcagtcttttaggaacagacaggcagttgtaccataggcggcaaaccaacgctgttccattgtggagactgtgagtgcctggagtatatatggtacttaaaggagacttcagcttcagaggaatcagaataaactcacttgaggcattacttttagaaagtgaaagtgctcagaggtaaggacttcgatgctgagcagtttccatctctgtactacctaggatcaacaacagacatacacacacaaacacattcactcatacataacacatactcacactcacacatatactcagatccacatgcacacacatttacacactcacacatgcacacatacacaggcacacacacacacacaacacaaagtattgtttggcagttgttaattttctacctggacaactggttagagctacatccttctcttcttctccgcctcagtaggagctgccagcaagctgaggagaagttttggaaagggagaaccttgtccttgggaatcctcattactttccctttcacacccctccccctccagcctttaaaagtgataattgcttgaaaggactggtgggaagtaatttgtattggtgaagctccagtgaatctcaatggagtggtgttgaccattggtggcttcctgtttaattacggggcttgagaactatggtacctgcccccatctcagccaagggcctgagacttggtggggataagaaagcaaaaaaagaaaagggaaaaacaaaacaaaacaaaacaaaacaggacttccctggtttttcaaaatcttgtatgtaaaacaggaagtcatggttttgtaacagcggagaatgtcttcaaacgctttgaatgtttgagttttggtctctagattaaagtgtgtaccagttcaggatggttgcggcttctggtggttgctgcccccgggtcttggcactttacatacctgcctttacgtgaatgctgacggcacagcgttgtaaggggtttgtccgtattaacatgtgccctccactaagtcctctgggcccccccaggtctcgctcctattgtccaaacgaaggaaaacagtaacggagtgactctccggtggccaccctgctggtgatggcagcactggccttacagttctggcaaaggggacatgcaactcatctttgctgtcctggtagacaggctgtccctctagagtttcagaagcctccgtagacaatccagcccttggccagtcaccgcttttcacctgttaacaacagagacaaatggagccagaagagttgcccaaggcgctccgatgccagtgcctcctgcatggtctcactcctgctttggatttaattggttcatccacacaggtgtttgggcagatgtacctaaaggctgcgtagatggagacaaacagatctaacaagttgcccctctgtctgccaagtccctttgttaacaagccggaatacacagatagaaatgtcaagattttagacacccaagtctgtatgctaaacctgggaccgggaagagcctctgccgaattccacagttggcctggttcccatcctgtattctcggctgcagatagaaaatggaaaacacacagcagtcaaccctaattatgtgtaagatctcactgcagattccttctaatgtaattaagggggttaatagtgtcaggagtggagggagcgggggacctgaggtgtgacaggggagggcttgtttgcttctgttcggtttatttttaaaggcttgtgttgagctgttcatcctaagccaaagtgagcgtcctgtcaagcaagggacccgaggaggctggactctgcgctggtgctgctcaccatcctgttctgccacatgggaaagatctgtcagataggccagggcgtcttacctcacagctcagggcttcctgagggtgcttgctcttgctccgacgcaagtgaccccagttccaggactgccttttatataatgtgttgtacacgcaaggaagggaaatgggagtttgtctcgtgcttttatttggattggacaaaccaagtccagaaaaaaaaaatatccttagtgctctgcctattaacccaggtcaaggcttcaagaagagagggtgtttacagggagtgatgagacccggaagaacccgaaagacagaaaggtaccaggctagactgactactgacagaagtctttctcttggtagagtcattacttgctcctgatggctggcttgggaaacttgatgagtggggaggacagacggacaggcaggccatcatagcctgtggaagtcaggggcgtggcttctgtgctcttcccaaagccagagtgggtggttgcccctggtggtgggaaccaccttctttctctcgatgtgaagaccgatgtgtccccttcctactccgcccctcccttcttcaggcacctgccatggctccccaggcctaactctgtggatgcctgtctctgcattgctaactgtgatgttcaggagggagagccactctccttccaggcatcctggatgctggctcctggctcccacttcaagaaacttcatgtggccgtcgtccctacagtcctgtccccatgcaggtttctgacccagtcacagagtggtagcagaaggcagcggggtgggggtagggagtggagccggagtgttggtgtcagggctagtccaccctttctattccttgtacctaaaacttcatagctgaccatggagccacttggctataatcccagcaggctgagcaagtggattgcaagttcaatcccgcagccgctgcctttttccgcctgcgctcttgttccctagttgcccgcttttgctttcctcgttcctgattggttttatttgcaaatccatcacccgtctccaagtagagactcagtccttgggatagcggaaagagtgtcctcatcttatcaccttgtcccttctttcttttctggcacagccctttaacacacacagaaggtgtctgatacagtgtttccaaatcgctcagaagcgagctgtgttgactagagcgggctcacgcgggctcaccgctgggcagttacaacagggtcaggcgggagcttggagttcctggtgcagctctggatgccactgtggcctcagctgcctctctcacgtgagcatcactcttctgttccctgattgatgggagggcggtatcatagaaactccagctctctcaagctctagaaccttctatcagcaaactgtcttatacttcttggatttgaaggggcagtgttggccctttcatagcaaatgcttggacggtttatcccaagctcgcaggtcactttgcatatatctctagacaggcagttagggagggccttgagagattccagatcagagaagatgagatcttagccatggttcagtcagacttgggccaaaaactctagagaaagaagttggcgactttacctcccactcgtgtcctcctggaccgaaagcatgactcggaacagttctgaagttaacttggaaactattagtgaaagtggggatagataattttatttaaaattcctaaagagcaacctctacactttcgagtctccgtctgtagttgtcttagaggatggaaattgcattcatgtgaagctgagctcgtctcagtttttaaaaagtgttcttgtgaccaaatgtggggagggtaagtcatggttctgagccctcggttgggtgtgtgtggtttcaggggtgatgtagacaacttatatctggcccgagtatgcctttcctgtaacctgggcattggaatctgaaaatcccgctcccttcagctccccctgtgtcagcccatctatctacctggctgaaaacaagtcccgggctgagcccgggaggtgtacacagtgctgtcccgccgtagatggagggtgtctgaagcggcaatctcccccatctaatttcagaacattttcatcagtcagcccacacactgctccctcctctcagagtttgtgtacatgtctataaaggaggtcatacaatttatgctccttttttgcatctggtctatttcacttaccgtgtttccaggttcatcaaccatatgtcagtccttccttattatgactgagtaatattattttgcatatacatctcactgtttgcttctgtgtttcgactttttggctactccatgcagtgctgcatatgcatttttttttaaagattttttttttgtctctgcatctgtgttttgccagttatatatgtctgtgtgagagtgtcagatcccctggaactggagttacaggtggttgtgagctaccatgttggggctgggaattgagcccaggtcctccggaagagcagccaacactcttcaccgctgagccatctctccaggcccctgcatatgaatatttatatacaaatatttgtgtgaataaatgctttcagttctcttggatcttaagaataaacttgttgagtcatgtaactcatgtttaacttattgaggaactgtaaaatagttttcctgtctgttttaaatatttttaaagctttaaacatcaaccaattaaaaaaataaagaagtgaagatcgaacaagcacaatgctttagggaaagcccaacaaacacaaggcgtgctaaacaggcgaatcttcactattgtcttagggtatattcacatttaaagattgaaactggatttaaatgtagggaaatgtgtccccacaggttcctttggacacattcagattctggtaacataaaggttgaattattttaaaattatttaactaacagttacagagttgaccaggagcctggagcaccactttcattaaaagtctgatgaacggtcagtcgttcttagcatgaactgggcaatgaaggggaggcagactctttctctttctctctctctctctctctctctctctctctctctctctctctctctctctctcgatttattttatttttgtgagtacactgttgctgtcttcagaaacgccagaagagttcatcagatcccattacagatggttgtgagccatcatgtggttgctgggaattgaactcaggacctctggaagagcagtcagtgcccttaacctctgagccgtctttccatccccgggcagaaagtttcttaatggcactgctttcaggaatttcctaaacagagcagctcttcttgatgttcactggtgagctcggctcaagcgtgggacttgcaagtgacttcttgaatggtgatcccaggggttgctgccttccggtgaccttgctcaacttttcctggagcatacacacagagaacagtggcatgtctgaggaaagaagctgcccctgcagctgtcctagggagaccctgatgcttgagaaggcaagcagcaggctgcatcgtagtttgatgaaaagggactggaattagtctagccctgtgctttctgtggaatttttggactttggggctttcttctctgagacatggagctcttaataccttctttaccgagagatagtgaaatctaaacgagacagtgttggtgacttttcctttgggagaccctgaacagatagatatacaggtatccttctgccccaaacagagaacctgtgatagacccaagcaatgactccccacaaagcccaactcgccagaatgtactgggctccttacgggaacgtgggtgagcagttactcacaggaccatgtgggttcaacagcagtggcaccatccaaaaggtccacccctcctcggtgaggctcacacaggcagcatccctgccccctggggttctctctacacaactcagcaaagggtatggctgtctccgctctgtagctgtcttgattgttgatataaaattggaaagggaagggcttgtgcatcttgtaatctcagggattcctaagacttggaagtggtttatttccagagtctcagtgtctcctcttggaacggaacattctgaggagactgctaccctacaggggtgaacctctttgtcgtgttgtacatctggaggtggtgctgtgattcctttccagcttctagcccaagttttttttgtacaacctttccttggaatggctgttctgttctgagacaggatcttgctcctagcgcttgctaatgaaggactcaaggccttcaggctagattcttgggatgtgatggggcctcttcatccacaggtacttctggaactcacgatgctctgcaagcattcaagccacggagtttataagccctacacctcagctcagccatcctcatcagaggggagagctgctgttgctgctagctccgatgggtgtcctcccccttccccaaacccctagtccctcccctgggtctgggcaatgcagccctgctgagccacagatctggcagctgggtttgtgggaagttaggttcgaatctgagtaggttcagggcaggttcagggcgtaggagtgttcacggacttctgtctgcggtggttcttgttgaaattctattggggcaggatgaatgcatctcatctggaggtcccatccctcagcctttaggatattaacacaacctaatgggttcttctactggaagaaactggacttttcatcctgcggacaatggagatgcttcaatgacaagtcacatctcttctgtggactccgttgtggtcctttagattgtcagtgctccctgtcgtcaagtcatggtcctcctggtggcagtgatctgtcttaaaatctgttgttaatactcccggtcctgaagacactcctcaccaaagagcatcttttcttccttttggggtcacttctggctgtggacataagctacagactcatcagaggattggcacacaggactttttaactgatgctcatggggccactggaactaggaagcctgtggggaatatgaccagtgcctatgtgttaccatttcctgacctgagggactccacttctccggctgtggccccggacatcactttcctgccctcaaggccttgtctacctgctttctctccagagcacgtctttctcgcaagctgttaatgttcatggctcctcttggtgtttgttgctctcccactttctgattaaacttatttggctagtcttccactcgagtgcctttaaactacggcatttggatggccctgctgacatgtagctcggcgtagatagaccacattgttccatagacaacacattctcccacaaagttgtctttcgaaagtggagatttataaccacttcagaaaaattcaaagttagacttacttggtatttgttgaggacgtacatgttggttgactattctcaatgtgggaagtggccttaatggtttccggtaggccagaatggagtggacaccatagtcccattcttgcaggccaatgtgctctctgtatgggctcttccttgatcctgacacaaacccagtgtgggcaaagaattcccctcattcagcagagaaggtgaagctcagaagggtgagaagttactgactgggtgttacacacaaaccaggcaggacactgactgggcgttacacacaaaccaggcaggacactgactgggcattacacacaaagccaggcaggacactgactgggcgttacacacaagccaggcagaaccaggaagtactcttaggttctagaccttcacattcagtcggaggcacaagaacctcaaatcctggccatagagtaattttgctcatctgtctctcgccccaagatacaaagttcgagagtttcaaaactctctaagccaactctcctgttccctggagggagtatttgttctctggggtcaacatcccgcaaagcaacagacctctctagtattctctagtcagcatccacccctgtgcctttgacctgggcagctgctctgatgtgccccaccccaccccaaccaagttttaaagtcatgtccatctatggagtgaccaagagaaatagtctcagttttccatctttatgtgaatctcatttccctttcttcatgtacatatgtgtacatgtacgtatgagagcacgtgtgcagatgtgcactgtggaggccagaggttgatgtcaagtgtctttctcagttggtctccccttgctttttgagatcactcactgatatggttaggtcgcacagccattgaaccaatccttctgtttcctccagcactatagatagcctatgtccagtgtttctctccggtgctgcaatttgcactcaggtctctcctgatactgtggcaagcacttgaccaactgatccccaaagctctaaaccttatttccacagtcaactttaaaatgtgtacgctatcaagccagagaactggctcaactacaaagagttactcagtggttaagagcactgactgctcttccagaggaagagctctgttctcagcacctacaaggcagctcaaaactgtctggaacgcaagttacagcgtatgtaacacaaacaacacctcttctggcctctgtgggcaccaggcacccatgtggtatgtagatatacatgcagacaaaagtgtgtgtgtgtgtgtgtgtgtgtgtgtgtgtgtgtgtgtgtgtgtgtgtgtgtgtgtgtagaagagggggcggcacgtgtatggcacaacatactcgtgaagaccaaaggacagccttcaggagtctgttcgtttcttctccaatggttcagggcatataacggtattttaggcttgtgcatcacaggtattttttccacctcctgggctgttgtcccagtctttcacttacaagggcttttcattgggtttgatctacatttattcctctgataagtcttttaaaaactgagggaagaaactgcccataaaccttcaaatctcttctcacacacattgtagtgtatgggagcttagcctcagtgctcccagcccccagcagcaagggaaggcctggcagagcaggacctgtggctagagctacatcccctgcagtagagagtgggcattctaggtcttaggtcacacacacaaacacacatacactatacacatatgaatgtatgcacgtatatctgcataccacatgctgtattctgttttcttaaaatatataaatagaattgaaagatcattttgtgattctctgttcgtaaatagtttgacaaaggtcattactttgttcccgatgcttgtcaccaagagaaataagttgagaaagagtgttacccaagtaccatggtgtggagtttagtgtttaccagctgatcagcttctgggaggggcatgttgcatgttccccagttcctggagtgcagataatcctgcaatggtcagtcccattctacataataagaagctcttaaaattctcaaaagtccagcggtcagtttccacgcacgagaacaagccaacattgtatatccaggactgtgtagattgcccctgagaaagatccatggaccagaccttcagtgtttctctgaattcttcaaatgtgcacctaaaagggccgggaaccccaaggtggggtcagggaaggaccattctcattgatgctgagtgacacacatgggacttgactttgattctgcggtcgcagcagagtgtccttttttactagcacataaggaatagctgttgtcatctttgctactgtagggactttgtgtgtggaaaataaactctgttttctgaacatatctaaatagaattgaaggtcttttaaaagatgcgcgcactcctttttgaggagcatgtttgggcttgacttatctgggcattggaaatgactcagaatgctcagaattctgtagaaccccagggctgagatctgctcggcctccacctctaactcatttcaggattttgtgcttttaaatccaaaaccaaaggtgctttttccttgactcataagcgcatcctaagaggagtgacgtcacagtgtccctcaaggcaaagcgtcttttctgcccaggtagagtgagtgggtgatgggaagggaggggaaggggccttcagttctgaatcatattgcaccttagtggaggatcccccacagcacacagcgttccctcatggcggttactggagctgtacaagactgcttccgagtagtgtatgctcttttcatggtgtgcagaaaatgttataatataactttatgctgcttgttagagaattagcttgtctctgaactgctccttaagaagacttgagatctaagtttagattaatattgttcatgctttctctttctctcccctcccctcctccctctccctccagcccctcactcctttttatttattattcatttatcctttggtagaattttcgtttgctgtttgtgtgtttattttgagatgagagtctttctgtggaggccagcttggcctcagactctcagacctcctcctcatcctccaagtgtttgggtcacacaggggcatgtgatgccatgtcctgccgatttccagttctttatccataatttcccttttccataaaagagaaacctagacagtagttatgcaactatgtttaaatgctatctatccttctatccatcttgttagttgaaaatggtgcagtcctggtcatatcagcacagctctcataaaagaggccctttattgaaaggggatggggagagaaacgaggaagaagagagaggaaaaaaaagaggggtggtggtctgggtccctgtcttttatctgggctgtgaagtaggtgacccaggtgatgacgcacacaggtgatgcagatgaaacatgtgcagggagtgtgcagtggttgccatggcagcagacacacagggtgggtgtgtggtccttgttctctagggatgacggattcagaggctggctgtaaacagcttctgatgctaacatatctatctgtctacctttctttctcattcattcactcatgcatttgttgaagtaccttgcctgtgtgtacgtctgtgtaccatgtgcgtgcagtgcccacaggggccaggagagggtgtagatactctggaactgaagttagcatatggttgtgagctgccacatgggtgctgttagccaccgagccatctctctggcccctacataattactttttaggactcaagttggagctcatgaggcaaagggagcagtctcctcacatatactcatatatactcacatgtactcacgtgtactcacatatactcactcacatatactcagaacatgaggagagcctccgcatggaaagaaaaagcagggaaaacaaatacacggtgtatttgtaatttttaattgttccatagccacgccaaatgtgtaacatcagacaagtaaaaactgacatgattttagttaatacactatattttaaaaaagaaaaaaaaaatgctgaccgtgtggctcagtgggacaaccagcctggcatgggctggtccctaggtttaatcctcagcatagccactactgcctcaaaaaatgtttttaaagaaaaaacatagtgcaacctcaacggtgtttcaaactagtgcatattttacacaaacaacacctctcagctcgtaccacctgcagaaccccagccagtggctaactggctagtgccggcctgcatgagagagagtctcagtgctaactggctagtgccggcctgtatgagagagagtctcagtgctaactggctagtgccggcctgtatgagagagtctcagtgctagtcttccgagatcagcagcatgtctgagtgcccacaggaaatgtcttccgtcagcctgcattagctccaggtacactttttccgctagaccgtctagtggaagtaatctgtgagactttcctccttttgtttgcaaaaggctcttcatcgacttctccacaaaagataaggaccccacagactcaagcttgagtctttccacttgcaagcacctagctataagtaagagatggcttgagacccaatcactcttagcacagtcacggaggctccaagacacattcttacataagcatccctcacgtcaacaactcacannnnnnnnnnnnnnnnnnnnctcatcaagtttcccaagccagccatcaggagcaagtaatgactctaccaagagaaagacttctgtcagtagtcagtctagcctggtacctttctgtctttcgggttcttccgggtctcatcactccctgtaaacaccctcttcttgaagccttgaacccccccccccccccccccccgtggaattttgcaccatgcatctgcagtccaagcatataaacaccagtctgcactccccatctgtgtagctgtgggatttctctgaccttgaccccgggtaagctccagctggctgccccacctcaggggatctatagtcctctctcaggctccgaacattcttcctttcgctgtggatatcctgaatgccacacagagagaggtcttccaccctctgaaagtcagaagcaaggaagaggatttcagactctgtgagtctgctgtctttgatggtagaggtgttttgttgttgttgttgttgttgttgttgttgtttttaactttctatatgaatcccggctggatcatcgcagggctgatgggtttagggaagaacttgctgcagttgactgcgatcgttcgccctctaccccagagcagggccctttagggctggcatcctgcccttccccgttacccagtatcattatgaggggagatccctggattgcaaaggaaaatccagccagagaaccccgcatggaccagggggagctctgcctccgtatttctcccctaagccgtccctggcttgtttatctcgtcatttccccctttctgttgctgtgataatacatcataaccaaatcagcttggagaggaaagggctggtttgtcttattcgttacagtccatcacggtggaaagccaagaaactcaaggtggggacaagggaggcttttgcttgctcagcttgctttcttatacagcagtcctgggactgctggctggggtggtactagccacagtggcctgggccttctcagttcctcagttgagtgtctattctaggtgactcaagttggctacaaatactgctgtcaccaaactgaccaaagttgagtatgtcgctacttgatgacttactatgcagtaaagagctaagcacttctctctctgaatatagagtgttctgtagtcaagggactgtgggccattctgttccctgtccacggataagcaaactgtagccacccatcccccaaatccaacccacagatctgtgattaaatgaggttttcggtatccaagatgcagaacgtgttgcgacccgttgatatcttgctgtgtgaccccgactttcaccatagacaggtcctctacctacaggcatccataagtccccagctctcttcctggtgatcctggtgatcttgtcccctaagatgttggtcagcctttcaagtgaagggatgcctagtcccttcacctggcctcagaacacgccactgtgtcccctttcctagagtgctttaccactagcacggtaaacctcaggtctgttttggttcatctctggctgtttatcttgattgactcttgatggaatttagtggtgcactcagaggattaggggtgggccagaggctgtgaggtcagcctggatgatgggatgtcacaacccacaccacaccattgagtgttgttctcatgactgccccgctcctggttcttagtcttcaccccagtctctttgtttacagacccagtggttaagttcattaagaaaacaaacaaacaaacaatgcactcccagagttgctagtgtagtgggaagacactcgaaagagcaccttagcgtatgagctctgatccctcatgggtttcgcccatagcctgtgtcctccagagtgtgtgtcatgggctctgttcacacatgctttcctgtctgtagcccaatcaaggaggggcttccagtctttgtctgtgcacctacttctctccttttttaatttggatgctccttggatgcccgcgcatgcgcgcgcgcgcacacacacacacacacacacacacacacacacacacacacacaccgagaccctagctcacagaaatcctttgagaacctgaagggtaaaggttaatttgctctaactttcatgattataataacacactcactgcctgggaggggccgtgagaccctccccgcttctttattgcttagcaagaaggcctgtggctttgccttacccggaatgggctttggctgcatcacgaggagtctgctttgaaatccttacacacccttgaagacagaaattttacagggccacgcttgttcccggaaagccatccttaggtagctcgttgggagggtgaatgggcgtgggcaaggtgagcccttagactactgctgaataggaagactggagcaagatacaataaagaaccattttaaagaggggtccagtggtggagttagggtgtgaacctcctcacactgtgcacacactgagcacaatgctccctagagagaagtaagggactttaacctcctcttgtctcattgatccggcttttaactcctccctacacctcctctcttaaaatggaagcacaattctgtgtctttccagttaccctaggtcagtggttctcaatcttcctaaggctttgaccctttaatacagttcctcatgtttaggtgacccgaaacccataaaattagttcattactacttcataactgtaattttgctcctgttataagttgtaatgtagacatcttatatgcaggatatctcgactcaaaggggttgagacccacagggtgagaaccgatgtcctaaaggggtcagatcgtttaagctaaggcttaatctctgacatcaccttccctagaaggcaaacaggagccccaaatgctgcgtaaaacaagccaaagagacgttaaaatctttctcaattttcttctaaataagcttctattggtggtggcattttactctactctaaatgagaaagtgtgtgtgtgtgtgtgtgtgtgtgtgtgtgtgtgtgcatatacccccctcatccatcccttgagccttgacctttcagttcatgtggaaggcccctgtacacacacagttctgccagctttcccggacgtgggaggatgggagggcacgcacatcccacctcttgtcctttcttcctgaggcatggctttggtggcacacacctgaaggacgctacagcttctgagtaaacaaagacagacaaacaggaaaactaggtggcctcagaactttatagagccatcagaataattacagcatcgaatggtgtgtagcagcggttcgcttttacctgcaaaggagggtaacgggggaaaaatggaaaacggatgttttctgtgtgggggtgaacatgtatgcaggtgtgtgtgcacgtgcgtgcacgtgccttccctggttgccgtccaccttatgtgctgaggctgagctccctgagttgggcagctaactagcttgctaccggaaccctgtttctttcttctgcttgctggattacgggtgggcccccgcacccaccagcatctgaggctctgaacttcggtccccaagtgtgatccacaagtgcttttacccactgagccatctccccagactgctcttgacttgtcttggtgtggccgccattttcctttgtcctctagggtggcctcggagtgtcacttggagatttcttggttggtcatggagaaggaagttagaggttgaaaaacctgaatgatccggcatgccactgctggctttctgatggagagaaccctgatatgaaatgtggaagctcccccttccccgccacaaacatccagtaaataaatgtgaacaagcacagaaaccgaattctactaacaatagaactcgggctggccagtgccaaaatttggccttgtggtatacggagcagaggacctgatcaaactggcccagtgttctcctcctgggaaactgcaggtagataatggtgttctaaattttcatgcaacagtagaaaaagaatatagatggaagttcctgtttgtaatataaaggtatgaacgagctccttaaaaggagttgacttgaccttgagagcctgctcaggcgatcacgtgacatagacattgacagtcttgggtttgccagaacctgagttagatgttagggatagatgacgtaattacaacctcctcctagtgagaagaggcagctagccaggcacatagcaccagtacaaggtagtgaatacatacaatcctttccctatccaaaatcattccaaactatgtaaaccatgaagtcactgctccctgaactcttctgaatagcaccgttcatccagctgtcaaaacgtcagttcccaaagtgtgctctcagctctaagtctagggtctaggagtcaaacagtcgtcagggcaacagagcccccacgcacgcccagccctagccccatcccagtctctatggtgatgcgaaaccaagggtggataaaacagctggtaattagatgtttagttgcttcattctgcactacggtgccaggaaggccaaatgtcactgatataagtcagctaacatgatcaacttcattaacctttgaccgccaagcgtgtagttgaagggcagctatgattcctccaacgttggtgtctgacagatatttctcgcaaatgagcaaaatgcagctgtcacttcagtgaaaatactcggtatcgtttattaccagtgattttaaaaggtagctttcaaacaaaaattcgaattttgaaaactgatgctcactcctgtgagcttggtctctcgtctccatccttaaagctctggcagtggggtcactaatgagtaggctttgacactatgtaaatgaacatttccatctggtgaactctcctaaggaccattgcatcacattacagagtcatgggtgggtgagttcagagtggaagaggagtactatggtgtgcgttgtgactaaaccccaggagggtctctgccacctgtcaggctttgatctagtatcagaaaaggaaatccacaactgtctgaatacagctctagaataatctcaattgtggcagtgtatctgtcaagttgggctgaaatatgacatgccctagagaagatcagaatctaaaaacagacaatgaaaatccatatcttctaataagacaaggggcaaaaatacgtaaacaacaacacttctcgcttttatttaaaaaaagggttttacataaaatgtttttcctggtaggcttgcagttcttaaggtgtgctaaaatatttttagattttattataatcttgaatatgataactgtctctggataaatctgcataaaccaaggttcattggcaacaagtggttttttttttttttgtttgttttgtttttgtttttaagactatgaagtttacccaagtaaaacagttgaaagggcctctaagctaggcacaaatgggtccttctactctgggagaaggcaagttcagtaactggctgttgtacttgcatgcagcagtgagatatggagcagacggtgggggtcgtttaaggttgcctgcacagggcaccgttggccctacaggataggcacggtaacttcaacaagcagtggccagaggaaaattcttgaaacttaggtgcaaattaaaagtattttagagcggaaaaggagagtttgtttgtgggaattcacctgaaaaaagaaaaaagtctgaattctagaacccatggtagattgtctcagagatgtgcggcttgaggtttggaacatagagatttatctgtcggtccttttccctgtatccaccccgcagagcactttctgagcagatgtatgtggcaggactataattgtgttgctcattaatccttgctgtaatccagtcagccagtatctgctggtttttgcaaacgaggaaaccaattttggagaactaaggggattaccaagtgtaagaactgacacgcacttgcacgctgggatttgaactctgccctagtgcctccatgtcttaatattaaactgtgttgttcctggtggctggcacgtgacagccagaggatgccaggcctacctggtgttgatctacagtatacaagctgtagatctatcttgactgtctaacttaaggttctgtgtaatcatatataaatgatctatcttaggacttatcttagcatttcctataaggctggccaggttccatcaccttctgacaacatgaagagtcataggtgcttcgtgctttttttcctgcctttgtcttaaagcagcacattcactagtctgttggagatctgctggtggtggtaccggctttctccaagctaccgtttgttcctgtcgggatgtttttattaaactaaacacattcgtgatgcatggcaggctacactcacctggccggtagcttagaagagaggtggagagaggaactgcaaaaaccgcagtctggtgtagggagaacaaggattttggtatcaaaccaaccccagtacagctcatctgtccactaattattacttagctctgtgttcaaaagggctcagccccttcatctgtaaactcccggtaatgatagccacttgggtggagacgtgccagggcccatctgaacgcattcctgtgatggcaggcactcgcggggcatctggtccatactcattggctcctctctgggaaaagaaaaaaatgagcctccacatctggtggtgaggaaggcctctaggctctccctttgctccagagttggtgagaagttggcgaggatgcagtgtcgagaatctgggtctccttccttacctggaagaggcccctgtctcacagtagggatgctctcggatacgaaaagccacactggacctgagcccaacactcagccttggaggatggatgagagtgttgcagacaaaacactacctagttggtgagacgctcaatgtggcccgggcataggttagctcgcccctctgagaaggttgggcctctggctcctagaaggagcacggaggacactgatgacaatcagctgcatctagggagcaccggacttatttggagtttactcaaaagtaaaatcccaccatgggggttgaggccaggtgccatttctcaccttggtgagctggtttattcgagttatgcctgtactcaagttataattgggaacgccgctggtaaaacgcacaggctgctcttatggcaggtaccaattttgcgtgcggtgagagcccaagctgtgggtttttagctgcaacctggagatagagtaccagccactcacagagctctcccacttcccagcaggcccagggcctcagctgggagggaggtgaaccacattcagtcctccccagaccacattatcagagaatgacgactttgaggacaccccagtgccagcccgtggtggcaggcagtggtgagcgggtcatttctgggaacctggctttggagacggcactcagatccctaagtggcacccacttcatatccgcaggaggtgtgggtttttattggctgtgatgccaaagccgttcctacctgcagggtccagcctgggtggcagccagccagcccgccttgggatggtttccagctgtggggagaaatgtggctgttgagtctcgctgctctgaccaccactgctgaggtgcctctttgtctgaggcaattcctgtgcccgcccgggacatcgaccacagactcagcacatagatgtcacacgccgtcagctatgaccaggatggtcagagtccaaggccacggaatatgctggaaacgaacttggctcccagagctagcctttgtatacgttgccacactagcctcatgccctcgggaaaggtattgagtgccccccatgaggctgtctcatctacaagagcctaagagtcaaagaagtcagtataccggcaccagaggggcttgccgacaaagcgccggggaacagcgtgcacttggtcagcagtagccgccattgccaggactgttctgttcagcatggtagaatggcccagtggtgagccttccaggcttccgacattttcctaaaccgccatgtgttattagtgctgagcacgggcaggacagccgttctcaccctctggcctctgtgctcgctttctgtcttgtttttggttttgtttgtttttgtttttcgggaaaggggtatcccttgctgttctggaacttggctctggtctacggaccaggctgaccttgaacttcagagagcctcctgcctctgccctccctcccagtgctgggattaaaggggtgcgccatggtcaccagcgccaccatctcaatacttaccctttgctcgcccactgcgtacatttaggatcagattgggtctcactctgccgcttgctgccttgtggaggttactaaacatctccaagcaatagactgggggtgacaaagagctttcgggaggtgtctccaaaaatcccagccatcaggggtatatatatatatatatatatatatatatatatataatcacattttgggaacatctgctgattttttttttaaaactggaaagtaagatttacctgaatgaagaagcagcagatgtcacctttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggagaaagctgagttacacaaaatactggtgtgcttgatactcaacatggagagaatgtcaaagcatgagttgatttcccccaaaacttggagccagcatatggcacagtgctgggcccccttgcggctgtgtttgctggaactgagtggtgggctggactgtaccctcacagtggtgcctgggggcctggttcactgtgatgtgaaggcacggagacccatgctgcctccctcctccccacctcccctaccttcaggtcacttgatgcttccctttcagacctggcttgtttttgtttttttaaccatattgtctgtctccatcacacgctccccacagtgctggccatccccacctccatgcccgcccctccccgggagataagttgtatgatgacagagcctgcatctgtgctaggatggtacctgggaaattctcgggtgcttaataaatgggcacctgcacccacgtactcgagtcgctgcgtggggtgtcgctgtggaagtctgtctcacagactcaggtggcacctttatgattcttcccctcatctgttcctcgccagaggatacactgtgctattaggagatgagaagagcagaattcagaactataataatttgttttctctcctggattttaaacaaagtggcaggactgcttctgtgtgtgtgtgtgtgtgtgtgtgtgtgtgtgtgtgtgtgtgtgtacatgtacatagcatgtcccacatgtagaactgaggatagcagccacaggggcaatgtggcagacaacttctgtgtagcttgaatccacattgcttcattcatacacgtcatgaacatggtccgcaagaggcaaaccccttagaattctgctcacacataatactgggacttcatgtgactcttattttcggccacaaaaatggccgtaatccgggctggctttgccacacctaccagcgccacccgcttgcgctatccatcttgcaaaatataagacaaggccagagcttaaattaaaaatcctcagcctcttatctccttcctacaggaaagcaaatctgtgttgaaaaccgtaaaattaaggggagagcgaggatagcataatttagcagaaattcacggcaccagagcctgagccatatggctggagggacaggtcagacattaagaagtgctgcctgccaactcgttccttagggtggtgctctgaaaccagaaaggcatgtgaaatgcagagatccttccagaagatctctgcagcaccgatgacgacaacccctaagaaaatatctttgttgattacttggcaattacaccgcttttgagactatcaatctaacggtcggggtagttattctaagctagagttgaaatgtattcgttttcaaatttgggaagcaaaaggattttgctagtctaccttaaaaaaaataataatttgtggtttttgcgcctccccacccccacccgctttctctggcattttggagtccttgcgtttcagagacccttcttatatacttagtaaatgtcaccattaacacttgaaaatcattaaaggacttttaagccttttacacattcatatgcatagatgtttgtgttaatatatgtcgagaaaacttgtggggctttgataatggtgctccatttaataaaggccaggggctatatgagccatgcaagggttgccattagagaggacctggtaattaccaagcacaagcataattacccaacaatctacaaagatttttttttcagggttgttatagtaagcactgtagaaatcctatcattgtacaaaaaaagtgtgactttctgccgttaccattttgggggccacatgaggttcttttggggagcggttgccatgatgggcgtagagacccctagggatctctgggatgaatgttcttattttcctgagggtaaccttcacattaaaccgtatccttctggtgcttaattggtaaaaagcatcaaggttcctgtgagtgcaccataggtgcagtccccctgtgacggtatattgtggggtccctttgccatccagacatggccacacatttgaacagttcacatggggacacctgtcaggccgcttccccagtttctttttaatgtgattctttacttcttgagaaacgcatttcccattaatcttagcctggcacagtacagtaaaatgtcactaattcaaactaattacggtgaaggcatgcctgagctagcaagttcattacattctcttcctcttaaggctgagttgctcgttactctaatatttccacccgggcaccttcctgaggctgctgtaattagtgcatgcctcagagtcacagccacctcttccttccacgtgtgtaatcctgttacctttcctttctttgggagaaatgggaagggttttgttttgggttttttccccctattttcattgctgttgttgttatttgtggatacagttgtatgtgcttaccatatgtaacatggtttgtagtgggatggttaaatccaggtaattaacatctgaattacctcctgaaggttaagcatccactcagcaggctttcaggaagacaactagggatggggcaaggtggcacataccactaagcttggcctgatgcaagaggatgtaggacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaggccgcccgtgccgtccccaacagccttcttgtgggacattcctgaacttgggtatttgcgtggaagcactggcaactgtgctcttggctcccttgtccccttaatgactgcctactgctcctgcgtgacatcccccaccccccttgggaagaggaggggactaggaagagtcaggccgccatattaaccattggctttgtggttactttgcagtcaaataaagtgcccgtggtgcagccctctcacgcggtccacccgctcacccccctcatcacctacagcgacgagcacttttctccgggatcccacccgtcacacatcccgtcagatgtcaactccaagcaaggtaagcgcctccggcctgcccaggcctctgttgccaaccaggcagccgtgtcgcatgggcttgggtaccattccaggtgtgccggtgtctgcccccatgggagtccaagtgcacctgaagatgggtgcgtacagttggctggcagttcttcagaaatctacacaaatttgttgttgctttagtttttcacaaaaacaactacccagcaacaacaacaatcaagcagaagaaagtataatactgccctgttccaagtgacggcttaaaaaagcctacatgatacacaatacaagccagtagattgtgcaaacggtaaaagtctcggccatttatttgctaaagtatccacgtgggggtatgcttttcaagtcccaggtctccacactcactgaataaatgtgagccccaaacttaaccacttttctccatcactgggcctttaccaacaagctaaggccatgactcttgtggtcttgaagtacagcacgctaacaaaggctcctctctcctacgtcacagcttggaaactggctcttagccccgatctgaaaaatcgaaacgcgatttctctctccttcacattaagtccaggacagtccctttccactgaaaaaaaggaacattacagattccccttggcatatcttctttaccaggagagctgcttgcgccctcagggtcagttttaaataacatcagggttattcagacacagacactgtaatgctaggatggcagatcaattgacgagactccccagacaacaactaagtgaatcgttgggtggtgtgtgcatcgagggcatgggacccacgaataatgtatgtatcctatatagggaacaagaagccaacgatttcattatgcactccatttaaaaatgtacaaaattgttcatttctgaatatttcccatttattcctttagacttcagctgagcagggagaaagaagctgtgacttggagtgggggtggggcgtgggggactcccgtgtaagatgttggcgactttgaattgttttctttaaagatttatttatttattttatgtatatactacactacctttgttctcttcagacacaccagaagagggcaccagaccccattacagatggttgtgagccactatgtggttgctgggaattgaactcaggacctctggaagagcagtcagtgcccttaacagctgagccatctcttctccagccccactttaaattttttaatcaatttttggctgtgctggggatcaaacttggggccttgcacatagtaagaaaacaccccaacaccgagctacatctctagcccctgttgataacacacacacacacacacacacacacacacacacacacacacacacgcacgcacacggagtaaagcaggaattttttgcttcaagagttattttttcagcctcttggggtttctttgttcctttttattcctaccatgcaaatctgtcccttttaatgtcccatcctcagtttagatattataaatgaagtgcaaaaccatctctgtctagagacaaaagggcacagtttcagtttggcctctctgcgtcagtgacaggctccgcttggtcttcgtttgcagaagagcacattgtgtgagggctgaacaaacttgaaacacttgggttttgcctgcggtaagtgggggcctggacagagagtctctcagcctgggacctctcagcattgcttgtcagtcttggcttgcacgggcaagactgggatccagcagggctttgggcaaccataagggaaggcccaataaaacaggaatgcccagaccacagaggccaagcatgccctctgccctctgccctctgcccctccatggatgacctctattgacagtgtgaaaagagtgtctgggtccacttggttttctgctatttaccacttagcagtcaatcaccagaggccccagatccttagggtaaacagaacacttcctgttagacttgggtttgagtagagcccaggtatctctgtagacaaggtaagaagaatgttggcccgggaattgggcatgtagcttggtgacaggacatctgcggaaattgtgagatcctagtgttttgctctgggttgttttatttgttgttagtgctggggatggcacaaaacaaaaatcaaggccactatggcgttctccatggtgaacgggaatgtctttgggctgtccccagaggggccatgatgtaaactaagctgtccagtgtgggtcgcaacctcagtgcaggtctaagatatacatatatctgcagactgtgccactgtgagtgataaaactggagatttaaattctcagctataaaaaaaataaataaacccaccaaatgagtattattacttttgtttaatttttggaagaaaaggtgtgttctgtgttctgcttgagcactttggaacagtcactattttaggagaacaacacactgctgttgtggtttttctcggaagaattcttggacagtttagttttgaacaatagtttatagcctaccaaatacatttggcttcccctgtgttcacctgtctgccattccccctcccttgctttgtacagctaatttattacttctctggacatgtttagagactagactagtggtatgaatggttgcttctctgcttcctttagcctttcttttacagctattccacccaccatctctagttgttttaatgtggatatcctggttgtagctacatgtttgtcctgagcatcatgtactttgtcaccatgaacctctgctttgaaagtgcttattcacataatactgagtttatataatttcattctttcatattttatcgtcccctccccaaaacctgaacagactcattctagctctgctagagaccagagccaccaatgtcaatgttcctagtaggctagtcagctttgtctagttggggaaaacaaaaatattaggtccatgcagtagcccctggcagaaatatccagaaaatagaaactgtctttgggaacattctcatttataaatagtaagattcacatttctaatgttgtacattgctctggctgtctttggtgcgaggcgagggttgatcgtttgtttttaacttgaacctcccagaggatgctgagatgtgaggatttgagcatcttagggtcagggagcaagcaacaagtccctcaccaaaagccctgaagcatcaaccttagttcacccctccccgttcccagaaacaagaaaaacagcctggggaacaaatttggagacccacttagatgggatcaaaggaaattagtgtgcctaagcaaaactgaaaagagagttcaagagattcttggaaacagcaaactatgcattggcctgaggcaggagccctactgagtaccgcatggagaccacgctattctagtccatgcatctttgtgtaagaacagagaggaggttggtcctaaatcacacaagtaatgtcaacactcaaggtgccacataagtctctctcccatgttcaggtcctttggttacttaagatacacgaagtctatggatgggttaagtagtcaaacctcatgctatttaaagagcctccagttatgaatcataatgtaaatatctgatatgtaggatatctgacatgtgacaccctcaagggggtttcgagtcccacattgagaaccattgccctaaatggaaatggtcttttgaagccatggtcatccatatggagcggcttacttagcacttttcagaaacagtgcattaaatgtcacattctcctagtgtgaatgtgtcttgtcagctttgttctcccctgtgcctaaggtgaggtctaagaaaggatgtcctctgggactaaggattaggtaggtctcacacttgcaggacactgagctcccaggaggatgcaagcacaaggaccgatctggtggcattctccactgctggagaatatagctaatccagagcagtgtgaccttggcgcccagaggaccagcgctgatgagcagcttagagggagaggaaatggcagccaggaacaaatgaatcatatcaagtgtgaccactgaggggctgaagaggattcctaattaatcttccatcctctgaggtctcatgtttccccagtctatgtgtccggaagggaacctatgaaaatgacaatttccctaatctttgagccccacggcaggccaccttcttcagaagggctgtcacttgccattctacacagaaacagttgtctaccattttcttcaagtgaaataataagaacaggataaatcatcaggagagtcttgggatggttgtgccctggcagtgcgtgcatccctgcacgggtttcttaagctgcaactgtccacctgaagacccccttcgctatgatgctgaaatcctaaggaagacacacgtccactcgcccgatgtgaatgatagatggtttctatccccaaaatcaccagtgacatgaagcattttggttttttttttttttttttttcttgctcttccatataactgtctctggaatataaacaccgtacctttctgttccctttaacaggcatgtccagacaccctccagctcctgaaatccccaccttctaccccctgtctccgggcggcgttggacagatcaccccacccattggctggtaagagccttcctgtagcctttagctgagtgagcacgtgtctttccccttcccactcttggagattagctccctgtgcagtcacacttgtggaatgcaggagatttttccaccaacaagcaaggtgctaactttatttcatttcaatttgaaagattatttgaaaaaaaaaaagtagagactttgaaatggattggatctgtccactaatatgtgtagaaaatgactgcattgcgtttgctttgatgcttatagttttatggattcaatttgtggctttgggcatcagctctgccgtgggaagccaccactcagcgaggcttttctcttccagttttctttctttcttcttttttttttttttttaaacaactcatatttttgagatgtgaacttagactcgctggttagctacctttgtttctaagtgaccaactgagacaagtaactaaatgagactaaatgagaaatcaacagaacacaggcatctctgagatgttaataagcaagcgccaggctcatttcaaggaagcaagaagtctgttttatttaggctcttgattcccgacagacttgaatgccagtttttttccctctctgtactagttatttccagagacaatcctactgctgctgcctcttcattcagttcttcttacttgtttttatgacagtaaagaagctccgtgttgaggagtataatttttgcagtgtgtggctgtcctaacacagcttcctcctccagctccatgcctgctccttctcagttccccctcgctgcaagggtcccacagatatctctcccgattctccgttgagcctgctctccccacagcccccgtatcttggcttcatctctacgcccagacatcctggcatttttctccagcaaggctagggatcccaccccaccccctctatcattaagtcgctcagtctgagagtttaattgattatgtgtatatttgagtcctagctcaattattctgtctgaactcggctcctcgggagcgatgtgtctatgccgtctctggcagctgggagtagagattgtaagataaagactggaccgtgagagaggggaagaagaaggccctctcagagaggagcagagtaactgcagagaatgggttgtgtataagggggacgggtggagcagtatcccggaatatgtatttactttatgtaaatagagcagttggtgccctttctatttctaaattctcaaaggtttggataaggagttgactaagctgcttctctgaagggatagtttaccattctgtgggctgcattatacccaagaagcattttttttaagtcctactttgcattaaaggtgttgggtgagggaaagggataaaagagcgattgatgagccagcctgtgttctgaactaagggagggagggttttcttcgaggccccaggttgctttgatggttgaggtgggggaggctgaggaagggaaaccgagttgtaacaatgttgggggtggctgccttcccacacctcctcggtcctgtcaccaaactcttactgctagctggtaactcgtgttttgtcattgatgggttcctctcttctgtgacctcaggcaaggtcagcctgtttatcccatcacgggtggattcaggcaaccctacccatcctcactgtcaggcgacacttccatgtccaggtaggtggaggtggaccgcccaggtcgctcctctgctctcgttgtgcgcaccccgccccgcttgcctctgggctggctggcttaggagccccataacccagccccgcgtgtgtctgtgcagtgtgcctggctcccacactaggcgtcacagggcaccaggaaccattgcaactccagaattcactaccacctaccgtgggaggacaaagacacccccccccccccatagtggacgttagaagagtttggatttagatcgtactgggtggggtgtaggtgggctgagggggaaccctgacaatgagttgggtctgagttctacaattgcttcctttgtggaaacttaaactcagtttaatgaggccgcaccccatagttcagatctgtcctccactggccctccctaggcctttgggggaagagaggacagtgcccacaagtggtccggcagggtgtacatcttagtgtgtgaatcaggccctgtgtggacatgatgctgcaagtgacgctctctggggctgctctgtgtggcgcttctgcttctggaagggatgctgtgtcccgtgcttggtgtacttgatgtgcacacagctttgtgctgtgtcatctgtgtgtcccatgtggctttctcgaggaagccagtgtgtcactgtgccagaagtcaaatggtgagctattaaccggttgtgaacagtcttttcttttctcttcttttcttttcttttcttttcttttcttttcttttcttttcttttcttttcttttcttttcttttcttttctcttcttttctcttcttttctcttcttttctttttgtttttaatgtggatttgatgtttatatagtttgtgtggttaatctgaggttacatgcgtggtgcatgcatgcacgcgcttttgcgcgcgcgcacacacacacacacacacacacatttgtccagagataaataaatctagatggctagattggttaataatcttcacttttttaaatagttttaacactgagaactgaagacaaagatctccttacaggcacacaaccagcatcatgtatctttccgtttagcagggagggcagcattatttggtcaaatgtttttatttttgtctccttaatacttaagacatttgtttctgaaacactaggcatcctagcaagtgtccttttctcctttcctgatgaaacaaacaaacaaacagagaatgtttttcttgtgaaattaggcttttactctaaagcagattggaaagaaaaacctctcgtaggcaggtccagggtggttgctgagatacatcgttagctgttctcgcagggcagtttcttcctttgccatggctgctggtggattggctaactttttgaatgctacattctccatgcccaggagaaaggcattagcaggtggagatgctgcccgggtacagaatctccctgccttaaatttaacccttgcccttaagtccagagtcagctcttcctcaggccccatctgagacgcaaacgttgctcctgtatagacgatcatcttgggcagtgagagcaaaaaccttagaaacgagggtctgtgaggtctcttctcacccgttctgcccattgctccctctgaatttgctgccacagccggcagtatgagaacactctgtgtgcgattttgaaatgtgatgcctttggttgaatctgagtaaagtgtcatgttttccagtaatttctctcaaaattaaattgaaaattttgttggaaaattgcttttcgaggaaaatgatccaattcccttatcttgggcctgctgccctcccgaggaagaacgccactttgaaaagctacagggaataattatattttccagctgaatattgaaagaaaaaaaaaaaaacagttgtcattccagacagtagtcaatactcaggagtatactgatagggcttcactcatagccagtcgcagttagggaactgtcttgtagctctgcctaggtttggccatagcggtcttctcatctctctcatctctctgtacaggttttcccatcatatgattcctggtccccctggcccccacacaactggcatccctcatccagctattgtaacacctcaggtcaaacaggagcacccccacacggacagtgacctaatgcacgtgtaagtagagccgaggccacaccccaccccacccccacccccgctccccatttccgatcttgaaattccatgagactctgcctggaagatgctgtcccagagtatagggacttgaatctgagactggaaaagaccaggggatataatatttcatgggcactcaccaggatggaacagggttcttctgcacgcagctgccagggatcttgaactgtagagcccttgccatgccaggactttccctcaggggaacggaaccactggacaagggcagttacccactttgggagtcctctgcagctcagaattcaagggagtggccactggcatgggatcccctagtggctcagcatggattcaaagttttagagccaagctatgataccttgtttgggaagaataagaaatggcgccccagggctggagagatggctcagaggttaagagcactgactgttcttccagaggtcctgagttcaattcccagccaccacatggtggctcacaaaccatctgtaatgagatctgatgccctcgtctggtgtgtctgaaggcagctacagtgtgctcacataaaataaataaatcattgaaagaaagaaggaaagggtgaaagaaagtaggtgtgccccttatttagaaattatgtatgagaaggctgggccaagcagtgttgacaacccaaagaagataaatacgtatgtttagtgagaagggtcaaaatctcattaggtctggggagcatggtcaagaggaaagagcgttgtgttatcctaatgagaacttgagtttggtccctagtggccatgtcaaaaagagccaggggtggtggcccatgcctatcatccctcactaggaagacagagacaagaggaaccccaggatttgctgaccaattnnnnnnnnnnnnnnnnnnnngctttctaaagtttctgaacaaccactactgtatgccaactgaggctcaacacccaaggttggctcccccccaccacacacacacacacacacacaggagcttactttgcaaagtgtcccttaagtgagcccccattgcaccagaagaggaatgaccgcccagagtttgtgcctagcttctttgggggtgaccaagggcctcatctttggggccctaaatggagcttcctcagagtgaaggaacccgactccagtgtcactgtggaaatgaaggggttcagttgtttgcaactttgggttttcatcgggtgagccacaggctcttctttcgaggttgatgctgtcccaggggcttccagagagccaggagggtcagcctcacacggaatctggcaatgcctacagatcttctcttccccctctcttcccacctcctcctgcccctttccctaactgccaccaccttttaggaagcctcaacacgaacagagaaaggagcaggagcccaaaagacctcatattaagaagcctctgaatgctttcatgttatatatgaaagaaatgagagcgaatgtcgtagctgagtgcacgctaaaggagagtgcagctatcaaccagatcctgggcagaagagtaagtaacggtgcgcacgtaataacgatgcgcggatgatgttgatggctgccatagaatggcttcttaaaatatgctgagacttagttatttgtcatgtgtgtgtgtgtatgtgtgagtgcgtgtgtgttgtgtgcccacttgtacgtatacctgaatgcatgattatcaagaaagtggtacccaagatacaatggtagtgtgctgtaaacaatgttgactctgcttggaacaaaaactttctggaactgatcactgcgacatttgaaactgtatttatcaagtatttatttgtctgtcgtgatgttggtaacagtcgctgaataaaacagccaactttaccttcctggagtatgatgttttgtgagcagatatagacactagcaccctccccccaagttacctaataaagtgttcattaatcccgtgggtgtaattagcaaggtgacataagaaagaacagcaggggccagcagaggaacctctgaggacattgcacttattataagactagtagccgttagttgtgtggatttccacaattggggtagtggaggggggggtgaagattgggagagggctctctaaacccaaaatacagcagggcttccgggagaccagcccagaggagagaggaagccacaccttcccaggcagaaccagagctgtcgagctctgagattctaagaacattctaagcgtagagagaattgtgtgttaggttgtatcaagtaacgaggagtcagacttctggagatgcactctacagcttaaagtccacatgagctggttctggggtttcttcttcccttgcatccttcctttaacccgtgttgttatctttacgtagctcttgtctgtcatacatgggagtcccagactctaaccaggctgtgggaactctgaaaatgccctctccgacagctatccaaacggctagccgttccttccacgtgctttcccgcaggactgaagtggtcttagtttggtatctgtaaagctgtaaagtgaactcaaaggttacatttttactgacgctgcactacattttatgaagaatgcggccggacgtggtagtgcacgcctttaatcccagcagaggcaggaggatttctgagttcgaggccaagcctggtctacaaagagagttccaggacagccagggctacacagagaaaccctgtctcaaaaaaacaaacaaacagaaaaagaatgcatcatctttacgcaccagtgctcacccagtgtgtgtgacagcttcttagtttgtgacctctgtatatgggttttggcttttgtttttctgtttctttttgtaagttcagaggaggccctacccacccttgggaagcgtagagaggattgtgtgttaggttgtatcaggtaacgctcagtacaccagaacattcagaagacgaggcctgcagccagcacagaatacagaagcaggccttgagtcatcgattcccactgcagcgcctcagcccgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaggcgcagggacagaattatagtctttggtgttccgagtgtgatgtcctatctccctatggattcttaaacacttaataatgataattacagtgattcccaagccagatctcagcagaggggcgagtccatcagctctgaagggctctaatgttaaaaagcccaaaggctggtgaccactttctctgactctgtgggagagagcagaggcaaagaggggtgggcgctttttcttttttttttaatttcagttcgaatacctctcttagctcttttcctctttttgtctttgagtcagatgccccctggccctgcagcaggaattattttcctgctcaagagggtgaggatgtgatctttgaggtacgcttcctatttttaatgcacatttccaacaattgctactttctcggctccctgaacggtccccagatccaagcatgtgtgtttgaaaggatggttctcatttgggggtctctctctgtctttgatttagacacctgtttctatttataggcctctgggtctttgattaagatcaggttttctgtcctttgagcactcccctctggcggagccctgcttactggctctttaaagttctggctttaaaaatcatgaagttttacaccagcgtgattagactgcttaaaagtggatcttaaatccatcccggaacattttatcttttgatttttttttttaattcatctttactgtctctagaattgaaatgcccagccatgtgaatgaatcaaaattttcttaatatacatcataaatagcaatggcataaatcttattttaaaataaactgactcactgggctattgccagaggtctgtttacagcttgatcgttagaatgtcttagcagtctcttaaaagtaaacaaatgtttccccctacaacttgacaattcttaataataaaatttgattttttttaaaagtatatttttcaataatcaaagagttagaaaaatgttttcttagtcttagtttctttctgtgtttcagaaacccctgaaataaagggccatctctctagttcttaaaacatgtttgtcttcaatgcgaaactccggtacagttggggaacctaccgagtcagtgtgctaaatgacctgggctggagggcccgagctggtgctttgtgcattcgggattatcagggacccaagtcactgtaagcaccagtggcctgcgtcttctttccttattgtttgcctgaagcgtacatagtggccgtttggagagaagatgcaacttcgatttgcatttttaggagttaatttctatttcattctagatgatttttccctcagcttatgcctccatacactatagataattaggccaacatcttgctgttgtcaatggtgatacagggcaaaggattggtcagatgagtagagggacagatggcagtcttcttatctgagtctcttgacttcttcctctcttcacacagcttagtgacattttgcattttggtattcatacttatttatcagaagagtgagtaaatatcaatgaccaatgatttgtgtgtgtgtgtatacatatctacttgtacatgtgtatgtatatgtgtatgtgtgtatatatatatgtatatatttatatatatatagtgtgtgtgtgtgtgtgtgtgtgtgtgtgtgtgtgtgtatagtgttcagtttgttgagggtctccagtgataggctgcatctcttgaagaaagcaaccttgctttctggccagaatagccactggtacccacgcatgcctctccttcatttccattggtattattataattataataattattattatttcataaccaaagtgtattgctatgggtgagatggcttagcaggtaaaggtttgccaccaggcctgatgacctaagtttgatcctgggaacctcatgatggaagaagaaaacagttcacataaattgtctttaaactgccatatgtgtgctgtggtatatgtgcctacacacacacacacacacacacacacacacacacacacacacacattaaataaataaataaatataataaaaccattttttaaagatgtatttatttattatatgtaagtacactgtagatatcatcagacactccagaagagggagtcagatttcgttatggatggttgtgagccaccatgtggttgctgggattcgaactctggaccttcagaagagcagtcgggtgcttttaaccactgagccatctcaccagccccataaaaccattttttaaagtgtatcacctgccttgcctttctgctcacatcaaggcacccgtgtgtcctgagcgttgactttaccctgtgcacttctaatacaattccaaacaaacatggctcctgatccagcccagaggctgggtttaaggggatttcaaaacatgtgggcgtggctgcctggccagtgggctctgctggcttggcaggaagatgccaggagtcctgtgaggtggctccctgcttctcctgtcagatttgccagagcaacgggcatccctgtttcctgcagaaaagatgctgagccagatcctcacgtccaaagccacactggcgggagcttgttctctcagcagctttccccttccgccctctcctcaagcacccacacccctctttttctttccttttccttttttacgtcattggtgatagggggtggtggtggtggtggagtggggtgggcgaggggaggcactggaattgggaattggaatcagtgagtgggacagcttggtacagacagcagaaggcagaggctcccagctacctgagagacgttttggggggaaggattcttcttactcctgcagctacatcatcttagtgagtgtggtcacctcccagttaggcagcgcccacatctccatggagatttggggaaaatactaggaaaccatctgctggagacccaggcaaatgttttacatatatttgcaaaattaaaaaaaaaaaaaaaaccaacataagatataaagtcctcaaattcccaaatggatgccttgcccccagaataacaattttgttacttggtggttacattaaaaaggggagagaagggctggtgagatggctcagtgggtaagagcacccgacagctcttccgaaggtccagagttcaaatcccagcaaccacatggtggctcacaaccatccataacgagatctgactccctcttctggagtgtctgaagacagctacaatgtacttacatataataaataaataaatcttaaaaaaaaaaaaaaggcgagagaagggactcgaagaatgtcccgcagctatgtgtcctctatcagaaaccccagtttcttgacaaacaaattaagatgttgcttcttgttccctactggccggaagctcaccacagtcagagtgttatcagtattctgtacgtgtggacgtgtgtctaagtgtgaggagatgggctggcttctgatgtcatacctgtttgggttacaagattcgggttccagagttcacgtgacagggtctggagagagtctgggtgagaaggaggcatgattgtcctaaaaggaatctggaaatgaacacattttgcataaataagtgttgtttggcctcagttatccgtgtaaaactccaggcaaccaaagtagaacactggatatcaggggtcacctgtgagaagactttgggttttttttcctgtttatactggcaaaaaggaagggtgggtgacaggtctttgtactctgactgctttgatgcgttgcacgtgatacaggaccacgaggcagagaaaccaaaatgtaagtttcaccccagcctccagactgcctggtgtctgcagcaccagggcgctccccgttagccggcagccatcctttaactgcttccagtaaacccatccattcttggagtgtgaagcgtgaggtgccttgctgccgcctcgcttacctgttctctctccccgtttccttttccgtttcagtggcacgccctctcccgggaagagcaggccaaatactatgaactagcacggaaagagagacagctacacatgcagctttatccaggctggtcagcgcgagacaattatgtaagagtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtaaaagcaagattaattattaaataatcaccactaaatcttgccacctctttgttttctgtgtgtctttagtttcatatataggtaaaatataagtgcatgtgtgtgcttgtatatacatgtcctttatcacctgtttcctattctctgaaaatgtatttttttttcctctgaagtgatatttaggaccctattctactaagtgaatgtctgtctcagtttctcggtttctcctgattttagatttttgggtttttttttcctccccttcagaaacacataatccaccctgcattgaatatttctgtgcagaataaagggttttcgctggtaccatcatttctgcaggatagatttatagtaccaggatgttaagaaaataaagcaatttaaagttcttggtacatgttgtcaggtttgtttccaagtgacaaatgctttagaaatcttgccccatgtcttggtgactgttttgaaacagttttaggactacttggggtttttttgttttgttttgttttgtttttgttttttaatctcacattctatgttcttcttcgactgaaaacagagtagggattgtcatgttctaggatatactagtcttatcgtcaagaactctcttgcttatgttgcccgctctcttactggagagcttgaatatctggcattgtctttaactctatattaagaatggcatatctaaaaccgggcgtggtggcgcatgcctttaatcccagaactcgggaggcagaggcaggaggatttctgagttcgaggccagcctggtctacaaagtgagttccaggacagccaagactacacagagaaaccctgtctcggggtggggggaaaacaaaaacaagaatggcatatctaaaactctgtcatttttatataaagtgacaattttgatcgtttagattcttaatagaataatttgaaaatcattctgagacagctacaacaggtgccttatgacagcaaaaacttactgctcgctcttctagaggttgagctatctgaaaccaagggcacccaacaggttggctgtgttcccaccaggctgtgcttacccaaccaaggacaagccttattcatagggtcccacctcccaaaggttccaccttattccagtacactcgggggggtggtggtggctggaggtgttatgatttcaatgtggaagtgtgaaggggagacattggtctcataggagactagacgcaggaatatcactcaggcccatcttgatttagagcaattgtcccttcaacagcacatgtgaaaccatgaaccagtgcacagtttattgatggcctttgctgtaggagcttcagttcctacagagacaatgacaatttgtgtctgaggtcacatggcccataacagccattacagcatttggacacataggcatctttctgagaatgggttaaacattgtttcctcctctatacaatatatactctacactagagtatactcccctggaaatgccactttactgtccagcatttggagcgtgtgcagcaaatatgactttgacagagtcctgtgggcagctcccgcgctgttattttggttgctttaataactgccacatgctgactgtagggagtgctttccactctctctgccactttctaatccttaggactgggcagccagtgtgtgaggtcagggaggttaggtcatttgtccccggccgtggagtaggtcgctacactgcaatttaaatccacataatacgaatttgaggatctgcacggcttctctcctggggctcagctccatgtctactggcttctgttccctgagcagtaattaccatgtgcttgccctgagcctttgccacgcccttgtaaggggggggggtagctcagtccctcctaaaggggtgcacagtgtcctcctcttctcagccctttggctgtggtttcttccctgggaggggacctgacctttatcccctgacccgtgcacaagctttgccaagttgtgcctttatacacacttaacattgcttgccgaatgtcttgaaagtttgaagtttacttctattatttgggctaacaaaggaagtttttgtgaagcaacagttcatagattttcttgggaggatatcctgcctcccaagataatacagtccatgtcgttttgacattttatttttttaaatcttgcgtgaattagtcgatcaatatatccaaactggtccctctttgctgtaaattcgatataggttctctctcctcactgacttatgcataaaataccatgccgctgtagcaacagagcgagcgctacttgctggctgtgtgcaaggtgtggagggtggagagaggctcagggcagggctcagggtgcagctggtgggccatggccctgagcccaggctcaggaaggaatcagctgggcagaagagccccagatctatgcaaggaagaggagaacaagacatgggacccgtgcaaaggggagcccagtgaggcaagggcagaaggttctaacgtgaaacagccccacgggaacagcaggaaacctctctgaatgaaggaccctgttggctacaggaggcatgttcttctgtttgccttctcctaacacctctgctcacattaaagatggtttttgatggtcgctgagctaggctgtttgccttagtgtttaggaagaaggtgtcagttaactttctaaaccgttaaggcctcattcagtcaccgtgtgactggagagaaacactgctctgaggcacataaatatatctgtgcttttctagagccacagggcttactcagtaaactctgagaggctgatttttattttgtccatgttgcttattgctgccattacttcagaggaatgttctgtgagtcagtagaaaatacctgtcgcaggctaacctcttgtgatccgtgagagtgggctctggttgtggccaaatggaagtgcttttcaaggtgaaagaaagaaaaggggagagagagagagaaagaggcagagagacagagacagtagtttccgaagagaaatgacgatattaagccacttaaaatatgaccaatttttttgtcattgagatgttttcgaaatatacttaaacttgctcctgtatcggcgtggtgtcccgtctgaagaaacagcaaccccagtttcccaggttctactccctcctctgtctttttcttgcttacgacaccgcatttccgccacagggtgctgggcactcggctgacaccacagacataaaatatagcgcagtgtatttctcagcaggcttcgtgcttggcaccagtggaggtgggttctgagcatggcagtcaggaagaggagtccccaaggaggcagggacacaggagccacacacatgcacttgcagagtccgtacagacaggaaagggcgagccagtgactctccctgtctctctggctggccacctcgttctgtctgtgcgtcctgtccatacagcacacacctgcacccccaccgtccgccctctctgacttgacttgtgcctctgtccttccagggcaagaagaagaagaggaagagagagaagctacaggagtcgacttcaggtaggtgtcccacggccctctgttgacgcgcctgcttcttgccgactccttgtaaacagtccgcatcttcctagacgctgctgcattctgtgactgtcacatgtgatccctaactcggctttcttcctttcctgagatgccttaacgtttcaaaaagacttttcttttcagtgtgaatgtgcctgtagagactcctttcccatccctgtgccccagagccatagttacgaggagtggttgattttttttttctcccttcttgttgtctgtcttctctttgcttctgcctctgctgtttgcacagtccttaagaatgccacttctacggtgacagtacaacatgctaccttgcattcccttgagcatctctcatgtgtctggggtttttaatactaaaggacaagtggggcttgtctcacactgatggcaggagtcagcgagggcccatgtcggtcctgttccctgtccgttaaagggccaccacacgcactgcacaacacacagacagggccgccatgagaacccaaagggcaaagcgagcaggtctacatggtgttatagctactacatatttggaatgtacagaaacctctccataaacatttcttaaagacacaattttctgcaggtacaggtcccagaatgacagctgcctacatctgaaacatggtaagatcaactctctcggcccctgctgctgacttagctcttaacgaggcgcttgcttgcggatctcctcgctctcaccagttccgctcagcatggttcccaaaaagaggaaaaggccacccaagtcagtctagtgcggatgacccagtcgctcgtgggtttttaccccagctgtgtgtttccgacgcagtgtgccttcacgtctattatgcctttattttatatatatacatattgctatttctctgttctcttgccctcaatattattttcgcagctatttcttactgaccagtggaaaaaaatcaacctttaaaaaatgtatatataggaagcagcctgacatcccccacctgcagtggggatgagtctgagggtcacctttgaacccgtctctgtcctggtacatggtaaagactcggttgagatgatgtgtgggcagtgtgtttgtaaggagggagatttgtgggtttatcattttctttctattttaaaatatcttctactgagtgttttcctttatgggtaatcattgctagaccttaccaaaggacctgtaagtcaaacctgatttgttcatttttatgctaagtctttaatgttgatccacatgacccaggaaactggcttcctaggtaaattctgggtcttaagtttgaattgacagggtgtatccattctcgaccacagttgccaatgtatctgctgtgttctttctctagaaccctgtgcagagtcacccagccctgcagggcttcctttgggtcctctttacctcttgccttcctcgaccgccagcccctagtcccttactgcattgctattattgtagctgttaggaatgtgttatggccacagattttacttctacagtttatccattttgctctcggagggatttttccgaaacaccaatgaatgatgtctcttctctactcaaggccagccagttcttactgcctgaagggtacagtcgcatctcctaggtgagatctgccactgccctatcgtgtgtctgtgcctcgggtcagttgttcaaggtttcttctcacttccaaactgacccatgtgagctctgtccagataaaattagcagttgcacaaatagatggagagcaccacctacgatggtccctgtgcttggaaggcctgctctctctacttacgaacacaccaacctgggcagcatcccttagaatggcctgcagtacggatggatgctctgggccaagccagggaaccccatcccagcttgagaatttacttagggtcctgaactttcaaatgatgtttccctatggaaatctcccagggtactggcaccaagtagatttaaatttccagtcgactacctgggccctctagtcagcttcttagtctggtctcctcatctggaatgcataacttgtctttagccaataggaactcagaaaggcccctccctcctcccagaaccctgctgcttactctcttgagaaactttcttttctttttctttttctttttctttttctttctttttttttttttttttttttttttttttttgagaaactttcttgatcttcattctgacttaccaggtttccaaatccccagctggtaccacagttgctctatccaaacctaacctcactgatttagcctaaggctcgatggcttcttccatggaccacctcttgacatcagtggcatcacacccaaacgtaacacagtcacagatgatggctacctaactgagtggctactaataacggtcttctgagccagccacctaggtttgttctttagttcacaggggatgattcggttataatcccagccccaggatacatctggcttcatagatgaacaacctagaaagaagcttgcatatacacaccttgtattgtttctgttcgtttcttggtttcatctctttaagacagggtctcatgtagcacaggcagacctccaactcacttatgtagccaaggttgaccttgaactttgatcctcctgcctccaccatctgagtgctgggattaccggcatgtaccaccacccgtggtttgctggcactggagaccacgcctgttttataaatgtgatcttttcattgctgatcgcttaggaatagtttaccccacctttgcatgtccagccatgacggagaaggccctcggaagtacagtgtgcccagggccagctctcagtcatggactaaatgcagcttttgcttcaacagttttagagctacctatttcgtgtgaaatgcactgcagtacttaagagttggaacttgatttaatacctttcatgattatatatgtaatcatgatttcatatgtatgtatgtatatattatatacttgatatatttgatataaaagctgagtttgatacaaaatgtttgatgtaaaatctgcttatttttttgtcttaaaatgcacttcagctgcctgtttctttaataagtcacagaaatctttgagattctcgccactaatttttttttcctgaaggttaaggagtcttctttgaatatactacaacaaaacaaaaccttcccctgtcccccaattctccttgagcccccagctgctgccccccattgccctagagcccccagctgctgctccccccattgttcttgagcccctggctgctgtcccccattgtccttgagcccccagtcgctgtcccccattgtcctcgagcccccagctgttgccccccccattgtcctcgagtccccagctgctgggtgaagcctggcttgctgcacttactgcttaaagccactagtatcgtgcccccccccccccctctctctctctctctctctctctctctctctctctctctctctctctctctctcgtttcctggatgggccacatggtctttgaagtcaccactcacacaccaccaccaccaccaccacagtcttgtgcagagaaaacctgggagttacgagatatgtgcagagcatagaggaacccaggcggccatccagaaagagtccagtgaattagtgatgacagaatgcttgctttccacacctctcttcttcctttgctgtaagaactcctgcaccggggcttgccagccactagtgcttattaagacctggagatgctgcatcgaatgggacagagagggaccccactgtcatgtgctacctgtgccactggagggtgtttgacaaaggagtcttgccaagaaatctaatgctgcaataaaaataaaagattcttggcagccagcagtagtatgcacgcctttaataccagcacttgggaggcagaggcaggtcagcctggactacagagtgagtttcagaacagccagggctacacagagaaaccctgactctaacccgccccacccccaccccccaaaaaaaggttcttggccctcaagacctcaagaaagtactctgccatggaggagggccctgtgacagtcatctgtagtcccttctggaagagctgcagcagagagccccaggactggtctacccaggtctcacagtctctggtcttgggtctgcatggggtgagagagtagggagagaaaccggggcctctaattaattcatctaacttctgatctgcaccgcctcgtggtgctgccacagggacccttttgtctcccttccctaacgtgccaccgcccagactgcttctgtgtgacagtcaattgcctgtgtggttcttcacttcctgtgcagatcccctccgaggcctcttcccctccccagagtggttttctggcgcccacaagtactcagaactactactgattacgtgggtttggtttctcccatggtgtaggaaggtcctgtcttgcctgagccgatctcacctcagaagcaagcccaggacagacagatggagcacttgattagaacctactcgctttgtagagccgcggttctcaacctgtgggtcacggcccctttggcaaacctctgtctccaaaaatatttacgctaccattcacaacaggagcaaaactacagttaggaagtagcggtggaaataattttatgggtgggggtcaccacagtgtgagggaactgtattcaagggccacagcatcagcaaggttgagaagcaccgctctaaagagaggtgaaatcaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtcttttccttctttttttctaaacttttaatttttcaaaaaaaatgtttgagttaactttttggattactacataaaatagtgaatgttgtcagggaattttcttttttaaaatgtttgcattttttcttgttaaattagcctacaaagtagcgggtttccataaagaattttaatatttcattttcgttgttgcccccgccccaccactactacagcattttgatatacatgtgcctgctttgttctggtttgcttcttgccccctccccccaatacctcctctctccttcctccccaggtcgtttttcttctccactttcacgctatttacacaacttctaccttccacatttgagagaaaactcattgttttgtctgggtctggattattttgcctaaacataaccaccccaggtttattccactttttctacaaatgactcaatttcaatattctttatagctaaatagtactccactgggtacatctgtttatctaattcatttgttgccaagcccttgggctgcttctggccattgtgaacatacactctagaatcatggatgtggggggcatgtctgtggtatgtctgggtgtgcactcagaagccaggctatacagtctgtcaacctttagggttgtttttgtttttatttttccagacagggtttctctgtatagtcctggcggtcctggaactcactctgtagaccaggctggtctcgaactcagaaatccacctgtctctgcctctgcctcctaagtgctgggattaaaggcgtgcgccaccactgcctggctctacctttagtttttttggaaatcaacatatattgacctctggatggtcacactgacttactttcctaccagcagtatgcaaaagttcctatcccccatggatgtgccatgactagtgtgtgttctgtgtactgtggccattctgacctggctgagatagattctcagtgtactcttaacttgcatttcctggatagctaagatgttggacattttctttctttctttctttctttctttctttctttctttctttctttctttctttgtttctttctttttaaaaaaagatttattttttatatgtaagtacactgtagctgtcttcagacacaccagaagagggagtcagatctcattacggatggttgtgagccaccatgtggttgctgggatttgaactcaggatctttggaagagcagtcgggtgctcttacctgctgagccatctcaccagcctggacattttctcaaaagtatctgttcatataatttacccatgagtgaaatgtgttgcttgcttctttgttgttgttgttgtgtctttgaggggttttgtttgttttcaagtcacttttaaaatttgtccacgaagtggggtggtggttgttgtgtgtatgagtgcagtgcccagggataccagaagagggcgctgagtccctttagcaggagttagagccagatgtgcgccacctcatgtggatgccgaaaacccaactcagagcctcttaacctaccgtgcccctcacaggaccccagagggcttctttgtttttaatatattgtagatgttaacccctctcaggttagtagttggcaaggattttttttttcttcggcgtgcaggtcacctcctttgctaaagctttcttaattcaacgaaatacggtgtacagttcttttctctctgtatcctgcaggcctgttctgagatcagtgcttgtggcaatctctttatgtttgcctttagtagtttcaaagtttcaggccttacatagaataggactttggtggcaagtttcaacctttgaggtgtgcgtattcagttttccctcccccattgcttaaagtagttgtcattccttcaacatatgtctatggaatctttgtcaagactccgttgtctgtggattcatgggtttgtttctgcctctcttccattccattggtcggttctaacgtagactgtttcattaaattcctgttaagcgagactgatctttcgagttcacacctctgaaaatacagctctgatgctataaaaggctctttaaacactgtgcctccactccttaaaatgcatgaattatattttatgcttccatgttttgggggtgggttggaggttgggggttgttccctgtgtggcctcttcaagccacatgtagaagttggagaggagacggtgaaccgaccaaaatgactatgtgtgagaattccatatgcaaattcactctgaaacagctgttgatcagctgttgtccagactggaaacagggtcagtgaaagcaattcctgagggttcttctgtgcaagccaaatgcagatcctgtcctgttttggactcaccgtcctttatcaggaagctgagagagcccagggcctcgggaaggggactgtaccactcctttctgtctgcgagaaggccagtgtctgtcacaggcacttgtgatgtatcctgcaagccacctgtaagggtgactcccgcagggtaaggactgtgcctggggagggggctacttggtgagcgagacctcatactggaaaccccttcccagaggggtttccagtatgagaagctgtaggctcaagatggctaactataaacgaatatgactagtgctgtgagttagcatgttagataaaaatgaagagtctgtcaaataaatcggtaaatctgagcaggttcctggcagtgtcctagtgctgcctcttgggctggggaagggcagggagctcccttcattttcctgggagtttctagggctttgatgtgggtttgatttggaacctacaacacctcaaccgcttgtcggtagtcagacattattatgaaagacctgacttttctctcttcctggttcagtcaagatgggtgagaaagtgagcataggatcagaatttgtgaaacatcgggaaaattgatcactcgagttcattcattaaaaaccaaccctgtgaacaagtttattagtgtttggtgtagtataacaaaccccagagccaaaattttccagacacacggtttggatgtagtgtctctctgattatatagtatccccaaactaatttaaaagtagaagcaagatacttttagcagcggaaaactcctctggctaaaggcacagaagttcacctgaagatagatgcagatgcgcacgcagccccctcacacccaccccacccccatttggctctgacttagtctttatctcagagacttgctaactaaatgaaggagtgtgtttatcactaagtagaaccttcagccttcactgccctggggccaggagctgtgtgggagaagtaattgcaagtactgtacaggctacaggagttaattgcgcagtgctttggatttatgttgggggaaaaaaaaaaaaccatgtttctggcttctgtttgatgatggcatttaaaggctcagggctcctgggtcctgtgattcctcccacagaac

SEQ ID NO: 20 - DNA, 1850 bp, Mus musculus
gccagccaccgccgattcccagcgctcatcatcacaaactttattcttggcaaacttctctttttctcccctcctcctccgcccctccccctccagcagattaaatgctcctccagaaggaaaaccgaagcgaaagggaaggaaagaagctctaacgcggacgtctgcagcccggtggctctttattgtttactctgaaggaagtggacttttcggtattttctgattcttctcgtacctccgctggggcaaagggagcctcttggcccagctctcctcttctcaaaaacaaaacaaaacaaaaccccaaatcaccgaaatcagcatccgaggaatccgtggagaggttttgcacggtgacgcaccacgggaccctcgtttgcactttggcaagtcgtgtcccctccggaaccggtgtcctcgaagcacagaccccagcaacgagtgcggcgtggggtggccacccagccctggcagcctagcctagtgcacgcggagcggcgtagacgctctcagaggcgccggcggctgccgccctcgcagtctggtgcccttcgccccagggccgggcgccggcgtccttctaagtgggaaagcgcggcaatcgcagaggctcctgcagctgctccagccgtgggcccctcgcttgcccacccggcttccattcacagtcctcccgcactcagtcttccaactcccccacctcacatcgaccctcccttcttgctgtctcggagtgctcccgcagcggagcggagattacacagccgccgggatgccccaactttccggaggaggcggcgggggggacccggaactctgcgccaccgatgagatgatccccttcaaggacgaaggcgatccccagaaggagaagatcttcgccgagatcagtcatcccgaagaggagggcgacttagccgacatcaagtcatctttggttaacgagtccgaaatcatcccagccagcaacgggcatgaggtggtcagacaagccccgtcctctcaggagccctaccacgacaaggccagagaacaccctgatgaaggaaagcatccagacggaggcctgtacaacaagggaccctcctactccagttactctggctacataatgatgcccaatatgaacagcgacccgtacatgtcaaatgggtccctttctccacccatcccgaggacatcaaataaagtgcccgtggtgcagccctctcacgcggtccacccgctcacccccctcatcacctacagcgacgagcacttttctccgggatcccacccgtcacacatcccgtcagatgtcaactccaagcaaggcatgtccagacaccctccagctcctgaaatccccaccttctaccccctgtctccgggcggcgttggacagatcaccccacccattggctggttttcccatcatatgattcctggtccccctggcccccacacaactggcatccctcatccagctattgtaacacctcaggtcaaacaggagcacccccacacggacagtgacctaatgcacgtgaagcctcaacacgaacagagaaaggagcaggagcccaaaagacctcatattaagaagcctctgaatgctttcatgttatatatgaaagaaatgagagcgaatgtcgtagctgagtgcacgctaaaggagagtgcagctatcaaccagatcctgggcagaagatggcacgccctctcccgggaagagcaggccaaatactatgaactagcacggaaagagagacagctacacatgcagctttatccaggctggtcagcgcgagacaattatggcaagaagaagaagaggaagagagagaagctacaggagtcgacttcag

SEQ ID NO: 21 - protein, 455 aa, Mus musculus
  VARIANT (1)...(455): Xaa = Any Amino Acid
CTRSGVDALRGAGGCRPRSLVPFAPGPGAGVLLSGKARQSQRLLQLLQPWAPRLPTRLPFTVLPHSVFQLPHLTSTLPSCCLGVLPQRSGDYTAAGMPQLSGGGGGGDPELCATDEMIPFKDEGDPQKEKIFAEISHPEEEGDLADIKSSLVNESEIIPASNGHEVVRQAPSSQEPYHDKAREHPDEGKHPDGGLYNKGPSYSSYSGYIMMPNMNSDPYMSNGSLSPPIPRTSNKVPVVQPSHAVHPLTPLITYSDEHFSPGSHPSHIPSDVNSKQGMSRHPPAPEIPTFYPLSPGGVGQITPPIGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESTSX

SEQ ID NO: 22 - DNA, 141463 bp, Homo sapiens
tatgatattctttgatacatttttgatcaactactgttttgagggaaatgtgtaaggcaatatgggggttacaaagatgaatctgacaaaaacttgtcattaaacagttgactgactgcatacagtagcctctagccacactcaagcactcaaaaggtggccagttagaactgaatcgtgctgtaagttgctgggcgcggtggctcacgcctgtaatcccagcactttgggaggccgaggcaggcagatcacgaggtcaggagatcgagaccatcctggctaacatggtgaaaccccatctctattaaaaatacaacaacaacaacaacaaaaaagccgggcgtggtggcgggcgcctgtagtcccagctactcgggaggctgaggcaggaaaatggcgtgaacccaggaggtggagcttgcagtgagccgagatcgtgccactgcactccagcctgggcacagagcaagactccgtctcaaaagacaaaaaagaaaaaaaaaagaactgaatcttgctgtaagtaaactgcactgaatttcaaagacttaatatgaaaaaagaatgtaaaatctttcattagtaagttttcataatgattatatattaaaatggtaataatttcaacatttgggttaaataaaatgtattattaaaattaatttaatctgtttctagctttttaaaattacatatgtgacttgcattatatttcatttggcagtgctgatctgcataattacagttatcacctactgagtgtatctactgtatgccaggtaattttataacaattatttgtaatcttccataagggaagtattccagataagaaacctgaggttgtcaaaggcatgttaatttattcttctacacaccttgctagtatattttctatgcaccaagagctgccacaggaagtaaggataaaacaaagcaaagtccctaccctcatggaacttatgaaccagtgggaaagaaagctaattagtaagtaagtataaaaaataggccaagcagtgacagtaaaagaagatgaagtccataaaaaaaatggagagtgaccggaattggagtgaaggcagaaggtttggggggatggctattttttaagataacaagctctaaggagggactatctgagcagaacctgaatgaagtcagggagtgagccctgtgaacatctacctggccaggagcttctgggcagaggcaacaaggactgaggtgtatagtgtgtgtgtgtgtgtgtgcatgtgtgtgtgtgtgtgtgtgtgtgtgtacacgtgcgtgcatgtgctttgcactctgaaggaacagctggagagccagtggtgctagagagcagtgagcaagaggaagccaggtaacagctcacatagggacttggaagccacaagtaggaaatgttaaaggatgactttggctgctctatgaggcatggactattgtggggcatgcatggaacccagcaagaacggatgccagagcactttgagaggtcaaggtgggtggattgcttgaggtcaggagttcaagaccagcctggccaacacagcaaaaccctgtctctactaaaaatacaaaaagccaactgtggtggtgcacacctgtagttccaactacttgggaggctgaggcacgagaatcacttgaacctgggagccgagttcacaccactgcactccagcctgggcgatagtgggagactgtctcggaaaaaaaaaagaatgaaagccagagactcattaggaggcaactgcaaaggtgcaggacagggagggctaacagtgagagagttagagcttcaacaaggtctgtcttactcagccactgtgagatacaaagcaaaacaatgtaaaaaattatcctagtaatttgaactgcaaaaatcaaatatctcggtaattcaaatgaatctcaaaatatatttgggagtctggggttatcagaactggcagtcaaaaattaccgtctaacctcataggatagtagtttatctctgtcctttgctttctgccaatttaacctaagggaagtggacttgagatctgttaattggcagagcgggactgcaggacctttaagtcaaattcagatgaggcaaattagctttattttggccaaagaaaagtgtttggtggagccagatgacaattttgtagcctaaactatttgcactggctgtctctaccatctgaattcactcccatcgttgttaattctgagtttaagcgtagccatacaagcaagacaaagctaaggaaggaactagaaattggctgtgtcttggataaatgtatatatgagtacaggtaacctcactcaaggagtctgtttttatggacagaagtgctttaaaacagaaagcatcctcaaggtcaaatgtcatacaggccaagttcttcctctgagaggtaaataaggatttaaagcagttacccagtttcaaatgaaaacaaatacaaaccattcccaaggacactcaaaagtcatgtcatgagaaaaaggaggctcaatcctgatgctctaggttggtttatttactttgatggaactcactggaaaattcttcaactccacgcttcactgtgcctgtgtaggatgtgttttctgggcattggatgtagatcttgtcaatcaggtactttcctggagcactaaaatgtacagattacacacatcaaaggcaggctgcaaccactgtagctgaaatttacacaaaatctatgcggctagtaactggataaacaatgagactaacgaccttgttctgcattaatctccctatggctcagttggtactgcaagaaggttgtggctttggcttctagcctcaaaccaggcattacgtgcttgcccaatgccaacagagcccaggaagcctgagaatatagccccagtccatccattttatgaggtacatttaccacaattcaagaaacacatccattaccatatccacccaggaaagagatttataaaaataagtaaattccttggccctgcctcccctttcagggagtttattttcttatagaaggcctcaggttttccttaagtgttttcagggtttctccattgccccccaaaagcaagatagaatccttgaactatcttcctcttttggccaagaataaatttcaaaaaggctgcatctgtaaagaaaagagaaaggaagaattgaagttgaccagtgaacttgatcagcatccacttttaatttaggacatttgggaaaaggtacattgaaaatagaaggtgcttggccgggcgcggtggctcacacctgtaatcccagcactttgggaggccgaggtgggcggatcacctgaggtttgaaatttgagaccagcctggccaatacggcgaaaccccgtctctactaaaattacaaaaattagccgggcatggtggcaagtgcctataatcccagctacttgggaggctgaggcaggagaatcgcttgaacctggaaggtggtggttgcagtgagcccagatcatgccactgcactcccgcctgggcgacaaagtgagactccttctcaaaaaaaaaaaaaaaagaaaaaagaaaatagaaggtgctttctaagtgccaattaaaattgctatagagtcccttccatacaattggcaaaggctgagggttgcttctggcaggaggcagctgaaggagatggagcatctcaggaggagtctgcaccctgggcagccttgggccatgccaaagggacctaggaaccctggaaccccacccatctcccagccctgctgctttcataactttgtatacaggtcacactgaaaagcttatattggaaaatggctcccaatgagcccaggaaatggctcccttggtggggttaccttaggttagaaaggatcacactgaggtacattcagctaaatgccctatgcactacacctgtggtactcctgtcacttcccagccagccctagcaataatctttactgcattgtaaacttgagatacctctgtctgggatacataatcacagtctattctaaaacatagatttttgtggcactcacacagtcccaagaaacaactcttatatacctttctagtcactctccccacctgtgagtccttacaactgttgttgggggtattttatccacataaacattactgctttctcaagccattatactaagactgttttcagagctgctgtaatgtgtgttaaatgtctcacaagaagatattgttttcagtgttattttcttcattcatttatgaattcattaagagcccaacataaacacgagttaaggcacattcaccctgttctgaaaatgttctctcatcacactcacttgggggtaacaactgcttcagtgattttggtggcctttgtaacacaactgatggaggcgtggagatggtcatagcatggacgcgagagcgtaacactgtccccatttgctcctgtggtaagggtttctagagcttcagaagtttttggttttgcaacttaacaggtccccttaaaaggatcgtctttgcttcatggactaataatacctcacatttgtacatactttcatatgcattatctcacttaatagtacggtattattatatccattttttcagagaggaaacagactctgggagaggttaaaatggcttgcctaaggttaccaatggcatgagagggagtggcagggcccatctccaacccaggatttctgactcttcgtatcacagtatttcaaagctgtctctttcttttagttacttccattaacaacagaagtgaagggacctacagttttttaaccataaaaacacaaaggtttctgactggtgagtggcctctaggaaaagatctctgcagtctatcgacgagagggtttcaaatcacagagatcaactgtgacagtaagtactttgataaaaatactaacattggttttccagaatctaacttctgtgaaagaaaactatacggtgcaccatatcatgtgtagaaaaaaaggaccactatacacaacgaacatatccacacgtgttgtgtcaacgttctcttcccaaatgtggccgcagaagaaagtgcgaagcatgctgaaataagacagtatttacggctaaggaaattcggcttcacataccggtaattatgaacaagatattttccctaataaaattactccaaaacgaaatatagagaaactgtttccctatgttctctttattttataccatgtgctcaagaatggtcacagaaaagagtcaaagggagcagagagagaaagaaagagagctatatagagagccggcctctgctgagggttggttttgctttagaaactggaatgtgtccaggcttgatttttattttcaattcacatttcagatccagctccccaaactctttgatctttctccctgtctccttacccggaagagaacccttggccttctcagctgggagctgggagcacacgtggaaagactggctcagatccatattcttgccaaatttagtcacacaaaggggcctgcgagggaaaaaagaaaggatgaaagcggcagccgccgcgacttcaaaggccgcgccgccgcgcggggccgtgcgcaggcgcctccctcagccgatataaggcacggctcgagcgcgcgagcggcctttccgcgcgcgtccccgacccggggggcgggccgagggacgcggagggccggtgggaaggagggcgaagggttggataccgcggccgtgctacccgccggcttttcgaggccggtccccatgccaagttcaggcgcctgagaaaagtttttcagaaaggagggacaagaatgtcacgtcctgcccacgaaatgagcagtcctgtggcccgcaaaatgactccagctcccacctccattctagctccgttctaggcattccccgtgcgtgggagcctgggttcccgtcacggagcgcagccgagcgaggagggcgcgtggccgggccctgtctggctccttcggctcccctgtgcccgccttgcgttcctggttcccgtgcgctctcctaccggcgcgattcctctcccccttgggcagccttaggacgtgtgccctcgcctcccagctggcagaagggcggcctgcagagcggggtgggatgcgccccttccccgcgggccgcaggaggaggcggccctgtggacagccgcgccccggacccccacccagcgaggcagggacgcagggctcggcctgcactggcccagcgctgggaaagccgcaggagggcgcgaggggtggcggaccccgctcgctggagccccgcgtggctgcgccgagctacagacgccaacgggcgccggccccgcggaagtccgacgtccgcaggcggccggatttgggaacgactttttcacggtcccacgagttccctgataccccggagggtggggggttgagtttgtttgtctttaggaggcggcaagaagaaggggaagaacccctgggacacaaactgccatttccctcgccccccttctctccttttccgcgaagtccgttaaactgaagatgcccacagctttcgtctccgggtgaagccggggtgggaaatagagggggtcggggttccgcctctggagtcacattattcgttttctagcccttctccctggctcctgggtatcctcttccgtaggccccgccacctccttccttttggatcccaccaaagtcgtagctgggagagagtccaggccacacaaaggggaagacctggagcctgggcgggggttaggaccgagggggcggagaggactcgaggggcaccgtgcttttctctcgtccttgtaattaaggactcactggactgtctgtagccgactcgagttggcagcaaaatcgccggggggaggggttttctggtgtgagtgggggtcactaccctgtctctcctgcccgctcccgagcggggctgggctccgcttacccagtgagcagcgaggccgtctcttctcccccgctcctctgttcttgtgcggggtgggcgcctcgccccccacgcgcagttgaggcgacggcgcccgatgtagaaggaagtgttgatataaaacaagtttgttcccaaactaaacccaaaccaagcaaagccaccaggaggggaaaaaccaacagcaatccagccagcccctagcaattgttttcacggtcggaattaaatcacatcaaaacgccccctgaaacccacatcctgaaggagtgaacctacaacagccaacctccagtcgttcgctcgagttcacacgaacaacttgcctctaacatccgagtgaagggggcggcgggtgcctctcccgcaccgcacccaccacatcccggacctgggatcccactcgcacccgaagaggcggctgcttatgttaatatcagcccccacacgaattagaaaagaccgcccggtgacagaattgcttatgccaggaactacactgaatccgtaagggagggggaagaacgtcttcccggggttacttcgcccctcctgcgtcctcctgctgtttccaaaagacagacttcatgtgcaaatgtcaacctctctcccaaacgaagctttagaaatttggggcgcatggtttttactaaagccccttctaagtgctgctcatcagaagatttacaacaatcctaaagacaatcagctaacacaagttacaccactgtaaggaaaacagccacgcaaatagagcaaggtgctgggtgatttcgttagaaacaatgttttcaatggacggggtctcagtaaaataccaaacgcagccccctacccttggcccttcaagtaaacagtttcccctagttattgttctaaaaattcccatcttcttgagcttctaatcttcaggaaacctggagcataggctccaaattactcggggaatccagagttaacatgaaggagaaagtgggatctgaattagtttcagcacttaaacagcgggggggatgtaagagtcatcatttaatctctcttcggcttccagaaagtaccccctggccattctgtgttctcccctccccctcctgagggtttgatgaaaaggaacctctactctgctttggtgaaactgcattttccacttgttttcctattggtcaaattggtgcagttatgggaggacttttgactgttttcccatgtgtcttttaagaatggggctataaatgtctgacacagctacacgttcacctctctgggacactactcacactggtgcctaactttaagggaagtgacataccaccatcatccaaaaacaaaaattgggtttctcacacactgtagcagaatatactctttttcttctcttgaggcatagcattgtcagctattaaaaatggatttaatgttttaattttcctggattccttcaccaaccccttaatttcaccccaatcttccagatagaatttacatgtgactactggccatgttgtagggaccaattggatcctttgtaaagttttaaaaattgcttcctagtaaattcttattcccaagaagtagtcgttattagtaggtgaagtcattagtgctcacttagatacagcattgtaaaaatctttacccattcaatgttcagcagcctgaaatttcacctttaggaaaaaaagagggatctttgccagacaattcctatataatggagcaaaatctgattctgtagtgttttgcttgttttcgatttaagggagatgaagatacatttctttatgtcctttgtttactgttctgaagttttacagatggttactgtattggatataataattttgcctagatttttaactgagggggtttgagaaccaagggacaaaatgtaatgtgttttcaaacttcagcttcccttctgctgtaactttcacaaagtatctcctgaaaactcctgtctttgtacaaaattcatcaaagagacagtggagactggggaatttttgaggttgtattcggattggtgtcttcaagggtccctttcagttcgcagtccaaggtgccagggactaccccgtcctccctccctcttctggctttgctctcctgagtccttttgccttctcttcccccttcttggattatcttttcattctcgatgaggttcccacacactgcggtgtgtgtctctgaaaacccactggagacctagcacaactctccgtacatcccgtggtgagaacagaatgaaagatatattgtttaaaaagcaataattaaaatctagtcttcagttccttcttcctcgtcatattttttctccgtaagcctagagattttattttcactagtgtgttcccttgtctccaaagagcgtgtgtgtgatattatattcgggaaagctacaactctcttttccttgtccttctgttctctcttaatagttgagcaatgtctgttatattttccccttttcctttttttctcagtcccagattcccgcctctccccactgtcagagcatctatcaatgtggtgtccatcacagcggcagcggctttctctttcatcttcctccctctgccagagccagggagggagagtgggaggcgtcaaggaggtaggggagagactggcagaggaaaaggagtgggtgggtgggggccaagtaaatagatacttagatgatgaagtcaagccactgcggcaatgtttcttgtcagtttcacgcgggcaaagcgtgcctttcggtgggttataagcagcgcccggtccttccttctctcgccaagttgcctgatccttccctccaggcgcgcgcgcacacaccacactcacacaccccaaaaccaagactcgtcctacaggatctgggaaaagaaaaagaaaaaaaagccctcaatcaccacctccttctcgccgactccccctcaccccccgcctcccctccagcgggcagccaaggagagctagaggcgggggaggggagagggaggagaagcgacgcaagtgggtagcttttcagcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtgagcgggccgctgccccagttccgagaggcgtggcgggtccctgggaaactcagagagggaggaagggaacgaaggcgcccggccgcccggctgagggtcccgagtagatccctcgtttgttttggggtgtgtgcgtagctgggcccccggtccgcagtgtgtgtgtgtgtgtgtgtgtgtgtgtgtgtgtgtgtgtgtgtaggatgggaggtagaggggcagggtaacttattccaaatggatcagtttagggggttcggtggctgaacggttggttcgcgggcaggaacccacaatgtttcgccttcggtctttttgttgggctgaggggtgccgtgctttaaagcgagtagggctgaataacgctactgataaattcttccgtgggacggaaaacaaagtgcacacgctatctcttggtagatgtctctgcaaaagtgcgttaaaccaccaaaggcttaggtggagacgagcagagccacaggcgggaggaaggggaggcgggcgtgggctggggcaggcggggccgtccctaccaccggtgagccgggccgcggggagcaggccggccgatggggcgcgcacccgggctgcgggggcggtgcggggttcagtccctgcggccccagcgcctgggctagcagctgggagctgtgggtgcgccgagccgacccaccgcaagggtacaccctggctgtaccgcccccaactctagttttctccaaccgccatcacttggaaacaaacccacaacttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtgctggctagagaaagcgcggagcagggccgcgctggagggctgtttgaagcctagtccagagctggtctagggggcggatggaccctgatacccgacactccactggtcacccttgttccacaactgggaaaccctctggaggaaatccggtagaaaagtcctgacacccgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccaatggcagaggtgagtacgaattttgaaaggctgggggcctgcgttcagagaacagaatggtgttctttacccgttgaatccagtttgagcgggctgggggcgggggtagggtgcacctaaccccgcgtaaaagatttgtgactactgtgtgctgggaaaaggaggtcaaagggaggacacacgtccagagaaccgaataacatccaaaacacaggctttttgccaaactctcctatttgtagagcagcctctctttctacccattttgctagtcctgccttagtccataaataattttgccacccacttcatattctccacaattttctggtccgggtgaaggacactgcgttcgaatccgagagcactcgggtgttaagtgggcatgaggaggcctgagggtgaaggagtaataccactgatttgcacgtgtttgaggctgtctgggtggatggtgattaccaaaactgatatcaactgggctaccttttagatgtctataacctgactctctaattttcctccctttaaccacagaatcgttctacttttgtaagcctgcactcagccagccatagtaggttataagctcgagtggagcttctgctgtaactgcgctcagggcagttgccttaagaccgcatctgagtggttggcttgtttatgtttaaatgccattttcagttgcaaaatgatatttcagccttcttttaatcagatctgattgaagtgaacagtggttgaagaggctatcgaaaccatcaaccccattaactcctactcctgtaatattaggcatccaaggagccttgatatggtttaataaacagcagtcagaacagcatgtggatcattcccaaatttaactatatttttattggttttgttattatttatacgtttttggtcccgggtggataataatcactcaaaaatacatgttgacaagaaaaggattatgcagtactaaacactagcgtatgtctctcagagtataaaacagagttgcccctaaacctcttcctttgaattaccagcgcacacacatttgtaccattattgtcacaaactctaaggtgattttctttcttttgggtgtggggattcatgatgttaggtggccagacaagcacaaacctctcaggagccctaccacgacaaggccagagaacaccccgatgacggtaagacacccattctacttcttctgactttagcagataaggggtgcaatttgtataaataggtgtgttttgttacttttgagttcaagaaactgggactaggtcagactatgcccactattttaatggtaaagaaaacgcaggaaacttatggcttacctctaatatatattacataatttaaaaactgtttttgaatgagttagggacccttggatttcaggtgggttccagattctttgggaagagggaatgtctacaatgagtttttctcttcctcatcttaccttaaatcctaattagcttagatctttagtatttttaatatattattaagaagaacgacagtatatatcgatttattttccaaccagaatagttttgagtggattttcacttgcaaaattgctgtttcttgttccttattacagtgaaaaggccggcagtaaatgagcagagcagaatctaacttgtaaaaatataaaacttataattaggaatgtgcatatcagaaatgataccctttctccctatttctgattcttgctaaaaactttaaaattacatacatatgtatttagacttaaggagaattctttgtgactttaaaagaatcaagtaaccttagggatttcttgtcagcctatctgttttccattaattacttaacaattggcctaactgaaatgaagtgtttttacatacaatatgtcaaccaggagcagggaagagaattatatattaggcttcttcctcagctacaagatagttacacagattaacaagaagaaatacacatatcgaacagaaattttttggcaaaatgatctaagtgtagcacataaaattaagcctcccagagttaatcctttataaatttagatagttgcctatatactagataacaactctttcagtagaatctagaaatttttctagaaatctgcaagcacaggtagaatctttgagtttgtctacaaggcaaaacataatttcaagtgtataaatctctgtgtttgtgtgtagctagatggcctaatatatttatattacatttttaaagttgtgtgtgttctgtatattttagtccagtttgttagtattagaacaaattaagttagatggataacacttatttttgtaaaaacatcagtcagtagtggaagaactgtttgaactacatgtttttaaaacatctggtttgctgctaagctatttaagagaataaatactgtcaatctaaaatagagcataataatccagttacagtattttgtaaacaaatcttttatgtagggtctgatttatcttagaactattagattttcagatgaaaaatacagtaatataaaagggaagtcagtgcatcattgattgttctttggatcttcccaggaaagcatccagatggaggcctctacaacaagggaccctcctactcgagttattccgggtacataatgatgccaaatatgaataacgacccatacatgtcaaatggatctctttctccacccatcccgagaacagtaagtaacatgctgatgttgcaaattatgttcagaagtgcaaattgatttgtattttggcagaatgtttatttttccaaactcattggtaatgctttcattatatataactagtcgttgctaaataagagctgttatgaggaatggccaccttaaaacagtgctacctttgatgtcttgcctttgaaattttagcttttggcttattgattaaaataaatatgtaacagatcataagttataaaatcaagtgaagttacatcaacaaatccctgattttatgagtattgtgcattctatgctgatgagaggaaaaaattgatttactttttcagctaagtaaggactgtatagcttttaatgcccacaagctttctagaatcagagctactttagctcatttggagctgaatgtttgttatgttactttggcttttcaaatggtgtcttgttttattgtatcggccaatgtttccttaggatcggtttggcggggatgagttatttttgctttattgtcaattgttgagaaagcatcactcaaagataaccctaatgaaagttgttccttttttttttaatcttgtggtttagttaacttttaaaattctaaaaatgcagtggtattataactgcattatgcaaatgcataacattataaagaatttcaggtttatttgatgatatttctcttaggaagtggaaacctcatttaagtgagaaaatacctaaatggtaacttgtgtagtatgtagatgtaaaatgtgctggtgatggagttctctcttagaattagcccaccagcgttggtgacggactttttactgacccatcaatatatttaccttctctccagccccactctccctttatcacctaacccccaatgaaaaacacatgtctatgggtctcggggattagggttccagtctcactgacagccctggaggtcaaatctcagattgtaaaatggaacctatagtgtttgacttacttgcccagtgtttctaccaactgaaaaaaatcagtcacaaacatctgggaagagtaacgttgttaataccttagtgaacaaaatctgggagtgagaagattcactagcagagaatagtggctcaaaatcaacagttatcaacaagagtatttgtggttatcattacacataatcttcagttgttgaaatgatacttatatcaaatatgatcactttgagcactgcaatttagatgttattgtaattattttccaataaattgctaaaggatatttgatctctcagctaaggaataagctttttctaatttttatatagtagttaaagtggagatcttggggttctaatcttgagggagatcttgtgatggttgctgtaagaaataggtatttcatattttattttaaggcttttcaagtatttaatgataaagatgtctgtgtgatgaggatgaatctcctacttaaaaagtaatttaaaaaagcaaaaatagtttaatatttagaggcccctcaaataaatgcttgagttttaaaagttgtaggagactttaaatttttgaacaaaacatacaaatatatagatatctctttaatatttgggcaggtttttttgctgtttttggagggggtggagaagggaaggagaatatgttttagataaggaatatttgaagattcctgttaaatcattttcagaataacaaataatctttccaaatcaaagtagtgttggtgacaatagaaaatagccacaaaacagccttacgtttttcagctgtgagtatacagcatttgtggaatttatttcttaaaaagatcagctacttctcctttcaaaatggtaattttaaaaaatcaatataatgaaaatttattggtatttataagcaatccctaagaatattgaaaattaagctgatcttcctctttatgccagcattctgccttgtgtttccacagtcttttctcccaatctaccagtatactagtcattttgaaattttgatagaaaatatcttttgatagaaggtatttattgttagtgtatgtattaaaattttgaggtcagtgaatcaaacagtcattcattgtttaggaaagatttgtggccagaataaatgttggtctgggtaaagtgtaggaaagaggtgtggtcaggaaacagttaccttaccctgttatctgttgctttgctttattctgttaaatattaggatgtatttattttaggcatgttttcttgagatattctgcagtttgcacaattccagaagcttttcagctgtaaccacaagactatgtaaattttttttttagggtccaaccgaagtgagttacaatctttggtttttaatacctaacagctgtttttaatgtgtcggagatcaaaaacactaaccggaagacagcctctcttcttcacccctaaccacacttctgccttcttgctctttaactctgtccttagcagggctgagtgtttgtgtcactaacatccacagtgatagattttcatctagggtgtcaggagcatggtgaccatttgtgtttgggcttaggatgggagcatccccttggcatcctgcttcttgaatttccattacaaacaattgcttgtttactgcatctgcttcccaaaagtgttaggactggaaaaacacctggggtgggggagggacctgaccactccttccctaaacagtcttctgtttgtatctaactgcagacaatccagaggataccagctatggccaactggcatgcagagaaatgtttctgctggaatctaattataaaaagtgcatatgcttttgcttattttttagacaaatgctactgtgtgtatcctggaacagattttacctatgaccaatatacagtattacctgttcaggagcaccactttcacctactcagctttttttcttctcaaggggaattttaattggcaaattacatccttctagaactggaatccttaggggtgtgaatgtgtctataccagaaatcttatgaatgggtctctcacagaattttaaataagaattcttagttcagataaattgggtctaagaagaaagcacctatcatgacatatttggtgtcagcgtgagttcttagggcatagtaaactttggcttgagttggtcttcttcacagagagtgaagagaagatgcagaagcctgttaaatattttagagccaggaccctggagagtttattaaaagcatactcccaaacctttcgttctctgaactttatttatgaaaatccctgtaggccaatggtaaagtattaaaagaaaaaaatagttctttacatccctagtttggctctggcagttgtgtgcctgaacaccgtgtgaatggtgagcttggccagctttaatgtagtgaaagttcccactggcctaatgcactgtggttattcatcttaggcgtcaatcttccatttgtcccgcatgcaacccaaatgtttaacaccttagaaaagaaacatctcatttctcttcagatgcttggggagggaaaagcaacacagtgcaggaagctgcagcaaacgttgcagctcagtcacatcaaaccacaataacacctggtcagtgtagcgctgcaaacttcattgtttttggttctttgtgatctttctaagagtcaatttttaggtgggaaaggaaagatatgggtgttctcatttcagctatcttttaaaatgtttatttttttaaagtagaaattgctatgaaaatgttccatgagttcttttctaattaccttgtataacttagttctgttgtgacttttaccttaagggaatcaacactttggtttctattaaacagaattatacctattataactttgtcttacctaccctgcatatttgtacttgcttataaacagctaaaatctgattttgtcattgttcacatctggaattaaggaactaagttggacttgtctaatcagtaagcttctgaatgtaccactgtacgtgacattgttggatacctttgaaaataatcacataaataatattcaaggatagatggagactaaggcttatatctcatgcaagatttttaaggtagagtatcttttcactttattgcaagaagctattgaatttgacttaacctataaataattttcacttttctattttaagttgtgcactttttgaagctaaacacattgagttttccccttcaagtggagaataagttttagaaagtgtattattctaactcaaatgtatatatagatgtcaggagaatgtgtgggaaaattcctcagagcccccaaagtttcctgtttgatccctccttcatggcattgctacaatttgggacaggatcatagtcagaataattggaagcgcttgccattcccccatcaaataccttatggccagtttgcttatttaagtgtgccaggaagccatactacatgtaacccttgcagagctaatattgcatttacatgcctggttcttactcagatagtttttttgaaatgaccctagtagtttcttcttcattgataaagacatgagaacaacccaaaagatagtcttaaaaaaaaaagaccacacactaaaaaaaagaccattgagccaatccgcaaaaatcttgcttttgaagtattttttccactcccatacaggtcttagatttgctctcatcaacctcattattttgatcgagtcttccctgtggtccgagacccttatgtgatttaacagagcagaggtagggtctcacaaatgggactctctggacttgaatttgtagactcacaagcacttgctataatatcaattttgtagcggatgagttttttttttttaatgttctttagacagaaccatttgggtttatgtgattgaatttttttttgagcaatcaaaacacttcatttttgactccttttgttcctcatttatgtatcatagacatgactggaattttataaagctgatttccttttgattttggtaaaagacttggaatttaaagagaaaacatgccagcactgtctgtagcaagcagaaaaacatatatgttttattcccaggtaaaagtagagctcagcattatgtaggtgctgctgtcctgggactaaaggttgcgcgctctctctctctctctctttttttaagggaatgttcatttaaaacttgtcctctttgaagctgttgcttaagtgtttgtgctgagctgagccaatctgtaggaagctaatactgtagtaatcaagacacttagtactcttctgtgctatccttacatgtccttacttatttagaaaaggcagccattggattttattcagataatttaaaaattatactttaggttcatgattactttttaaatattatgatcttgaattacctgcctaggaactgtggactctgctataaactcttttagggatataaatcatccagtatctcagatagagaagatgaaagccttaaaatatcctagagaacaacaacaaagactgggggtggaggtggggggagttgggagttaatctgtaccaaagtgaagagcggggagttgagcagaggactggacagggagcaggaggcattgctaactcagaaattctgataatctagctgggactatttgcagactgttagcagaggctgtgtagaggattataaagtctctgtaaaagagtgcatttgtataatacccactgtagctaaacctgtaaacctgctgcaattatccacttgttatctctagatcacttacaaagctcactgagcgatggtactcacatgccttcaatctgtatagggaaaattgcaagggcagtgcagagcaagcaagagttttgttgccaaccccatttttccatttgtaggagaaataggactagcagagaaggttgcatcacagagtgtctagaaatacagtttatttttgcagctagctagggacaagtagaatctttaaaaagctggatttgttgaccgttgtgtctacctatgctcacacataaccctatgtggaacttgatgacagttttgcagatgaaattttgatcttcatcatagtaatttattgtcattgttatgttcacctgtaaaaagttgcctattgctcgaggcaggtggatcacctgaggtcaggagtttgagaccagcctgaccaacatggtgaaaccccatctctactaaaaaatacaaaaattagctgggcttggtggcaggtgccaagctactcaggaggctgaggcaggagaatctcttgaacccaggagtctgaggttgcagtgagcccagatcgcaccattgcatccagcctgggcgaaagagctatatgtgtgtttgtgtgtgtgtgtgtgtgtgtgtgtgtgtgtgtgtgtgtgtatatatatatatatagagagagagagagagagaatgaagaggtagatataagttagggtctctaaaaaggagagtggttctagggtagcttaattttcttttattattgttgtcagcttctgaatgaaacagtaaccaaagcaaaattttaaaatttgacctactaagatatatttcttttatttgtataagtttatggagtacaagtgtaattttgttacatacatagattgcatagtggtgaagtcagggcttttatagtatccatcatccagataacatatccattaagaaatttctcatcatcacccccctcctaccccctcacccttctgagtctctactgtctatcgtttgacactctatgtccacattatttagctcacacttacaagcaataacatgatatttgcgtttttactaagatatttttataaatcttttttaatcctggaaaccttacaataaaaattataaaaaatgttgatgatagttaatcatctagtaatcagttaccatcataaagtaactgggggactatcatcagcagtcctccagtttaaactcagggactgctgatgaattatgttagttacagtcagcctagcacagagtagaaacctcagtaaatgtgctgagttaataaagaatgtagaagaaattttgcatgtgtgttttctggatatttccaaatgatctgtctttatgaaaccaaatgctacgtgaaaagtaaaacttgaaagtgtttactaagtaatccttagtatttgattattttactttttctcttattttttgcattggtgaataaagtagcattagaccagtgtttttaatgaggaagtcaaaactactccttatagaatatagagtttccagataactcctgaaaacagtcagccgggggagtgcactactggaataaataaagaatggactagaccctcatatgaggatttatcttaggaagtacttatctgttagttaggtcctagaaacctaattgaagaaatggagatgataaaactgcttttttcagaaggattcttgagatggaaacacaatactagtaaaaagaaaaccatcttcaagtatgtttcagaatcatgtggttaatgcttttcaattcatttttattctcttggcaatagaaggaacttttttttcagtatcacgaggtattttcagctattaaaaagttctgtccttttcaaatacacatggcagcctcagtgctgacttttctaggccattgtgttttgtaaattgattctatccttttgcaatgtggtgaacaaaatttttgagccttaattagggagagataggtaggcagtgccctatgatggctaaacatagagaagggaaggactaggctagatgttaaaagacctgagatctaatgtcgggtctccatcatcttcttctgaaaactttgggaaggttaaatggcatattaatatcgggcttgtctacctgatctgattgatgagaagttcatatggcacaaagcctgcaaaagcgctgttttctagctgtggccgcagagcaggagtctaagatggtgtaagtcagtgccttgggccccacctggtgggatttctgcagctataagaagtgcttgactctacccgggaaactccagagaaagggaagaaactttcggttcctattgtgccatcatgctgactcagaatttggatactgggtgaaggccttacacaaacctttagaaaatgtttgcataaataaaaattcaggggaatgtcatcgtatttttacagatctgattttcctctcttgggctcgctttccttgtgattgttaggagagcagcagattttcttctttagcaccgtaatccaccatgaaagggaatgagacgtatgagggaacagatttctaaatttcaggtttgttagccgaaagtctcatatccttctaatatttgatatgaaattgccagataactcttaactacttgaatggagttgaattgaggtaagaatatgtttttggttaggagatttttttttcccccttaatcccataggagctggggttttctctctactgcaaaaattatagagaaaggatatccaggagccgtatgaaggacaatgggcaagttatttttttttgcccttcgaatttccttctggcttaaatttttctagctttcttgtcaccgaaaaggatcacgtccaaagggatgtgttggctgaacagcaaggagaaatcaatgtttttctagcctcctgggaaattccagcttctttcctttcaggacttttctttttctttcagtaaaatcccatgaatgttaaatatttatatattggatgcagctttctttgtacaggatccctcaattttgaacactataaatggtaccttaaaataattatggtcatatcatctttgtatactggttaaaatgacctggatcgagggaaaaaggtgctgaaatcttatctcaaatatattagactttgttttggcatcttaaagtctgtaacaaaaccaaaatatgaagtaaataatatttactgtttattacagttgggctgaccagtcagctgtctggcagtgttaggaaaataatcattgcttgaattatttttttttcttatttgtattcatacattagaattttaagttaaaactcaagttttttggtttttttttgcttgaaaaagaagggaaagcaactgattttttttttttttttttttttttgctactaccttgtgctacatactgtgcgaggcaccttacagggttgtcatatttaatttaatcctaatgtgaaaactggggtgagtgttatactcccggtgttaaagacaaggatccatcgtcagcgacagcagtaacctgccccaatttaatacggttccttaaggtctaaagacttgtttgttttcatttaaaatagccatatttacctttaagaatacaaagtacttattaaattcatcataatattgattaaaattgaaagcagaagagaaattgttacaattttcttgaaaatttcaaaaatgcttaaccatttttattaaaataaaaagaaatttaaaaagcaatacatgttcactggaaaaattagaaaattcaaataagcaaaaataataccaaatattaaattcccaggatcacattgttaaagacgatcactttttctgtgtggccttttagacttctttctgtgcacacatataaatgtaggtaaacaaacacaaatacttgttatatattcatggcaataggaacataaggtatcattttgcaacttgcttttttgccaccaacttattatgtatatctttttctattaataaataatcttctgtaacatcatttttaatagattgcctaatttatttaaccagtattttattggtagacatttagattgtatcacctttttccccaccttatgcagtactgtgatgaagtgcatatattctaactaaaagtttgcacagattctgaattgtttctttggaacaaattgccagaattgcagtcaaaggcaatgcacctttttaggtaggagttacctgcactgcaatttaatcttaaaaacatgtttataaagttaatatttaaaaatatgtacttgtttacattcaactttcgttgtggttagtgttttgaggctgataattttcatgcctcttcaagtcaataattagtccagcaaagtcagacagagggaaagtgtaatatcagctttattattaataaggccagacagtatcaggcagtataataccaactgtattatcaataaggctacattggagaacgtgacttgaactgtgatacaaaccatggacttcctttgattttcctaaattgaacacaacaccaagccacatgcctcttttgcagaggcagggtgctcacatcctgtagaactggagatgagaccaaacccatgtttgggcaagctggcctgacagagagaacaaagggtcagtctgtccttgctcagttcctgcttctaggttgccaaagagatgagtgtccttccttgtagagagtgcatgaggtgctggggagggaaaagggctacagccactgctgagagggcagcagttcctactttagtgaccaagctagggaggaagggaaaagggtgaggtgattgtctctttagtcatgacttgcagtcagtgagactagggtccaaccaagataatggtaaaataaatgagtaaataaaagagagcagcagcaaagcactgctgttggagtccatatacctagatgctaccactctgctactgactagatgtgtgttcacactctttgacccttggtctcctcatctggcattggtggtggtatggctggaaggtggccagtggcctctgaattacaggtgtttctgttaaaaaggcagattactggccccgtctgcaaatgtcctgaatcacacactacaggcaggtcatgtagatgcgcttttaacaaactctccattgattcttctataaaataagttttggaaaaacattggcacagtagatgctcagtaatttaactgaggttcagataatgtaaatgactttccagaggtctcacacccagaaagcagtggagctgggactccaagtgtggccctttggccccaagcttactttctcttcactcaaccatattgggccctaattgagaccactggcactgttcacctctcgtcagatctcatgaggttttctccccgagtgccttgccccactggctgtgggattaaatcacattttggggcattatttttaaaagctttccacaccctggaaccatctccctttcaagtcttacctcctcaccactctgccttgcagcttatgattcagttacactcccagacctgcatcctaaacccttttccaaaaccctgtctttggattcttatagcttgctctcgctgaaatgccctgttctctattccctgccagcagggtcttgtccatccttaaaggtctggggtaagtgctgcctcctcaatgaagttcctccggatcccaccgtcagtcaagagtgactactctctctttcgggtcctcataagtcctccctcagagctctgtagccatgttttccaatagctttttgtctttgtgtttgtatttctcattgattgttagtttctttaggatagggagcatgtcttattcatctttgttgcccagaacctgttatattacttgccacagagcaggttactcaccagatgtttgtggaataaacagaacagaaattttaaaacttcaagaatgtaacgcaacaacaccaggtatcaatccgtatttaaatggaatctcttaaaaatatataaatttgtatggaatcgcaaagccaaaatggagcttagaaattatttgagcatttcatatagaatccatggactagacgttagttattagttttgagtacttagcacatgccaggaactgttctaaaccccttctgtgcgttagcccatttaatcctcatagtaactcagtgctatctctgatatccctgtgttacagttgagggaactgaagtatagagaaggttgagcaatggcatgcagggcatagagaagggtaaggacgactgtaaacaggtcaagaagtggaaggtcagataatttaccctgattgcacaactggtaagtagtggtaccagattgaggctcaagtcttcactctcacagcagggtactttctgcaacttcagtttcttattaccatttctgccactagcatgcagaagacgctagatgattattgaatcagtgagtttctcataggtaagatggaaatgattcttagtagggttttgtgagaataaaattggaaattgtacatttctttaacatattttgggtagtaatagctattatgatgctagtggataacacaagagttcaaaggtgaccagttagatgtggaggagggaaagagttgtgtaaaagatgatgagtgttctagcctgatggtgagaggacagtattaatggaaataattaatttggaaagagaagccagtttgaagacaggcattcatgagtttagcttaggaatcattgttttcagttttatgctaagaaaacaaaattaaccaagatctggaaccaaaccattttacattatgggcatctttttggtccatactttatttgatgtaagtcaacaatgcctcacaaaatcacttcacttacctatgaagcttcctggaccttgaccagaaacctccatgtgattatgagaaataagtattttgtccaagggtgaagagagtactggtattaataatatactagcatgtaatatttaatgatgtactttacatgcatttttcttattaaatctttactaaacagtatgaagtgaatgctactaatatgcctatgtttccagtgaagaaactgaggcacagagaagttacttgaatgtccatagtcccaaccagagtttaataagtggtagggaatttggattcaaagtcaggtattttcaggagctggggcccaattcataaatcagttcatctctcagaagtgttaagagtaatccttagtcaataaactactttgaggattaaaggtatctgttatacttttattaaataatgtaaatggcttaaataaaaggttctaagaatacttggaaattgtcttctggttcattcaacacataaccatgtgattgctcaatgtattcttgaaaattcccaggaaatattgcttcctggggtatatcagacatagtttgataagtgtctgatttttatgggaatctctattcctcacttctagaggcccagtgtccccaagtcttagggactaaacagattaatcaaatagctgtatgaccaaaggtttcattattcttagaatctttttggcaaatgatgttgcctccttattacataagaactgagcatttacaggcaaaagtctgccaaagagcattctttgcacagcaagcaattaaaatgtggtatgtgcttcatttttaggagcagttagtggtgatttttgtggtatcatgatgttggtttaaataagagaaattagtttagaattaactggaattgtgatcattcctgagaagttgcaacagtgagtttcctttaaaaagtgaagaaacttttctttctaaggagacattaggaacagtcttttcttctttttctcaaaaggaaatatctttttttttttttggttaacagtaatatataaaaacgggggaaaacccatgaaagaacagaaaaaataaataaaaagtacctatatttctgtcattctgatataatggtttcattttgatgaattgtttcatttcagacattctttctgtatctatacctgtaatacaaacgtttttgtaaatgagcttataagattattattctattataatcttttgtcattaaaaatgtattacgtgtgctcatctttatgtgaatgtaggtctgtgtcatcagttgtaatggctggatagtatccagttatatatatatatacacatgtacatatatgtacatatatatacacatgtatatatatgtacatatatacacacaaatatatacacactttaatttattggatttatcctcagttatggatgttaaagtttttttgttgttattttaaataccactacaatgaaaccgtgttaaaaatatatttataatctattttttttttttttttttgagacggagtctcgctctgtcgcccaggctggagtgcagtggcacgacctcggctcactgcaagctccgcctcccgggttcacgccattctcctgcctcagcctcccgagtagccgggaccacaggcgcccgccaccacgcccggctaattttttgtatttttagtagaggcggggtttcaccgcgttagccaggatggtctcgatctcctgacctcatgatccgcccgcctctgcctcccaaagtgctgggattacaggcgtgagccaccgcgcccggccaatctatttgtttatgttacttgctggttcatagctttcttgatttaagataactttttacatagtaagcatgtaaacagttttgacaaactattcatgaaataatggttcaaaactattttacaccaacatcatgtatctgtttctttactcctgcacaattaagatctgcttgcaagttaatatgtaaagaacttgctacttaatataagaaaattcatagtaactcagtgctatctttgatatccgtgcagcattagtttggttcattatttatatttaatttcaggagtgaagatgctaatacagctcttttgaccctcataggatggtgcaataaccagaaagcacatcttattgcagttcactaattatatgttgttataggagtttctgaactaatcctaaagtttaaggataaacaagtttcctggtagaatgaagataaatcctaaagaatgttttcaggaatgatttatcattcattccgtaaatattcattgaagatacttattttgacagtcagtgtgctgagccccattgtggatacatgatgataaaagcagagtcaccaccctctagaagcttacagattagtgagggagagacacttgtgcaaacatccacagctgagcagagtgaggcaggcatgacatcactactacaacccagggatacaggtgtgaacagagcctagcctgctcaccctggagtgttgcagcctagtagagcagttccagaggactgtctttatatgtactattcattctttacctgctttcagttccatgtggcccatttgaagcatggtggggaatatttggtttacttgtttaaaaagggttgtgtagacacctctgggctgggccaggaaagttgcttgataaatgttttttttttttattaaaagagcattcatgttaagtaacctaagactatttaagaatagaactcagaaactcagaactatttatagagcatttgaaatgaacaagtttataaacattgctgccaagttaactgatggttggtaagagtggaggccaggacttagaccctcttctgttttatgctgttggtactgtgtcactgtttatttagtaccaccaccagaaacctttaccttgtgtgaggcacttgctttttgtactatttaaccacattttaaatcgttgttgttaaatttgactacaatttgaattgggcaaacaatattatgaaggtagataagttttcatttatttacatatgtcatgtagtggctgagaacacatgctctgcatcttaagtgcctgagcccaaatccaggattagccacttactacaggtgggaaaattgctttacctttttgtttctgtttctttactcacaagtactttaaaaaaatttctggcatcctaacggtaagttggaaagagtaggaaatgactgtttcaaaaatattatttagttaccacatataggaaatacgtggtctgaattcattgcagggaatcactgtactgctaggaataaggtgtcaacataggactgtgaattgcaggcttgaggatattagatcccatttagtgaataatgtgaagccaacaaaaagttacataatacaggattatatgtactagattttatgagggcttcttatgtatctatagaggaaaatggagattaaatttttcaaaaagaaatatttcctcctaagatggctgggtataaggaaaaaacagaggcctctgtgtagtggtgagagaaatgtgacatttaagctacaaatgaaaaaaccgttcataattcagggctatctgagatgtttgtttttgttcttatttgttattttaatcttgagttaattcaataatgtctatgcaaatttgaaaatattggctacctgagaaaaaccttttaaagactttttttttttaggcttctattgttgctaatctcgtggtagaggaaaaaatactgacatggagttaggcaagtcattgactagccatgtatccctgaacagactagtccctaacttcttcaagcctgtttccttctctccctccctcccgggcctctctctgtaacccaggctggagtgcaatggtgtaatcaaagctcactgcagcctcaacctcctaggctcaagtgctcctcctgcacttcccaaagattcaggtatgagccaccgcaccccactgagcctcagttttcttatctgaagctctaacaaaggactgttgtgtagactaagggaaacacggttgtgtcagtatgcttcccgtgcttaaaagctcctggacttcttatggtaccagactttagagctcactcaaagaaaacacacttgcatttctcttgagttgttttatcgatacaggttgagtaaccctaatccaatatgtgaagtgcttcaaaatctgaaactctttgaacactaacatgaagatcaaaaaacaaaaacaaaaaacttgtcggagtttttaggatattgattttcccatcagacatactgaaccaataggtatataatgcagatactccaaatctgaaatgaaatctgaaatgcctctggacctaagaattttgaataaagtatactcaacctgtactgaaagcatcagaatttacgtcagtgctttttaagaaaggaggttttttctgctctagaggtgaagcaaggtctgatgctatgagaaaggtagaagattgactcaatacttctttttgcctggttctgggaggacatctcatatgttaataacttattaggggcaccacaagtgcatacctattataccaaatcagatctggacatctaacgtgaataattccactggtatataatgcttaccattaaaggtctgcctttggaacaccaagccatacctactttctgctcatcctctgctcactctctcatagaatcctgaattccttgaccccagtcatcatccagatactccttttcatgagcaaacatttagtgttttaaagtcacaaggtcgctacgtggacaaagactaagcaacacagttgtttttactcatggagaacatgtccaggagagcttttcctctggcttttgtttaattgggataggaggaattcattcacttattcattcagcaaatgttttttcagtggtcacttatttttaaaatagtttcatttttattgagatataattcacatagcatacattttacccactttgagtgtacagtgtagtggtttttagtatattcacatagttagtgcagccatcatcacagtcagttttaggacattttcatcacctcggaaagtaaccccagagcctttagctattatccccttatctctcattccctcagtgctcaccccaggcccaagcaactactaacctattttgtctcaacatatttccctatttgagacatttcataagaatagaatcataggcacatatagggtgtagtcctttgtgactggcttctttcactgagtgtaatgtattcagggttcattcatgtcacagtgagtatcacagcttcatttcttttccactctggcttccatggctccatcttgcttccagaaggttagatcagtacagtgaggaaaggagctgatttaatccatattgagaggaagaaaagtgaaatcaattgatatttcagatatctaaatccatggtgagatttattttactgcaagccctcatcaattaaaaattttggccactgtataattatttatgaattatatacctgaactatataattatctgatggctgttatttcaaataaaattgataatttctcgttattttggtcagcttcttgacaagtcttgtccagtgtcattacagattttagctttaatgcaagctcttaaagggttgatattagaggtagaactgttggctttgccattttcttgctgttttttgtgcttacattattactgttatcttcagtccacttggcattcttgaccgtctggcatacagagcaaacgggggccccagtggcaatttgtatgttaaatatttctggtaaaacttaaaatttttcatatagaaatatgtattgacattgtagtattttcttcctgctgcaccccagtggataatgctatgtattctttgtatgatgtgggataaccaactattctagattgatggctggggaaagtaaacgggaaccctattcctatttgttccgataagatacttctgaaagtgtggctgttgagtgtttcatatgaaagttttttatgagacctgcagattatgcagtattcatgaggatactcttctttttttttttttttttttttttttggctggttgggtcaattctttgctgtacagattacttgcagattgctcagaatcacctgggtttgctgcacactgagctgtgggctgaggctgtgtttcaccctcgtgtggcccagctaaatgacatcatttgaggtcgtgcttcatggtgaccttgtggcatctcctgttcacccctcctgtggccctgccctccagcagctgtgtgggaattctgctcccttccttctctctagattagatgtctgcactagggcacttgctattttaaaccaaagatgtactgtgtgtgcaagtgatgaaaccgcttgaaaagaaggctctgtgctatctgagacagttctcagtctttcatgagcatgttgaaaattgggcaccatccaattattgacatatgattgtagatcttgatggcagaactctgccaattcccagggggatctgcttgataagctgttcatttgacttggggaagacaggagagcagtttaaacccagctccaaatataagaactgtttctttagcatgtgcctggggccagctttgttcttcactgaaggaataaccaaaggaaatggacttaaattgttgaaagaatttaggttgggagaattacttcagagggagagattaataaacattggaatggtttatcaaaggaaagcatggaatctggttatttaaaggtttttaagagtaaatttgtatttgtgtgaagcgattggaatgcctcatctagaggggtcccagactttgggcagtacctattaactcctgctcctcaaccggcttgcttcccccactcctcacctctgaggcagttttcttttcttttcagtaaggagcataaggaccctccaggttcttcaagagattatttttcccttcctgaagggaaaaataaataggccagcacatagattatgctatataacgagtctcctgtgtatcattacagtgttgtcacctccattctcaatgatggcaatttttgctgagggcagtctgagaaatgtgtggagcccacagctccgggggctactgagattccatatgcttttagtttgtctctgcttagccactggagtgcctctctcaaggttggtggctgagcaagtggtgctgtgttctctcacatgctgttcaggtgactaaaattctaagtacaggtttctctgaggagggccttgaagaaggcgggggcaggggattgagggggcgccgtatattgactttttcctttggtttgaatgggaagcctgggatgcttccagtgactgttttgcttgttactttgcaagagaaggctaatgatagaatcacaaaagaaatgtttttttgcctgataatctgaaattagaagggggccttgggatatggaaaatgtgataagcttattaagaatgcaacctacagaaaaatatttgataacactggaacttatttccggcattttccgaaaatggtaaaattaaggaaagatggcacttttccaagagaaaaatatacagattttgagatgttattattcaggttttcttgctgattttgcttttgcaattctgaattcatgtagtttgtaccctttcctctaaagcaaaacaaaccccaaatgaaacaaacataaaaactgtaacccagtaaactgaagtaggcaggttgttaaaagaaagagttttccagttctgcacagttacagacaaattttcaaagaaaatttacagttgggtaccttacagccaggtctgttgattcaaaatcctttcaaacaaagatggcttttgttcgccaattacttggtgtttcagaactaagaagttttgtgcagaatgaaaggaagcagttatttcatagtcatttctcctatgtcaataagttttagaactttgtagacttggaaaagttaaagactgatggttcattgactactatctacataaacaatattaaatctttgtgaaaaggggactttgttaaacgagatgcattttattttataaattctcttaagattctactttcctgctctctccatccataatcttgtcatttcaatgtgaatgtaaattcagagtttctctgtagagctatgtaatattgattagggcagacattttcaaaggcagcaattaaaaattagaattggaataacggaaggttttcttactagggagtgattactggacatatgtaacactatatgtagcaccagagacatagtatagtgatttatggtcgccctgcttgctttttatgttgattttaaatgtaataatggatgaattacacaatgtatttaatcataagtccaaaatgtcttaattatttttaaaaaattagaaatagctttacttttaatttccattttaagaaataggatactagtgttgatgtattttggttattatgttcttaggaatttttctgcctcttttggtggcattaggttttgattcacttgtcaagacgtgatcctgtcatactgatttgtgtctctgtatctggagccagaattgaaaaccacctttgactttcctgttcttcctcttctgttaatggaatcatgcatttacaacttcccaaataaacctgtgattcttacaaatgcaagtatctgctctgcttagttgattaaaaagggctaaggaggagcaggtaagggcgcgggacaggtctttagcagctgcacccgttcaccttgcatcaggtgtctgcaaagtcttcagaccaaatacatgttagagtccctttcccaattggaatcacttaccccatcatttttattttaccctttaggcttgaaaaagtgtgtatttagccatcagttcattttgtgtggtctgagttataaaatgcccctgctggtttttccatatgaaaaacatggttttcatttgtggaaacttacataattttttttctgggccttttgtgctgctttaaattaaaagcaaatgtatttccctccccttcattcttgcttccccacccccatctttgcatgttccaattacagagttgtgaaaataagtcatccttcggcttttgttactttaaaacagctatcggtgatgtcagagtcaatactaaaagcattaagaatgctggcagaatgtaatgcagctgcaatccaacatgatgctggaaatggggttgagagcataaaggctttccatattcccagggcgcacaactgcttgcggccttggctttgatctcttcaaaggctgctgcctcctcctagatggagagacttggctgccactcgcttgcattgaaaaaaggcagaggtctctattcaggcagaaatcaatcactgtgcagaaacaattatgtgtaattcaaccatcatgaaaacaggacgagattacgggtttgttacctgagtgactgtgtgaagacggggagcagagaacactggagtcccgctgacatgccacatctcgatgacaattatagacatatgaatgatgtggcggggggggaggcacaatgacaaatactggtcacgctgtccagcagagcagaaaatgaggttacaattgggagataatgtttgcatatgtaaccatatttcagcaagctgaacaacttcagggaacagaccctcaaaactcttgtgaatatttgtatgtacagagactaacatatgaatttgatattggctgaattaggacaaaaataatcctaataatttgaggattatactgaaagagagaaggaaagtgaatttaactttggtttattacacttgctgatttggagtacatactactgctaacaccaaactctgaaaacacaactaactttctaacctaatatatatggatctctctttaaacatcttctggttcaagaataacatttttattttgagtctgtaaacttgtctcaaaaaagcattatgttttttcaccttgattgaggctttttggggaaatgatttttgtcagttgtaccatcttcccttgttttcagatttaatttttgaaaagcaactttctcaaatgtgttgaagtttcctttcactgagaagaaaagcaaggcatttttctaggtaggaaataactttttgctttaagtacaagtatgcttaatcttgaagccctggcatgcaaagctatcgaggtatttatttttattttaacttgcttcttgtcacctaacaaaggcgtaggagtaacctcgcactttgctagctaacctgactccgggtgaggggaaagtcaaaataagatgaaaacctagatggctgattataaaatggtattgcttctgctcagtttgatacccaggcctgggtttaccttttatgctgctccagcttagacatcagaggcgtgagagctgctttgagttacagatcttcaaacaataagtcaaaacaaaaaatcaatcccctccggtccctgggtgcagttatcgaaagataaaagagaaaaataaagttatgctaaagtagatagaggaaaggagcagatatgccaaggaaacacggaggacaagtgcagagttgaagtgggcctcatatgagccaacatcaatgaatttttatcttatcaaaaagttttagggttgccagttcttttcaaactggatccagtctgctccagggctgcctggagcgttggcttcaatgaagttgcttttcccccctccctctaaaatataaccacataggaattagactgcatttcactcaaggtataaaacttgccacagacttcgacggcaaattaggggttttgataatcccttgatattttgaatataaattgaggggagtgtgtgtgtgtgtatttttatgtttattgaaagctgagatttacatgaaaagtaaggcaaatctctatagtgtgtttttgcttcaagccaaatttctaaggagagctagaaagtccccatgaattctttttgaggtaagaaatctgtgtttttcctctgtttcttgtgggtaatgtcagatatttttggatattaattataactatctgaaccattttagatggtattttaacatatgagccagtatatatttttatgaatccaagttatagtttgaaaaaaaagccttacatttttacatatttttagaaaacaataaactagtttactcaattgttttacagctgtaaatgtttgtgagatgatcctagttcctctattaacgtccctaaaggtctctcacaaaatggcagcacatatttcattcttgtccttccctttgcttcctctttgttttccttaccgagagagtcatgttcctgagctaatgccagcagggccagcagggccagggtggaggtccaggctctgcatccacctccctaaccactgtggagcccggcctgcaccttgccctgtgatctgtgctggacatagtcacatttaacagcccttcaagtttccaggttttaagggagaaaaggatagttagcttggcattgtagatgcagatgccatgctatttaaagatgcatgttctatatataaactctagttaatcatttgactaaaaccatcataactttcctttgcatagttcagatgattcattgttttgaaaactatgtaaactcaaatggaaaacaaccacgcactgatggttgcaacttatatttcccagtatagagttaatgagcagaaaaatggcagaaccgcttccacacatctaaggctgaacatttcttggaactattaatgaatgtactttactgtaaacattgaagcttagcagtatgttctataggccctgagaagaggggaatgaagattctttctagtttcttacaattataccatggcagggaatctcagtctgtatttttaggtatttgtcctccaactctccttcaggcctggttcagctagcatttccagtccagtctctaccatttcctatccttaatccatccttgttatccttccaggctacttagaggatgttgctacgagtggcttcacgtttacatgcaaggaagggaaggcagaggaggaaaatggggcatggtggcacatgtaggtcacataggcatcatgcgtcagcaagctccgttctgtcccccatggaagcatctttgaattcctgatgttctcagccctaaattctcagctcttctattctcatataggcagtggcaacttcaaggcgtttggaggagttggggctagcccccataatctccagcaatacccttcaccaccccaaataaacacctttgctaagtaaaaatattcttcagatacagcatttacttcaatcttgcaaccagattgctgttcctaagccccctttgtgtagaaatgtatatgctaggtaagctgtcaggcatactcgtgtgtgtgtgtgtgtggtgtgtatacacacacatacacacctgtacatataatgcagtgtttaaagctcatgagtcagattgcctgtgcttgaatttcactgccatgcaagttcctaaagcattataatgctcactttccttatctgtataatgggagtaatcatagtagcgacccataggcttgtgtaaaggcaatgcaaatacagagcatacttgatacctctttttgttgttggaaaataacaattccattccatacatcatgaaaacattatttgcatttcattactgaccttttgagatgtactctttcatctatttattttatacatatttgatattcgaaattccacatttgaccagctccccgagtagaggccatgggtggaggaaagaactgagtccaacaagtctcatctaaacctgtatttctgttgaagaagcaaaaataggagattttgttggggtcatcctaaaggctgcataatcatgagagaaaattatgtggttaataatttgttaacctcttaggtttcagtaatttggaatttaggaaagcaaaatcatagttcacatttttccctagtctttttaatgttaatatactaaaggaaattatatatctctttcaaaggaaaaatgttttaaaattaggtgaatgttatattttggcatgttatattgggttgatatattctataggacaatattaagtttttattacagagtctatgagtgtgcaattcattagcatttggaatggtaacaggaaaaccatattcaaatattttgaatcacaaaatataaattaggatctaaaatttataatattcagggatatgatgggtgagatgagcaagattcaagttaatagattattatagtcttctgaatagtaccagactctggacagcaaagtaaccaataccgttccttcctacattcagactttgctcttcttccccccagcacacacagcctctaatcctcatgccaacaaatcagtgccactttcctcttttcctatctttgagggcatttttatcacataaaaactccacattgaaaaatctaagttgtagtatgaagatagctttatgatgtttaaaatattacttggactttctgttttaattgcttttttgattgcatgaatcagtttttttagtggtgatttctgagattttgttgtatccatcaccagagcagtgtacactgcacccagtgtggagtcttttatccctcaccccactcccaccctttcccctgagtccccaaagtccattgtattattcttacgcctttgcaatagactttctgttttaataggaaattgctagctttgatgatttgtgatgttttgtaaaaaatgttgaaaataactatttaaaaaactattcttcgtagcttcaaaattctgtactgtttgaagaataattacaatacttatttagggagaggcaccaaatacatattttaactaacattaaagtcaattttaaagtacttacaataaagaaaaagttgactttttaataagccagaagaaacttagtctgggttaaatagctttatccttagcaaaaatgaccagacaacctctcagaattttaaaggaagacttagagcccttattggtagctatttagttttcaatgactacatacttatataatttcataaaaattattggaagttatttccctttttacccttggatattttgagttagaacattatttttaaaatcttataagcacagtagggtaaataatcacaaacatttatgttttttaaagaaaaagacaccttactgaagggcaaatgaccctatattattagatttaactattcagtcaccgtaagaattacaatagcatgttttatacaatgtgtgaatcgtaactctaggtctgcagttataagacccctgaaaggcaaacttctggcatttgatcatatgtattgctgaactttccagatctgggtggggtatccaaacctggaattgttataatactatgcagcataagcatctaaagtttaaaaaaaaaaaaaaaaaggaaatttaaggagatgagaagtatttgaactggcaatatgctatataactgtacatgtttttataaagattaatcctttgattttagaatacttggtcaaatagccagtagaatttaagttttgaaggttttggggggaatacgcatatagtagaaggacaaagcagaaatggttaagaaagatacgaattttatagcatgctaaaccaacaccacgtgaaattttataggtgcaggttctttatggaacttctaatgtttgcacatttattttagaaaaaatgaactatgcttctgaaagttattttacatttaagttcagagttatttcctgttttcttctcttgtctaccataacttgttttgtttttttctacctgaattttaacccttgaaagatttcattattttcacatcacatcatcaccttcccctgagcagctgagaccagtttttgctcattcaacctgtttgtgtagtaattttgtgactgattttcttcatgtatgggcaaggaagaagtcatactgtttgtacagttcacatttgggcaggattgggggaaagggggatgaagccaaaaagaaaaagttcttggagccagcccatggggtgcgtgggaggagagcagaaggaattgcaggctccaagcaggttagcttgaaggactcacagtggataattacctacactatatggctggaggagggctacaagtctccacttgcctaaaaacaactcccccgctggcaggccattgaagtgtcactcagccagcttccttacccccagttcccactgctagaggctctccatagacaaagcagggcgttgttgcctagaggcccctgttcttgccggctagcagacacagcactgtacctctcctggggcatgccagtcccccagtgggaataactccctccaccttcactctcgccatcctgagcctccactggaagggatgcttgcatttcagggccatcaccagaaatagatggaagcacatctccatctgtatttgagcctgctgtcatttgcctcctcctaccctttatcactcttccaggctaaacagtcttaattctccgtgcctgctggtttcagaacgtttgctgttgtggccccactcctagttacattctttgttttggcccaataaaagtttgggttttgaagtacactcagtgcttcagattgagctggccccccacaggataggagtggtctgtagcttccctcattctggatgtttgagttccattaatgcgctgcaggttttagagtcttaatagcgtcttgacacctgggctcaaagtagattttaggcagctaaaactcctgtcttcctctaacaagtttggtttatggacccatcaacttgcaatgttttattgtaatctatattagcaccccccttctcaattcacttggtcactttagtcatttggggtctttttggacctagtgatgtagtgttttttattccttccattttcttgtcatatgggaatttgaaaggcaggcatctgtatcccttttaaagtcattgattaaaatgtatgaagaagcagggatgctgggtgggttatcattaccctttgagtatatgaaagggttctgcttcaacttgggaatcagataagaatcctggatctccctttggcttgctatgtgaccttgagccatttactttaacttctcagggttttaatttcctcatgtataaaacgatgttacctcctacttcatagagcagagtgaggaatggagagtatgcatgcaaaccatcagatgtgcctagcacattgtaatgggcaatacgtgctcttttttatcctgttttggaatcacattgataagagtttaatccttcatctgtatgtcttgatgtatttggaataactctgtgtggcccatcagcttctccagtctcctcttttctaggatggagtgccagtgctgtagcctgctcctccagtgccctgtattattctacatttgaactttaaataaagaaagaaagctgctctggatgagcagtagagccctactctagccctctttgattacactaggttaatttgtcagttgataatttagaagtatgacgtgtggaggcacagtggataagggagaagtgtaagagctgtcttccaatagtggaaggactgctagcatggaagaggaagtggacttacttgtgtattcactgaggacaaaataatatatgtccacagttctttatttgtaaatttggaattgaaagatatgtgaaagttgatttttttttttttttggtaaatttggtggcaaaatccaactttaattaatgtgaagttatttatatatactcgttagcccactaattgtgaatatttatatgcttcactgcgaaaatacaaatgtgtttgatgatggagtgcttccctggaccccactggggagagtataaaacacacagtatgtgtgccctatctaaaacctgaaaaattaagttgtaagacgtgcagccccaaggatttcagataagagattaggggcctgtaccaatgagtagatagaagtcttggcaaatagaaccaagtttaaggaagacatcctcacatatatgacaataaaatgagattattttctgatgtaatgaatctcagacacagatcattcatggtggaggtgagggttgccatgaaaccatctattaaggatgttatcaaaggagtttattgagtaggaaactggacctctaaagtccgtcccaaccccgcatttattgatttaaaagacacagttttgccagtgcagtgggcacatgcctgtagtctcagaggcaggagaatcacttgagcccaggagttcgagtccagtttggacaacacagcaagaccccatttccttaaagaaatttttttttaaaggacatagttttagtcctaggtggatgagctccaacagaggtttctctgatagactgagcttacagccctggcccattctgagaattaggccataaactgaacatgggacactatgctggagagtacaggcacctaatgaaggacgagtctgtaattgcttaacatgtattacttgtattccatgattacatagtcactgtcacatttaaataaaagttacatgataaactctcatttaataaggttgatctaacccagtggttttcaaagtgtggtctccagatcagccacatcggcatcacctgggaacttgttgcagatgctggggcgggcggatcacgaggtcatgagtttgagaccagcctgaccaacatggtgaaaccctgtctccactaaaaatccaaaaattagccaggcatggtggtgtgtggctgtaatcccagctactcgggaggctgaggcaggagaagcgcttgaacctgggaggtggaggttgcagtgagccgagactgcaccactgcactccagcctgggcgacagagcgagactccatttcaaaaaaagaaaaaaaagaaatgcagatttcaggctggatgcatctgtaatcccaacactttgggaggtaggggcaggcagattgcttgaacccaggggttggagacaagcctgggcaacatggggaaaccccatctctattaaaaaatacaaaaaattaggtgggtgttgtggtacatgcctatagttctagctactcaggaggctgagcggggaggatggttggagcctggggaagtggaggttgcagtgagctgagattgtgccattgcactctagcctgggtgacagagcaagaccctgcctcaaaaaaaaaaaaaaaaaaaaaaaaaaaaagggcagattttcgctctcatcccatatctattgagaatgctgtagttgagggttgttagaaacctgcattttattaaaatccctccaggtgattctgatgcaggctagttcagtaaacaatatcaactagttttcataaagaaaacctctggagggcccatagtgcctgcactccaggtctcaaagtatactttgagatctaggttatctgccaaggtgctatcctgaaaggactctaaatgagactcgagttgcaaaaacagaatagaagaggaaaaagggattctaattgggatgccaagacaaagctttctgggaagtatgtgctttaagacatgggtaagattttgagggggtacagaatgggatagtattccttgctgaaggaagagaacagtaaaacctcttcattggctggggaacagaatcgtctccagaatgtcagtgggaatacaatactaacaagggagagctcctatcagccggactagttaattatgttttttacataatgtgaatatgaaataaattctttttggacccaaatacctgcctttatccttattaagggtaggcacatcagtctagtcctgtgatacattttggattcctgaagctgtagccccattgcctaattagatcctcatccaaattgtcaataaaaacgtttaccttgaatttgaaatttccttccaggttgacctaaatcctaatactgcttcagtgcattttgttgcactagaaagaaataaccctgatttcatatgtggttttatacaaccagtatttcattgaactcactgttatatcatcataccctatacaacgcaccttagttttttttactgggagtttttacattttaagctttttatgagatatgtttgatacaataagctgcataaaggcagggttttatctaggactcttagcatgtcagaaactaaaaaaaagttatgtttccaaagagcccatgtctcatagaagccataattgtgcctagtagcttatatcagcttgtgtactactcaaaaacacaggcatttggtgggtattcagcaaccttgtttttcagactatgtaggcaatttgtggagattggctttgatgctgttgcttgagtttagagtgtttccaaatgtctttcagccaaaattatgtccagtgatatatggaagtgtgtttttgtggtggtcttttgcatagctgtgtaggcattgtgtagatactcttgagtagatttttatttaaaacatttttttttttttttttagagatagggtcttgctctgtcacctcacccaggctggagtgcagtgccaccatgatagctcactgcagcttggacctccaagttaaatgcctagctaatttttaaaacatttttaaatagaaacgggtccttgctatgttgctcaggctggtctcaaactcctggcctgaagtgatcctcctaccttggccttccagagcactgggattacaggcatgagccactgcttgagtagtttaaattaaaataagctggatgtagtggcgccacctgtagtcccagctgctctggcggctgaggcggaggatcacttgagtccaggagtttgaattcagcctggaaaatacactgagactcctaaaaaaaaagataaataaaaaataacctgggaggaaagatacagtagtttggtgaaaagcttcctaggtgatttaaattaaagaaaatatttctctttagcaccttactaccaccaccaccaaaatgcagtagtttaatattgttcaagaaaaaaaattttgtatgcctcattaattttctttcttcacttgttagtggagtgtttaagttctaagaagcaacttgggaagggcaaggaagggaatgtgttattttacatttagtagcaatttaactggaaagtcttttttttttttttgagtcggagtctcactttgttgcccaggctggagtgcagtggcatgatcttcgctcactgcaacctctgcctcctgggttcaaaggattctcccacctcagcctccctagtacctgggattacaggtgcacaccaccacaccttgccatttttttttttttttttgtatttttagtagagacagggtttcaccaattgactaggctggtcttgaactcctgacctcaagtgatttgcctgccttagcctcacaaagtgctaggattgcaggcatgagccaccacgcctggcctggaaggtcttttgatgagccataaacagttaataatatcatcttaggctgatagtgcagcatcataggactggcaagtaacataagagagcattcttgtgcctttaaggatctcatcaaaattatccaggtagatagttatctgtcaaactcttaatggtctcatttaaggagaatcatataagcagtcttaaataactggttctggtcaccagtgttatcatctgtcctcctctttttttagccttaattccaattgctgctctgcatgtccttgtatgaagggagtgatttgaagggctattttagctcaccctaaaactcaaagggaagtatatgaagtagtattttcctctaggtgattattggaattgatcttatggaagaaaagaaatgaaaaatgggatcactattgaataccttggttgtcattcaccctgtaaatagtatcgttactcataacacagcttaagaggaccatgtttctttcctaaatagacaccatttgttattggtacttgagaaacactaagaaaattgttcaaagcatacacagtgtgattcctatgtgtaatcacaatgtgattataccctactaagtacccaaatttgtatcacattttttgtgcctaggatttgcagccaccttttactaacataaactaagcatgtttctaactttattcaacaattagaatgccaaggtatgacctttttattaatgaggaatattttgttattgaaaagacttacagagaatgagcagaacaaccttagtttcgttgtttatgaagtggaacatgctggcaaggtttttgttctctatctggaattttctcagaatccagaaaagtgttgttttacttggattgttctctctctcctttgcttctccattattcatgaaggaccatgtttttatagaacaaagcattcaaaatttatgcaatccatacatgttttgagtttctaactattacaggaaaaattattaccctgaggcttagagaaaccatgattcagtgatattttttcttcctaaaattataatttgctttggaattccagtgctcttggaatgctagaggtaaagaaagcattctaattggccactggttcttgggaatggaaagggtttgtgttttttgacctccttctagtgatttggttgactaatctacattttatggtagaaacaatgtggagttgaccagagctccatatactcagaaggactttgaagtgaccccagtcctgcagaggtgttaaaaggaactttctgctgtgtattcccatagaagcagcagattcagtaatgagaggagtttgaggaagaatagaagcagaagggatgtcctgattcagctttgagtggtgggaaaggaggaactgatgaagctggtgcccagtggaccctctccgggatttttcctggcctgattttttaaagtaaaaatgttagcctgtaatttggtaaatattctttcatctgtaataatatttatttgattgttagagacaaccacttatgatggacatttttatgggtttcttctcttcttctttgtcttttaatctctattaaaccaacaacaaaggaaatatatttaactgtactgccctgatagagaactcttctcatgatttacaattttttctagtcctgcccatatacataggtattgtgtacattttttagtcttacctgattaggattataataatcaataggttcataccgattatcttttcaataggtatggcttctgtatctttatgtatttgtttgctagctcaaatgaacatattttacatgttagaaaagagctcctttagaatcagccttaaaataagtaatgtctttccaaagggcaaaagaaagtctaaatcataacttcagtcatcagtttatcgtagaaaaaaaaaaaagcccttcctcagtctgcttttttcccttgagaattttaatcccaccttgtttttctgccagtgacttactgatatcttgccaagcttttatgaagtttttttaatgataaataattttgtttatgttgtaatcattgacatttaggagctcttgttccactttgttcatctttttgttgtttttcttaaacccataaccggtgtttagagggcaggactgaagattcttgtgaaggtcctgacttgattgctggactctgctgccactagtaaaatttccttggtgagaactctgctccctcccaaataggtgaatactctcactttcataatagagtttgcatgtgtatttattttgagactctgccattctctcctgagaatggtacataatggtacatatttattatgtctttgaactaatgcactgaacttactggtattcactgtatttatcaattcaaattatgcagtgaataccattatttgacacaataaatataacacataagcaaacctccagtggttggagagttaaggaagtagagcctgtagggctgaaatggtcaggacagaccctacagagaggattcagggccatgtggaaactccagaaaaagggatgcaaggacaaacacccaatccctgacctcattctttttgcctagtcccaaacccttcagatcttaaatttctgtttcccataatccagactttttgtcttgtacaagctacatacccccctgttgcatctctaagttctcttgactgtaattttcctgctatttatattcctaaaatctttggtttcctacagtcacgataatttattttccgcttaaataagtgagaaatggctagatactctgccaaagtaagtgagatgagctatgaaacctgttcagaatactagcagtagtcccactgaggtggttttcaagtagaaagggagaaggagagagaacataacatttatgtcaacacgattgtaattgtacataatttgtcatgagtgaatccctgggtttgcttttttcttgccacttctttctccagttctctctttagcctatccctggagagtcacatgagattcagcttcagtgatatatatagcagcattcaggcagtaaacatttccgtagatgcacaactttataaataacataagtaatttgtagatatttttattcctttagcagtctcctagattaaagggttttgacatgacatgaggagccttcccaaaaaagaacccaaagaattaacttgtcaaatgagaagtcccacgtctgatcactgagcctctccccagttttagcattctgttcttggcctctgggccttcacctgcactgtttttttctgccaaaatgagcccccattacacatgaaaaactcctacttccagctcctatgtctcctgagaagcattcttctagcccctcattggccatataattacccctgtagtatttagtcgatgactcacatacagcattttccacattgtatcgaacgttgttcatttacatctcatccccctcattagattacatacagattcttaaggacagagatcatgtttgtatgactagcccctaaaatagagctacacacacacacacacacacacacatatcagtaaataatagagtaaatgaatgacattttccacctattcttttttttttttttttttttgagagaaagtctccctttgtcacccagactggactatattggcgcgatcatggctgactgcaaactctgcttcccgggttcaagcaattctcatgcctcagtctcctgagtggctgaaaactacaggcatgcaccatcatgcccggctaatttttgtattttttagtagagacggtgtttcaccgtgttggccaggctggtctcgaactcctgtcctcaagtgattcgccctccttggccacccaaggtgctgggattacaggcctgagccaccatacctggctgctttttccacctaatttttattaaaaaagaataaaaaaatcaggaaatgagtattttgagaaactattaagttataatttatcctaatttatgattattccaattgcattttatcctggttcttttaaccacttttcttcattcctatcacaccctaatgtacataccaaagacacaagaagatcaaattctgtaatcagtttaagtcctagttggggacttagatgaaaaattttcagtggagagattgctaaaactgactaaaatgacttctaaagacttataaaaatatccatgaaatctctggttttttttattactgtcaaaaatctagaattggcttcttattcatgtgtattttgcaattaaagaaacttataactggagctttaagtccttagtggaaaatggaagagagtttcagaacatagttatgaccactagactcaggaataggactatttcctgaaataaacaacaaaagtaaaaaaattccctattccagtaaagttgtttcatgtacatctaagtacttaaacattgtaattggcaggttatggttagttttgtgaattttgtgaaaaatctgattggtgttaacactgttatgattagtaacttttcgaacttagagttttaagtaaaacaacatttactttttaggatccataatacacctaggattaccttatacatgaatcactgcacagtcacactgctgtacttaaactgttgtgggtcagttgtttccaaaatttgactactaaactgttttcccaatatgcgtgctaaaaaaaaaaaaaaatcccaaggtgtgttatgtaccaagcaagtgatttttctagaacttaaagttgtaaaaatccctgtaatatcataaaaactatcagcaatatgtacatatctgctgaactttcacaaattttcattaatttattcagtaaattctcaaacactagatattttacctgtaatagtggaaaactggaaaatgatagcatgtggaaggatatagttaaaagagctcgagtcatactactgtaaataatattgatacggccgggtatggtggctcatgcctgtagtccgagctctttgggaggctaaggtgggcggatcacctgaggtcaggggttttagatgagcctggccaacatggcaaaaccccatctctactaaaaatacaaaattaaccaggcgtggcggtgggtgcctataatcccagctactcaggatgctgaggcaggaaaattgcttgaacctgggaggcagagattgtagtgagctgagattgcgccactgcactccagcctgggcaatagagcaagactctgcctcaaaaataaataaataaaaataaataaataaataaaggtacacagatgacaaaattatattgaattgataaatgcagtgaataccagtaagttcagtgcattagttcagagacataattactggcctatcatgggaaaatatgttggtatgttagaattctaagtcagaatgagctaaactctatatgattagccttttagtagagaggtcatttcagatataaccagtcaagaataatgactcccacgggttggtaacagctatgccccatccaagtgtatggaacaaacctagtgatacctagaaaggagtgttagaaaatctgttttagtcctaggtccaagttgacctttggacaaattacttgaagacaaaagaatgtggaaatctgcaaaagctctgcaatcttaaagtgttttcataacttttatgtggtggcccaaactgaccaaaattaagactttttatagccttgtctttcctacttggatgtttcgctaaagcaatgttcatgttccgggcgcggtgactcatgcctgtaatcccagcactttgggaggccgaggcaggtggatcacaaggtcaggggtttgagaccagcctggccaacatggtgaaaccctgcctctattaaaaatacaaaaattagccgggtgtggtggcgtacacctgtagttccagctacttgggaggctgaggcaggagaatcacttgaactcaggaggcggaggttgcagtgagcctagactgcaccattgcactccagcctgggggacagagcaagattccatctcaaaaaaaaaaaaatgttcatgtatctgtttaaggggtatatactccccacactttgctgggggtgttacataatatataatgtgcattctgtattttcatatatgtgaatattttggaaactgaaaaaatatctggctttgtgggtttcatctaacacatatggaccaaaatatcagttatctcatgtaaattagaataataataccatacaatcttgctaagagaaaagttttttgtttttaattttttaaggtagagtctctctgttccacaggctggagtgcaatcatagctcactgaagcctcaacctcctgggctcaagctatcctcccacatcagcctctggagtagcaggggctacaggggcatgccatcacacatggctatttttagtttttatttttttgtagagatgggggtttctctatgttgtccaagctggtcttgaactcctggcctcaggtgatcctcctgtctcagcctcccaaattgctgggatttacaggcatgagccactgcacctggcccagaaaagtttttgatatcagattatagattgttaattttagatttaaagctgatattaggcatcttaaaaattggtgttctggcattatggtagatgtgataccctaagcaacatctgctgaagtaaactaaaaatatggagatacattttactcacacacacacacaaatatcacatatacataatacatactcacaaacatgcatacacatatccaatctgtaaagttttttccccaaaatatacattttgaatgcatccatgagcggactgaaagttaagggtactcagaaagcagtaaatggaccattaaagctggctgttgtagaatgtgatgaaccaggcttcagattctatcttgtagggtacgcaggataaaaagtagactaataggtttaaaaaaaaaaaaaaaaaaaaaaaaaaaccaaccctagcagaaagctggggtcccaaaggctatatctttagagtaaaggcaaactagaaataaacctaccttcccagggaactgcagtgaaaatttcttgtctcaagtgctgtcactgactagaagaagaaaaatgctgtcctgagaattataactgcagctggctttcatgcaggtttgcagtcttagttcatattatcaagggtgaccgaaggaccccaagctgagaatttcctcaacagagatctggttttgtaatgctccacagcatatggcagaagtgaagacagattcattctggaagcacatactatataggcctcaagtaatttctgcagataaacttaaaagaaatggacacttacagtaaagaaaaagaaaaaagaatagaaaatcacaacacacaggaaacatggccccatgagccaaagtcaacatatgcagttgagtcagacaaaaatctttaaatctgtgttgtcgtaagtgttatccaacatggtagttactacatgcatgtgactgttgagcacttaattagtgtaactgagaaactgaatatttacttttatttaatattaagttaaatagctacatagctgatgactattccattgggcagtgcagctttagaaaatagaattattggctgggcatggtggctcacacctttattctcagcactttaggaggccaaggtcggaggattgcttgagtccaggatttcgagaccagcctgggcaacatagtgggaccccatgtctacaaaaaataaaaataaaaataaattagctgggcatggtggtgcacgcttgtagtcccagctactcaagaggctgaggtagaaggatcacttgagcccaagaggtcgaggctgcagtgaggctgcagtgaaccactgcactccagcctgggtgacaaagtgagactctgtctcaaaaacaaaaacaaaaatgaatgggtggtaacagcagattagacctgactaaattaatgaaacgagggatctgaagaaattatgcagaattatagagaccaaaaggaaaattatgaaaggtatgaaaaaaatacgccatgatcaacccagaataagctgatggaactatgataataacagataaaggaagatataattctgaatcattatgcatataataatgtaactttaagatctataaaggaaaaatggaccagaaccacaaagacaaatctactttctagtaagagatttcaacttatctctatcagtagttagtaaatcagcaggagccccctaccaccttaaaaaagtaaataggctataaaagatttgaacaaccattaagattgatcaaatgggttatatgagctgctatatccaacaactctagaatataaaatattgggccatgaatagtgtgttaaaaaacttcaaaggattagttgtgacacagaccatattctctgctcagaaaaccattaatttagaaggaaacaactagaaaaacccttatttatcaataaggaaaactcttcaaaggtcaaagaaaagatttcaggactgaatggtaataaaaagtttacatatcaaaaccagtgatgtgcagccaacaggtacttagaggaaagttatggcattaagtagttataccagcaaataaagactaaaaggtgcagtaaaaatgtggtggatcaaagagaatgaatgaggcatgaagaatgattgtagcacagtgcaggcagggactagtggcctttgctgctagcagtcctttggcccctgtatttttggagagtgctcattgacattgttaggtgtgagttttttaagatcttggccagaaaatgttatccaagttattggcaataactggtctagcaagtaagaacatgaaagtgacaactctgtaatgcccgaaatactgaggtgtaattggcttgtgcattggtatctgtatttttcctcaagagttaaaaaattcagctccttttgttgagtatatcagtagcagcagcattggtttagtaggtagattctcagagtgtagtgtctgtacctctggggtccctgagacatttttagggggtccatgagatcaaaactcttttcacaataatactgttattttttgccattttcactgtgtagacatttgcacttgtatgaaaacaatgctgggaaaactgctcatcacttagcacaaatcatggcctggcaccaactgtagtagaagttctttagttactatattcatcaccatggactctcagttaaaaaatgctagtgtcacttaataaagcagtagaagttattaattttgttaaacctaggcccttaagcacatgtgtctttttaatattctagtgatgagatgggaagtacatataaagcacttttacaatgtggcaaagtgccatggttgtctcgaaaacaccagtatgattgagtttttactttgcagaatgattgacaggtcagctgtggctcttcagacttggttatttggtagacttggttatcaaaagtaagtgaaatgagcctattgttttaaggaaaacagttatcaagtacaaaattcaagctttcaaatacaaattagaattttggaaatcttgtattccgcaacataagcttgacagctttcctatcctttaatgtctcttctgatgagttcagtggtgatattgacaaatgtgattgtggtattatataatgaaacaggtaaacattgggaaaatctacatgactcagtaacccaacatttttcagatgatcagtgtttgttgcaaaatcacatgtggatgagagattcaaagtgtaggactttgatagattaatggatttcaatgtaacagagtaggaaaagttcactgatggtttcagattccacattgcagctgacctttaaaaaattactgctttgtccattgtatcaaagaagaatattcataattatcttaaaaagctattaaaataattctttcctttccagttatatatctgtgtgaggctagaatttctacatatacttcacagcaaattttatgcagaagcagacatgaaaatttagttgtcttctattaagccagatgttaaagaggttttcaaaaacataaaatggtggctggacacagtagctcatgcacataatcctagtactttgggaggctgaggcaggaggactgcttgagtccaggagtttgagaccagcctgggcaacaaagcgagaccccatctctacaaaatataaagaattatctgggggtggtggcacatacctttagtcccagcttcttgggaggttgaggcaggagggttccttgagcccaggagttcaaggctacattgagccgtgatcacaccactgcactccagcctgggtgtcagagtgagacccttcttttaaatatatacatacatatacacacacacacacacacacacacacatatatataaaatatacacatataatggtacaacttcctataaaaatatttatgttcacatgtaacaatttaaacagattgttttttaagcaaattaataaatattttttaattttctcagtttcagtttccaatatgataaatattgatagatataatccatataaacaaaagctccctgggtgtcctcagtaattttcaagattataaatggatgctgaaaccaaaagttggagaaccaccagtttactaagtcaaacttttaggccgccttataggaaagacttgaggctaccaaatgcacaggtacatatgtgtttctttttgtaatgaaggctatcgtgatggggcagatcattcaacatactcccaaacaggccacatcctgaaactggcaaagaccttcacaccttttattgagggttttttattttaatcttttgccttacagtgggacttcctgaaaagtgtggtgattctcagtatttcattttgtacattaccataatactcttacatgacattttgagcatcataaatctgaactctattattaggttcaatatgtaatatggactcagaaatttcttgaatgaaaatttatgatgagaattagtcatatccctagggtttagtcagtgaaaacaaaacctcagtgtgtgcatttaaaggtgatcaggaatagaaattatctattctaaatgaaaggaaaaaagatagaaaatttccccattttaacagaaaacaaagacaaatgatttagaacccaaggactgacttttctcctcaatatgtgattttccatcacctgatgttgaacttttatctcgtatgtgggagttagctttcagttctacacttataatctgtatagctgacctgcttgaaaggcaaagaaattgaaaaaaaatgttttttaaaaaatcttattttcatgtgtttttctttggtgtaagttgcttgactgtatttcatcacaaatcatgtactgtgcggtatagttccctcacaaggatgcatgatgttgaatatacacaaaaaaatctttgtttgaaaaaaaaatagttagaaagttggtgctttaaccaaaaagaagctcaagaatagattagaccgtaacaacaaattatgtaaaacaaaacccagaaaacaggtctggtggacgttgtgtgttatactgtctcattaaagaaaatgagtcaagattgatctaattaaccacacaggttcagtacattttacctactcgagcaggctgcagtggccatctcctgccacagctgtttgtttaaattgttcacatgagtcatactgagaaagagcctttaaaaaaaataggtaaacaaactatttgaaatctctgtcttctacctgacaatcatctaagagaagcattgtaattatgtacttgggagagtccctggcctaaggcctttctaaacctgaggtggccttacatagatatttagaagtaatgtcttttcacatgtcattcattgggtgtatagtgttttatgcagtcttttaccttcatgttagtttaactatagcatgacaattcacagttcgcattaagcctaagtttcgcactcaaaatcatttttgtataaaatgtatggaacttgactgttgacaaatcgatctgttgagtatttttatgtcactgtttagcaaatgcagaaatgtagatttgtgaaaagatgactagagatgaaagcatgaattctttgccaacttccaagttagcagtaagtattaataagctcatcttttagaaaacaatgcaatggaaataaaaataattatttgttcttgtggtatgcttaaaaggatcatggactttggtgaaagatctggatttgactcctacctctactacttgttagctgtgggatcttatgcaactcatttagtctaagcctcgtcactccccactccctactccctaaaatggaaataatgatagcaatctcacagagtagtcattgggactgaacatttatttagcatagtacttggctcataatgactgccccaaatgctagtaatagtaattgtggctgttatcactgctaatattaagttatatttcacaagtgctaattaagtcctgttatcttcctgagccttggttttcttatctctaaaatggggacttgggaggtgatctctaagattcttccagtcagacctttccagtcaccctgcagaggctggcgagctgcccattgctgggacccttcacgcccaccctgatcccctccctgctcttcctccccctccccgcaaagcttctctctggccagttctgctcagcaggaggtcgtttgatcaaagccctgggaaaggtcagacattcctggagtggtgacactcagccggctgcaagagctgcccttacagaaccttgtactgcagaagctgtagctcaaatggagaggcttttctaggagccattttctgagcactgtggcgtagcccagctgggaagaaagttactgaagaacacctgtttgggggtggctgtcaaaagctttgttatgctttcattttcttttgggatgtgcaaatggtgggaatagaaaggtggaggttgaatcttgtcataaagatgctaacaagtggtaaattacactatagttaaaccgtgcaaccattaaaaattctgttaaaatatttaatcacggtaaaatatttacaacatgtcgagtaaattagattataaaataatatcagggttttttttaaaaaatgtttatatgtgaaggtataatggagaaaaattaggaagaaatttatctctaagtttttttctgggtggcagtattaggtaatttttgtttagattttctaaatgttttacatgggttgattctaatgaggagaaacaaaagaaataaaatcaaagaaagaaccttaattgcttatcagatgaaaaggctaacctcttcacagaaaagaggatgtgtgaatgtgaattgtgtacagtgatgtctcacagtgagggcactctgtgtcacacgttgccacctttggcatcttgtgggcttgaagctatagaatgtgaccagtctctttacttgtgggcacttacacagtgcttatgatgtgcccagcactgttcttggcactctaatactaacttattgaatcctctccacaacttgctgaagcagatcctattatccttaccttacaggaaactgagagacagggatgtgaaaacacacagggcacacagccagtgagaagcaaagccaagattcacacccaggttcaccaggccccagaatccaggctcccaccacatactgttccactttgccctgaagtaagactcttgacagccctcagggcaaacagctctcaagttggattttatgtgtgtggccatcatgagggttaattggggtgtactgtactctagtgtggttcagaagtggactcggagggctctttggtcccttctttttgtttgagacagtcttgctctgttgcctaggttggggtacagtggtgcaatcacagcttgctgcagcctctacctcctgggcgcaagcagtcctcccaccccagcctgtcaagtagctgggaccacaggcatgtgccaccacgcccagctaacttttctatttttttgtagagatggagtttcaccgtgttgcccaggctggtcttgaactcctgggttcaagcagtcctctcacctcggcctcccaaagtgctgggattacaggtgtgagccactgtgcctggcctgcacccttttttcttgcttactgtttctctttcctgtcagctgagtccagctcatgtccccctgcccttttcactgtttgagttccaagccaactcccacacagctaccttgatcagatttgactctcttattttacctcagagtcaaaatcttgcctgggcgggagcacagcagtgagcctatagcttaacttggaattgaaaccaccatttattttccttctgtcattgtcagggacctcaattgtctctacaaaaatagctttccataactgctcctcagtagagggaagaaagcagtaaagaggaaggggcactgcagccttcagaccgcaggcctgccttacagccgtgtgtgtgtgtgtgtgtgtgtgtgtgtgtgtgtgtgtgtatgtgttacattataggcagaccttttaacctctctgggcctcagtttccttattggtaaaatgcaaggattgaagtaaatgaatttcaaggtctcactgctctgatgttttgaaaagcttcagtgtatctttcaacattttccattacagattcttttttctcatgctgtaaatgccagaagcagagagaggttagtcttatctatttctacagcagcagctacacaactatcttattctttctctctttaacctcttccagtctgattaggactcagcttcatcctactgttttgatagcaattatctattctgtggcatcagctactatttatttttgagatagagctcagagttaccaattcttgggttattagcacacttgtatttagcaagaccaataatgtgaaccatcttaaaattaacacttaaaaagaaattttctcaaggttacatagcagaagaatgacatggactcaccatagccactgagagagcgggtagcttcccagtattaaaccgaattatatctgagtaacttctcttgatcaagtctcaccactgtttctacttactactactgttcttgccctcatattcattcagttgtgtctattgatctctgatctatttggatagctcatttccaatatataaatttggatacttgcattgtcagtagatactttttgtccctaacagatagtataggtgtgcgcatggaattatatgtggacatagatctttatttgaagccttacaacctaaaatggattataaattgcttctttaaatttagcctcctggatttaggttgtccacagcaggccagtgggagcacaattcggatgctcgtctcctcctgtcccatcccatcccattccgttccttttaggcagcagctccctgccctcctcgagccccataagtgctgctcgggataattccatcctgggcaaatgcagggcagtggtctctggagtttctgttcacagaggaagccggctgttccatttataacaaggaagggtagttctctcagacattgcacatacacttcaacgtgatgtaacctgatagcccctgacggaagtcctaaggctctctctttaaacccttttccagaaggcaaggtgttttccttgctctttggctgctgctcacagtattttcgtgttatctcctcagacattaagtcccatatctttagctcgcagagtttgtctgctcatatgcaccacacttaaacgtccacatctagaaaacactcttgttttcacatcacttggggctgtttccccaaactgcttaccttttcaccatggctttgctgttttcctcattttgaccttttcttgttaacataagatgcttgtgtgttgtttctgcaataaccactttctggaagggcctagttgacatttcttatcctgctgttttgactgtgatgatgatgatcattatcatcatatatatgattctttgcatacaaagtgcttttacaaaccctttatcgtttaggccaagcttggtcctcctccctggcttcttgttacagattcctttacttgactctgataatactttttaaattagtttgcttaccaagtgggttaacaataaagaagagagaaaatctctgaaggacacttttcctttatgtttgtttgcctaaatgctaaataactggcctattacagtcacagagtatgactgtaactactgacttaaatatgctgattttctgcaatgaaaagaatagcttttgataaatgttaataaatagctcaaaatttttgagtaatcataacttcttgaattttctataacatacttgccttaaaaaaaactccagattgctttaaacttatgtgtttattttttattctttgtcttcatatagtggttttttaaatgagtttagggtctagaactaaatcttttacagctgaaagcagaacaaagcaactttcaattggatccgtcttttcttttattcaaaatgattattctaagcacttgtgacagtgggtagctgagtagtagaaatagccacatagtgcttcatcctccttgcctctcttacttttctctcgacatgcatacctgcaatttatccatggtcccaccctcccaacacattactgctgttttgcatttgcccatcctcccatttgaaggagtgccagggaggtcctgttgaattcttcgaagagcagatttgtagttgttgtatgttttggtattttgacagcactagatgcagacttgggtttagggtgctgtgatctgcggcaaaaacaggatgttttaggtgagcctgactgtacaggcagtgggcttgtggcagggtgggtactccctaactttggtccccgtttccctcccacccccacaacaatttctttgtgtgtgggtttgtttcaggacttgtcaaaagacagtcgttcagtaggtgttcccttctcccctgtaacacagctgcggagatctgcacttcccccacccaaactcagctggctctcctccctgacacatgcccctggcagcaactagtgctctggagctcttctaccttttttctgccgttctcaaaatgctatctggttccatgtagctttctttctgatttccagattgaaaaatctgaatagatttactggcaaaatgtatttcttcctctttagtgaactgtatggcactaaacaaagagaatggtttccatcattgtattaattaaaaaacacaccctgtctgtttcactataagaacatctcacctcggatagcattccacagctcagagatgtggcagcatcaggcttccattcctgggcttctgccattctaatgttgtttttcctccaacagggtggtttctgacagtgctttgatgacattgtctaatggtgtacttaatgggtagctgggggatgtcttagagacagataatattttactttgtagagttagactctggtttgactctgccttttctgagaaggctgtttctctacaagggtgtaggattaaaatcaggagcatatactaattatgtgaaactatttgtactaatcccacttgcaggtaatgacatttgtttactgtgcagctgatgctgatttatctttacattttatctagttaacaaacatacttatatatcattacgagccagaaatcattctaagaacttaactaatagcagctcacttaatccttaacaaccctatgaaataggtactgtcatcatgatccttattttccaatgaggaaaaatcaaggcacagaaagaataagtaacatgcccaaggttgtacaataagtgtcagagttgagattcagcccctggcagtctggcttcaggcgtcatcctcttactgcctcatggctgtgtgcccatgggtgggtgggactggccatcacacagtcctgaatggcattgcaagggacatttttctcattgcctggagaaaccaggatcagaacactctaccccaggcatggggcatgcagcgaaaaactgactctcaagcctaggagctatttgtattggctttggtccttggacctctgcttacagaagcagagacctcacagccttcatctgaccacacgaaaaccatcataagctcataggacagggttccagagatggaagcttctaatgccccagcagccacacagtgtgtatcaatgcctgacctcccaacatcctagcaccattgaactcccaacaggtcattaccactgttttttgcctgtttccaacagccgagctctttgcatactcagatcactagctgctgagccttgtaggggaattagggcagggtcgatttcacagatgagaagatacagtgtcaatagtccaccataagactaggacctaaatcctgctgccactttttttgtatgtcagtacttttactttttaacctgagacaggttctcagtctgtcacccaggctagagtacagtggcgcaatcacagctcactggagctcccaagcttaggtgatcgcccacctcaaccttctgagtagctggactggaagggtgcaccaccatgccctgctaatttttttgtatttttttgtagagacagagtttcgccatgttgcccaggctggtttcgaactcctgagctcaagcaattcacctgccttggcctcccaaagtgctaggattacaggcgtgagccaccacgcctggcctgtatgccagcacctttcttgcctccctctacctcattttttctttactcttcctcctctgattaaataaggtaaatggtaataaatgacagttagggctggaaatatatatggtggctacaaaagataaagaatcactttttgcaggcatctcctgttttcccctcctttcctcccttcaggcaggagttgtgtggcctgcaagatggcctggttgctggaaggtgacttagtcaatgatgcagttcattggctgggtccccaggtacactcagcaggtggtgctttcaaagattagctacaggccaatgtgctgagaatcaggataataatgcatctcttgtgcagtcatcacagctttagatacattcaggaaaaaagccagtgggaatggaaggaaggcagagactgtcacaaccacctgggcacatcttgcatttcttcatttgtccttacaggggctctgtttgcatcattaacatgaataattctttcttccttttcattatgtgttctttcatttggtgtatcctatggaaatattgggggtagttattgattagcactatattttgccttggaagaacttagagaaaattactgatccaattttacccaattgttaggtcatctttctatatactagtttacctatctttcatccaatttagtaagtgttcatcttcattgaaatgccataaaatgagttgtaacctagagtctggacagatttcagagatattatggttctaggacctactcaaagtttgaaataataggaaagattgcagtgtgcttactaagcagccatgaagggctgtgaattctgcatattttctgtaattcttactacaaaactgtaaggtggatattatcttcattttacagctgaggaagcagcggttaagtcactcaacgaggatgatggaagggagcagggtcgaggtttgaggccaggtctgtcagtcttgtcgcatacctaggagacccgcatgatgtgcccattgcagggggtggggcacagatcagctgtggtgatttcctgagagaagcagtgataccattcttaggagagtaaagaaagaaagaacattgatatgtctgtctctttagtggggaaaaaagctccattgtgtttttttgctttaaaatatccataaaaattcaatctcaaagacaattgcaatcatcctattagcaaccttctaggcaacagacaagcagtagtttcactaggggcgtagtaaggctattaagttgtagagatagtaaatgcctgcaatgtatcatgtttgagaaaaattctgacttcagagaaacaagaatagtgaaacttgttaattttagaaagtgaaaacatgctctataaggaaatggtttataatacttagtgacccctgctgctgtactcaaaataggaaaggcagaaacatttaacagttaagtattgtttggagaatgttaattttctacttggaaaactgtttgccaacaatgccacctgccattcttctgcatctcccctcctactggaggcttcgtgctcttgctgaagagaacagttctaatacaaatcctcattactttccctttcacacctttcccccactagactttaaaagtgataattgcttgaaatactgggagaaactaatttgtattggtaaagctcccgtgaacttcaaacaaatctgtgttctctaatggtgacttctttttaattatgaggctgggcaggtgtgtattttgtagacctgctgtgcctgccccccttccccaagagcctcccatctcagcctgggacacttgatgatggaaaataacttctctggattaaaaaaaccatctctatgtatacagtaagaggccatagtttagaacctgagggaatgtcttattcagtaccctgaatgttttgccttctgttttctagattaaaacttacattagatgggagtggtaatatctagtgcctattggtcaccattctaagcacttcacatgttttgttttaacacttacatagtacttgctatgtgccagatgctgttctaagtggtttgcaaatattaatgcatgtcctgctcatacagtccttcaagggtcactctgttcttaataccattttacaaatgaggaaaaactaggcacatggagatggagagacttaccaaagatcacccagttggtaagtgacagaagtgatattcaaacccaggcagtctgtctctggagttcatgcttaatcaccttccatactggaaaacaacttgtccctttttcatttttagaggcctttctaggtgattacagcctccagcaagtcaacagcgtttagcttctgtctgttaataattgaaatgaattgagcgccgaggaagtgctcaggctaaaaacactgagacgtaatagttgatggccttacaaggagtggatttctcttctttcctccaatttaattagttctgcacaggggctaactgaaatatgcctaaagattgcatgcccacagcagataagtagcttctagcagatttaacaaattaccctttgtctgccaagctcctttgttatcaaaactacatccctaggtagaaatgttaagtttttgcacatcaaagtttgcatgctaagctggggacactggagagacctattgaatttgatccttggtctggttccaatcctgtattcctggttgcagatacaaaatgaaatacacacataagtcaactctatttgtacgatcttcagtccagatctttttaatgtaattaagagggtaagagtatgaaggaggagagagaaacttgcagctcaacaggaagagctcgtttgcttgttttctgtttattttttatcctaatatttaactgctaatcctaacgcagtgcatgtgtatcttataaataaagaaactgagaagttagtgatttgtattggtttcttgagtgatcctgtttaccacatggaaaagtctggtgagatgaacaagtgggactgcagcacttgcatgtttctcctgacagtgtggctgctcttattttgatggaagtatccccagttccaagaccactggacatctcccacattttaatataatttattttatacatacagaaggagaacagcatctttatgtcatgctttaggttggataggaaaaatcaagtccagaaaaatattattagcgctgcatctcttaaccaggtcaggttgcaaggagaaagggtatactacgagtgagtcaaatctagaagaagctgaaagtaagaaagaggtgctatgacaaactgattgcagataagatgatgataatctaagacctttttttattaccagcacaatgttaggcttgttacaaaacagtcatctcttgcaaagcacctgaaggttgatgtggaaagtctgagcaactggaaaggaaacctcaaagtcgaagcacactgttaaaagctgtgtatcaaggttgaggtcctttgtaactatacactttccagagtgattgaatagatggttgggtctcatcgaaacttgcatctctctcttgaattaaagcgaagaccagcctcactttgtagcttgctttgcttttccctgtccctgcccaggagacctgtccctttctagcccgctttagcactgtggatgtctgactctgaattgaattgtgagagctgtgctttctggggatctcctagctgtaagcatctagaagatcagtataagcatcttcatgtggtaattgtccttttgagttatgtgcctgtagtaggttttctgtctgttgttctttctcttatcagtaacggggaaaatggcagtgagaagcagcatgttggggggcgggggtgaagagtgaaattggactgttagactccatgatagtcaaaggacataacatcctattttactgtccttcagaagagctaaaatgttctcagagagtgacaaaaagatgatagttacttccttgacagcaacatagggagaaactttatgaaaagctagaaaatttatatgcatctgacttcagtgactatccaaaataaatttcaaagtatacaatttttttttttacaagacagctcaagtagcaccaccatttccctttaaaaaaaataaaataagccttttccctgattgtaaggattatgcacaatattctagataaaaattttggaaagcataagagacgaaaattacctatagtctcacaagttaatattgtggtttacatttcagtgcatatacttctggtctttttttctctttgtagactttctacgaaatttcatatttttcccagaagtcaggctgctagatctgtgtgatctttaccaaaaaaagaaaaaaaaaaaaacacctttctctgtctctctgcttataaattctatcaagtttgcctgcaaaggtcattgacctcagctcttcttccgaggcatgggtccatatattcgtgcagaataaaaccaataaaagtcataatgaggggcagagagagtggattgtttaaaggctcagtcctttcgagcaagatcaatgagtctttttatcttaagaggcatgtgagatgtggggtttttttgtattttccaatcatgcacaagtgaccagccagctgttggactctgggtgacaatgcttgtatctgacctgctgtctgattttttctcattcttctgtcactacccatttttcaacctgtgtccgcctccatgcagatgggtttcctctctctgtgcactcacagaagtagaaaaggaatgtaaatatgtgtaaactccccttcattggtgagtgtttttagatgaccatgtaatgtcactttttcttgcatatttttgaccaacttgactgggttttggaaaaataatttgtatttctcccactgatctttgcaactcatccaggataggtagtcttctggagctatgggatggctcggaaccagaagttgagctttagagtctagtgctggctctaccactttgcagcccgatgacctcatacaagtcactttataacttgtgttgcatgaaacgacaacaaaagtaccctaatgtgtgtacatcagtgcaccatattgtcgctggcttgcttccactggacactgaaaatgaagcccatcatctttcctcatcctgcctgcctgccccatcctagtccgtaaaggcagcctcaatcttgaaaacctggaagcctctttctcctggcctttccccttcacccggcacacccaggctgttactgtcttcttcccttccttattacctcctgcctggagtttcatctcctaatggctggttttgttcttaacattacacattataggtgtttgcatatatgtcttacctccttgagtagatactaagtttcttgggaatagtgatgagattttacttatctttgtctccttgtcatgcttccttgggatagcaccttaacatggtaggcatttatttacttaagtactttttgagttggataggtgaaattgactgatcagaccgttgatctccctgagccatatctgggctcacctctgagcatttgtgactgggtctggtagtagctttgtatcccaggtggggcactggattcggggtggcaacatttggagcccgactgcagacccagctgcctgacttgtctgaatatcactttcgtcattgactgactgagggtggttagaatttattgaacgcttaggctccttcagctctggaattctacattaataaactgctttgcacttgattactttgaagtggaagtttcccccctttctttataaggtaaatgaatatttcatctcaagcccaggagtcactttgcacatatcctgtgatgggaggctaatgaaagctttgatagagaccttaaattgggagagatgggatcatatccattgctctatcataagaatttcaccaggtctatagagaaacgagatagaagacttaaaattttcattcatagctgtacaactcatgatttgaaacattattaaaattaattttgaaaacacttgggaaaatggagatgtttgaggtaaaaacaatttttgaaattcaaagagtggcttttaaccttttcattagaaccctagtagtcttcttaaggagtggatattaaaagcgggttcaggctgggcgtggaggctcacacctgtaatcccatcactttgagaggctgaggcgggcagatcacctgctgtcaggagttcgagaccagcctggccaacatagtgaaactccgtctctactaaaaatacaaaaattagccgggtgtggtggcacacgtctgtagtcccagctactcaggaggctgaggcaggagaattgctggaacccgggaggcagaggttgtggtgagccaagattgtgccactgcactccagcctgggcaacagagcaagactccatctcaaaaaaaaaaaaaaaaagtggattcttcatgcaattttaagtttaaaaaaagcagtgtttttaaatgtaggaaaaacgtaaacccatagtattaagctctgagggttaaatatgtatcgtttccaggttattgatgaagactaactgggcctgatgacagagacttttgctcatgcctgtgattttagagtctgcacgttctcttcagctcccgtgtcacatgcctatctctcacctggcagctgagaacaagcctagaagacagtgcggactcccaggaggcttgcacattccctaattgtcctctggcagtttggaggatacctgaaaaggcacacctccaactcctagctgtcagttcaccggcatgcccccagagagtcagattgatgccatttatggaactccagagagagccctggaaggggaggggcaaggaaaactaataacagcccttttgccatcatggggagataggcccaggaattgagggcggggagtgggaaagagcattcataggtatgtccttcatacgatagtttgggtgtcacctgtctgcctaaacatatacaatatgtcgtactttgctgtgggttggacactggttatatagcatcccaattttagcttgctggaattcccctgtcatcactacatgtgaaattacaatgttcagagatataatatgtatattattattatataataatttatatatatattttatatatataatttatatataatatttattgtatttttatatatatataaatttcacttggtaaaatttcacttggatttgccttctgtataaagtaaaattagccttcaatcagtggtttttggtatattcactatgttgtacaactatcaccactgtctaattccatcactccaaacagaaacccggtatctgttagcagtcattctcaattactgcctccacttagcccctggcaacccctcatctactttgttactatgactttgcctggtccggacatttcatatacatatacatatacatatcatataatatgtggcctttctgtttatggtttattcacttaacagaatgttttcagagttcatccattgaatgtcagtactttcttctttttcatagatgaataatattacattgcattatatgtaccacaatttgtttatccattcatcagttgatggacattttgagttgttttcagtttttaacattgttaacatttgtatatgtgtattcatgtgaatatatgatttcaattctttcagaaggagtggcatcactgggtcgtatggtagttctatgtttacctttttgaggaactgcaaaactgttttctatttcttttgaatatctttaaacctcaaaacatcaactacttagaattttttaagaggaagagggagttaaattaacacttttctttagagaaaacaactgaattagtagtaagaggagaaggaaaaattcaggttatgttaagcaaaagaaaacattatttacattgacttacagtgtctccacatttacacattgaaatgattaaatagggtgtgtggagaaaatgaattcccacagatcttttaatagatatatccaaattccggtgaaatcagttgtaattatggtcaagaattagatgtaacaaggtagagaagatatcttgagcatttctagttagctggaagaattgagagcgtgaagaaatttgtagcgtaaactggaaaattaaggggaaggtgaaaaacataggcacataaattcattccttaaaatggatgtttctttgttctgtggatgggatttttctgaatatgcaagaatagcttacattctttcttgacatcccatttatcagcttgtcctgggaatcacaaggcttgtgaataatatactgattgattgtactgttcattagcacattcacatgatattacataaacatttctaaaacataaacacagatgatgacagcattttaggaggaaggcgaaggttccatagtgatgctttgttgtttggctgcgtgtttgcagcttgacaattctcactcttgcctctgaggcctagtggcccactctaggtcaacttttgagacccacgtagtgacgggagctgcgtgctcttagagaaccagaaaatgggctgcatcatggtttggtgaaagaaaacaggattgagttctactgcttttggactttgctgagctttcttgtccttctctgaaacatgggatatttattaatacctttcttgcagggtgataatgagatccaaatgagataagggtcatggaagcactttgtaagctaatgtaaatgtgatggttttcattattgtttaattatagctttctccctcaagacatcacccttttgttggaggagctcattcatagctataccacactgccaaagatgtgtcctctttgaaataaagtacttactggagacttagaatccagaccactggaataagacaggactcttattccatatttgctgtatgtaagaccctagctctgtaatcatacaaggcatagaacttagaaccactgaacatcatgtccctgtatcagctggagtctttgcactgactttatgtctatgcaactgactctaggtgcctcctatctccttcccttcttctgagactgaggaatgccactttcctcatcacagacttgtccaactgagtttttctgtgaaggttaatttagtggtagagattcgaggcaggtcaaaggcacaggagtacagagtggtgcctttgctgaagagaaagggcatagccctttgtggaattttggcaggatgaccacgtctcatctgtaggttgtaatgattagcacagccttacaggtccctacgctggaagaaatcaggttagtaataattttaatgagaattgaagtaatgtaatgacagaatgctcctgctctgtgtcttaaatctgttctgtaagctttattgatgttcttcaaattaccatttatgttctttcagattcccagtgcacgttgccattaaaccagtgcctaccatcagcaatgtggcattgatccattttaaaactgattcttaaaatgttcagtaaataagtccgtcctttcttttttttttttttttgagaccgggtttcactcttgttgcccaggctggagtgcaatggtgtgctatcttggctcacttgcaagctctgcctcatgggttcaagtgattctcctgcctcagccttccaagtagctgggactacaggcgcatgccaccatgtctggctaattttgtctttttagcagagatggggtttctccatgttggtcaggctggtctcaaactcctgacctcaggtgatccacctacctcggcttccatatgcagttctttcttttgctttcctgacttttttccatagctgcttttagccatagtgtcagaactacaaaatattagagtgttgaaattcaaagctttagaatttcatttatcatttgtggatagcaggaatccagtgctcacactttatcatttcttgatagcaggaatccaatactcatgggtcgcaaactccaagttgttgtacacaggaacttgcctacccactcctctcacttctgtttaccattcttgctacatgcaagagtagactgtcttgagaacattcttcaataagcccttaaattatttttacttctttacccctcttcctgagattcacaatggttttcagaaatccctaagctgattttcatattctctagaaagaatttgtttcttgagtgaacctgctgcaaagacaaaagtgtctcatctttctctattttaatactgtatttagcccaatgtcagcttctgtgcatttggcctggacaactgcgctctgatacactgcctcatgtcgaaagctgcattaattattctttaatgcacttgtgaaagtctcaattatttgctttttttgtgtcttatggataactttctaaaataatcacatcaaacgttttacattatgccttacattaacactttccttgagaagtaaaaggaagaaaatacctgtgaatcttctacaaatctcttctcattgctgtgcagtaaagttcctccttgtatccagtgactcaaacccaatgctgtctagacccaaggcaaggaaccagacagagtaattagggacaaatgcctacacatccctccagtgttagcaggaagtgggtcatgaagcaggtcaccccagaccatgttaaatgataatctttgaaatttttcatctgaaatagtttcagacagagatcaagattatgatcctcttgtttgtcaaagaaataaataagagtttttcacctagtaatttaggaagggattcagtgtttgccagtggggtgctgttatatgtgaaacaattagctcaagggagaggggacttttcacatgtgccaatttccatggtataaataatcctaccatgaccaatttcaggctaccaacatgataacaggctctcaaaattcctgaaaatttagccatcaggtctctgagctagaacaagccggctcctggacactactgtaaattcagggtaatgtagattgctctcgggaaagatacataggttaggcattcagtatctgtcttgaattcttcagcatgttcccctaaaagagatggaaatgaaaataaacttcaggaggaaaattttctatttttaatacatggaacaaagtggagtttatctttgattttatattcacagaaatgccctttttcactagcagagaatagctgttgtctttgctactacagttttccatgggttatagaatatttcctttttataatttattaatagaattgaaagtcttttaaaaggtctttaaattttgcttcctcttttttgaaataaatgttttcagggaaaatgttctcttctggcttgacttatttgagagctttaagatgaagcaaagttacatagaacccagtttacgtaatctgctttctttctcatttaagttttcagactcaattccaactcatttcaggttttgtttttaagtctataacaaaaggttatttttttcttgactcatataaatatatcctgtgaatagtgttgtctgcagcatcatttttcactcaagataagctctgctttttcttcctagataatgtgctatgatgtgaaatggaaaagatggttacttgtcaaggaatgagttcatcagtaacttgtaatgaatctgaaaatgtgtgttaggtatttgtaaaagttatctgagttgactggcaagttgaagaagttacatataactgcttcaagacacacaatttaatcataaggatcattctaccctgcttttagtaattttttttacaccataaaatgaaaggttatagttctgtactagttgtcatataaatatttggttttaaatatattgactttagcatttggagaaatacctaatgtagatgatataggttgatgggtgcggcaaaccaccagggcacgtgtatacctatgtaacaaacctgcatgttctgcacacgtaccccataatttcaagtattatttatatatatatatatatatatatatatatatatatatatatatacacacacacacacacatacacacacacacatatacacacatatatatatatatacatacacatatatatatacatacatgtgtatagacttgactctcagtatgggatattgaaatgtaatgttaaattaccagctctgccacttaccttctctgattttcagtttttttacccataagagttcttttccatacaaggaagctttgtttcaaaaacgccaatttttttgtttaagtcaaattggagtacgagacagaaagggggcagtcccacctacaaatttttaaactgtaagcagaactgcctgatagaaatgtagtgcagatcacaaatgcaagtcatatatgtaattttatgttttcttaagctacatcaaaaggtaaagacaggtaaaattaattttagtaataaatttattgaacataatatgtcaaaaatgttatttgagcatgtaatcaatataaacatactgagatcatttacattattttcacacacagtatttgaattctagtatgtattttacacttatggcatgtctcaacttggactagccacctttcaagggctcgacctaatgcctaatggctaccatattggacagcacaactctacaacgctatagaatagctttaatgctgatcttacagtgtaaatatcaaatttacatgttcatagaaaatgatttgagttttccaataactttacctctcaattattcatacttttagtcccaatctgactgatagtagctgaacccaagtaacttgttgtattttccccatttgatttctgaaaggcacttcagaagttctatagaaaaatgaggacccctgtagacataaatgttatcttttcacttactaaaacacccaattttaagtagagaatactgtatatatatggcacttattaaaatcagagaaggctcggtgggacaaaattgtacacataagtatttctgttactgtcctgtaaatccttcacacctgatcttaaagaatcagttttacttaaactaaaataaggcaaatgcttttcctagaaacttaagtgtgaaagccccccctttgaatatgaaataattagatttaagtctgttggcttcgcttatggaattttgcaccctccatttgcagtctgaacatttaaacagaccatctgcacttcgtatctgggtaactgtgggacttctctgaccttgaccttgggcagactgtagcttgccgaaccccacccccacaaccccgccacaggagatctagagtccatttctcaggcccaaccattcattgtttcctgctggacattctgagtgccaaggagagcccttccaccctctaaactgcataatagagaggtgtggctgtggtggcagtgggaagtccctccctctgaatatgccatccctgggcagtggaggagagaggcttttcaaccaacatgtccccagaccagcaccagaaaaccttgttgagcctattcaggattgatggctgatgaggttctgaggaaatctttctggaatttgtcccccctgaaccaacccgccccaaacagtgccctccctctctggttctggagtccctggggttgcctcatgtcgcctccggtctgagctctctggatggtagacagagaaagcttttgctcctgacttctcactcactttaattgatttgtttaccttccattattttccactgacctgcacaaatactactttcatcaagctgactacacttcagcttattaatcataataagttattatgcagtgattggattggtaaaatacttctctcagaataaggcagcagatattaaaaaatgtctaggttttaatcattatgggtacataataggtatgtatatttatggggtacatgtgatgttttgatataggcatacaaggtgtagtaatcatgtccaggtaattggggtatccatctcctcaagcatctatcatttcattgtgttaggaacattccaattccactcttttagttattttaaaacttacgataaattattgttgactatagtcacgctgttgtgctagctatcaaaactagatcttatcctaactatatttttgcactcattaaccatccccactcacccaacccccattccaagctgctggtaaccatcattctactctgtatctccgtgagttcaactgttttaatttttagctctcacaaatgagtgagaatgtggttatttgtttctctgtgcctggcttatttcacataacataatgtcatccagttccatccatgttgttgcaaatgcaaagatgtcactctgttttgtggctgaataatatttcattgggtatataccacattttctctatccattcatccattaatggacactgaggttgattccaaatcttagctattgtgaatagtgctgcagtaaatatgggaatgcagatagctctttaatatactgatttcctttcttttgagtataccgagcagtgggattgttagataataaggtgataatatttttagattttgaggcaactccacactgttctccatagtcatcatattaatttacatttccaccagcagtgtacaaagtttcccttttctttatacccacgccaccattcgttattacctgtcctttggataaaaaccattttaactggggtgagatgatgtcacgtggtagttttgatttgcatttctctgatgattaatgatgttgagcaccttttcatatacctgtttgccatttgtgtgtcttcttttgagaaatgtctattcacaccatttgcccattttacaaagggattatttcactttttcctatagagttgtttgagctccttacatattctagttattaatcccttgtcagatgggtagtttgcaaatatttttccccatgctgtgggttgtctcctcacatcgttgactatttcctttgctctccagaagctttttaacttaacgtgatcccatttgtccatttgctttggtaaggcagcagctttaaatctagggatcatgggccacttctttccctgtcctcccctgtgcatactgcaactcctctgccccaacccactgatgtgtgattgtatttgtgtataaaaacatttaaacacagctttcatcttatttttcatgtctgtgatccagaaaagatgaaccattggattctcgctctgccccacgtccttccactgcaaagttttccataccccatagaatccttgcaccactacagctagtggtccaggcaggcagctgctactgctgctgctcttcctcctcctcctgtttctccttctcctcctcttcctcttgcctccttagaatctggtgagaatctggtggtcctttcttttacttatgccccatccctctatttgacctctgaatcaaccactgtaatgccttacttgtactattttaccactaaatagtacaagtaagtaagttgcaaatgttttagtttgtttttttggctcatttatctggaatgactccagttccttctcttaattttcaaagtattttcttcaacatgaaaaattaatggagtacttagatgattaggggtatggtgagggtgttgtgaaatcaatcaaataataggatgttgcaactttacataattagatgtcatttttcctttaccctgatctttcctcagcctctaaccttaaccccagtccctctatttacaggctccagttactgaaaacaatgggtctccttttggctcccagaatgaattattcccagagccttgtttccttctcgataaaacagaaatcttaacacctaacttaggtatggctttaggattaaatgacgtaatgtttggaattcaccaccttacagagaacttggagaatagtgggttttccatgcgttttaaaagggagcccttccagcattctgttgtagtctgattgcctctggtaatatcagttttctccaagtggtccactgttcctctctagatgcttcattacagttgaggccacagcaggccacattcacttggttggggggtagtttggaatagagatggagagaggagctgagcaccaaacagtgtggggcaggaagagcagggactttggtatcaaacaaatgccggcacagatcctctctccactaattattacttagctctgtgttcaaaaagactcagccttctcatctataaatatgggggtaataatacccacttacatggacgagtgccagagtatataaaagcgctactgtaatgactggtacttactaactgtgcaacccatgttaattcctttccctgtgatatgttccttcccctcttaagaaaacatttcagttgtctgatgatggtgcaggtctctagaccatcccttttcctccagagttgggctcatggaccgtttgaatcttaagatcctggggcctcgttcttatctgaaaaatgcagctgcatcaccaccagtagggggtcttacatttgaaagccacatcagacctgaagcaggtgtttggctttggtggatcttaggaaatatttccagtaccttgtttctgaggtctagatgcaagaatcaatgtatccttttggagtaaatctgcctctctttctgggaaggcttgagaagctcagattctcagaaaaggagggaaaggcgcagcatgaagttacatggctttatgtcacgagtaccagacttctgaagtgtttaatgaaaagcaaaaatgccaccataacaatcaaggccagatgaaattcctcatctcaataagttgatgaagtgttaaaattcccctggattcagttattaccagaagattattgattaaatgcacagccagttgaaactccagacctttatgcacagccagatcccgcactttgggtttagtttagttagaacctggagatgtggaaaatgaggactagctaccaggacagcaggtttctcccccagttactcctctatccaggaggccccaggccttagccagtagggagttgaaccacctttttagttcttcccagaaccacatcctctgaggctaacagctttcatgacaccttcaattcctgccagtggtgagtgggtcatttctgggaatgctgctttgggggtggctctcaggatccctaagtggcacccacttcgtgtccacaggaggtatgggttttattggctgtgatgccaaagaggtccttacctgcagggaccagcctgggtggcagccaaccaagcttccttggcatgttttccagtcctggagagaaaggctgcagttgagtctccgtagctttacccacttctgctgaggtgcttctttgtctcaagtgattcctgtgcctgggacagagaccacacagccatttcatagatgtcacatgctctcaggtgtggcccaaatggtcacctcagtgtccaagattttatgaacttggctttcaggaaggccacatgatgtacaggtaatgagcttggcctctagagccagacttctgcatttgaatcctggcttggctgcttgctagagcacatacccttcaagaatattttcttctccatgcctgtttcctcatctgtaaaagggggataataatagtacctgcctcaaagctgttgtgaggataaagtgcttagcacacagtaagcagttggtaagtgttaattgctgtaattactatgtattatgtgggtaggttggcctgatggtgatttgcaaatttaagaaagggtttcaagcttctccctaaacagccatccttgatattttctcccttttctttctttcttttttttcttttttaagtatctactctttttgtcttttcctttgctcacccaccaatcacctgcctgagattaaagaatgtgcagttggaatcagaaaccaagggttttggcctaactcttactgccttgtgagcttaaacaagtcactgaacctctgaccagaagtggagaatttggggtgacagggctgccaggtatctcgtaaagctggagtaactgtgcatcctgtgaccctgggataatgaaacagagcacatattgggactacctggtgattctcaactggaagctaagacttacctgattgtatctgtgaatcaaaaagcaggtgatttttaccctctctccctccttccctcccttacagcgagatgtgtagtaggaaaagcacccgagtaggaatcaggagacttgggttctattaagtgaggtacttactatgtgtacagtagccagcacagagtaagagccaaaaggatcgaacttttctactgctgattccactgtattgggcagcccagggggttcattcccattgtattcagtgtccctgcgttactggagttgtgtagtgagcaggactgtactattttatacagtagtcctggcttgacctacccattccctggtgacctctgtttctcggcttccagtctgtaaaattaaaataaggaactaaaataagctactaaatatactttaggtttcttagagcttaaacataataaaaaggcatatacttagatacacactttctcctatcaccaggttcattttcttcatagtacttgatgctgccttttcagattttgcttgtcttttttttttgttttttttttttttttttttacatattcattgtttccaatacccaccccctgctgcctgacgccacttccagagccccagaaagtaagctgcgagaattagagaccttatctgtgtgttggtcattggtgctagaatagtgcttgaaacattttaggtgcttaataaatacacacatatgcacacgggcatgtataactctgcatgtgatgtagccacttaatttgtctacaaacacttagatagttggttgattattcttccgcttacctactccccacaagaaaatatataccacattttattaggagattaaatgaatggaattaagaatggttttactggctgtcttaaaacttaaccaaagtagcagtgccagggttctcactttgtgtgtgcacatagtgtcaaggggcagtaacttgtgaaatcagaggaagcctgcagatttttgggctgaggaatcttgactgtgatgatgatgtgccacatatccgcagtgtaagttggaatccactttgttctgtttatatacatagtggagatggttggcaggaagcaaaccataacccttggaattctgctcacacatgctattgaaatttcatattacttttattatttggccacaaaaatggacataatccttgttggctttaacacacctactagtactgctttcgctatccatcttgcaaaatataagacaaggccaggcttaaattaaaatcctcggcttcttatctctttcccacaggaaagcaaatctgtgttgaaaaccgtaaaattaagaggagagcaaggatagcataatttagcaaaaattcatggcaccagattctgagctatatgactggagggataggtcagacattaagaagatgctgcctgctaatgcaagttccttaaggtggtgctctggaaagaaagaatatatccagaagatttccacagtgtttactctttataagtaccctaagaaaatatctttgtagattgtttggcaattatgcttatttatgagacttttaaaatgaaactgaaagccattattctaaagtatatttgaaatctatcgattttaacatttgggcgttgagatttgtgtttccattttcaaaagagttcataataaactcctcctatcctcacatctacccacccccacttctagcattctaaattccatgtatttaagaagcttattctgttatttggaaaactgtgtcattaacactcgaaaagcattagaagatttgtttaaccttttacacatttatatgcatagatgtttgtgctgaggtgtgtagagaaaaattgtgtggctatgataatggcactctatttaatatacgccaaaaaagctatatgagctatgcaagttttgccattaaagaagagctgataattataaaatagggaaaatctagtatggaaattatatcattttccaaaaaaagtgtgatttttttttccttttttttccccccccgtaagtttcttttggatggaggttgtaatgatagggtataagaagaattactaatttttcttataagatagggtataagaattctaatttttctaaggggagtccttctcattggagccacatattttttatggctaatttgtaaaaaatattaagttcaaaattagtgtatgtcgtaggtacagccaccatacacaagtgtgttttgggggccctctttaaccattcagatatggacttacattttaagcagttcacattgtgcagttttaggcacttcctcaaatttttaaaaaatatgaatatttgcttcaggagaaaactgatttcacatgcattttagtcaataatatagtaagatcttactaattcaaactaattatgatgaagacatgtctgaactagtgaattgagcataatgatatgctcaattttctcttaaattcatgttacccattactatagtgtttttaagtagagattttcctgcaactgctttaattattagattagtttaaaatcagaaacaaacacctttaacaggtatataattgtgttgagtccctttttctttggtgaagggtttattgagtctctttaaaatgattcccctagagaagttgttaatgggtataaaaatacggttagatagaaggaataagttgtagtatgtacagtagagaaattgtagctaacaatagattatttaatagctagaagggaagaattttaatgttcacaacacaaaggaaagataatgtttgaggtgatggatatcccagttatcctaacttgatcattccaccttttatacaggtatcagaatatcacatataccacaaaatttctacagctatgccatatcaataaaaaataaataataaataaataagtgattttactaattaggttaaacctacttaagtcttctttatattttttaattacttagtaagcacttttgggttggggggaacaaccttaactttgtaaccaaagtaatcacagatttcaaattgatgaagtccaattagataacttgaattaaaaagtgtgactgttgacttccaaattaaataataaaatgtctgtaaacaagtataagacatataaagtgtgttaaaatatacaattttaacaattaaaaatattattaaagcagtatttcagctggacacggtggctcatgcctataatcccagcactttgggaggccaaagtgggcggatcacaaagtcaggagttcaaaaccagcctggccaatatagtgaaaccctgtctttactaaaaatacaaaaaaaattagctgaatgtggtggcgggtgcctgtagtcctacttgggaggctgaggcaggagaatcacttgaacccggaaggtggaggttgcagtgagccaagatcacaccactgcactccagcctgggcgacacagtgaaactccatctcaaaaaaaaaagacagtatttcatattatgcagttcaactcaagattggaaattcctttttatcaattaatgtttatggaaactagagaagcagaagatgaactgaggagggccaaagcataatggctagtcttgtttgattgacaaagctataaaactcgaaagaatggtgtaccatggttcttaaagatgtacaacatagagttatgaactctgtaagctgaggggatatcagtataggaaatttatatttattgggtttaaaaatttatcctttgaattggcaatatttattcatttatttgctcattggacagttttttgctttttgtgccagacatatgtagtgaatacaaatgttgtaaaacattcataaattttgctgtaattcgctctttattgacttaacctgaggaaataatctaaaagagagtataaatatatatgtacagaaattcatgccatatggaagagtagtgatcaacctaaatccctgaagagtcactggtgaaataactgataactcatgaatatcagtgacatattcatatatttgagaagtatttaccatggaaaaattcagaaaaattctaaaagagacatttccacctgtccaggtctgaaggtgattcttgggttatgttgatgactggttactgctgctgtgtgaatttttttctttgggagaaaagactggagctgggcatccatattaactattgaccttgtggttactttgcagtcaaataaagtgcccgtggtgcagccatcccatgcggtccatcctctcacccccctcatcacttacagtgacgagcacttttctccaggatcacacccgtcacacatcccatcagatgtcaactccaaacaaggtgagagtccctgtctttccaggccctttttttttgccaaatgaagagccaaatctcatcagcctgagtgaccctccagatgccagtgctccatgtcactgggtggatcagaatgtgtttttacaagacaagagtaattcatttgatagcaattctttggaaacacacaagaatctgttacatttattatgcattattaaaaagcagaagaaaagcatagcagggccacaatgaatgaaaatctttcattcacaatgtaaaccaatagattgtgcaaatatactaaaaagtcagtactctacaatattcatttatttcagcatgtacaagatattgatgctggtaattttaaaataggaatggggaaagtaggagatttttacttcagatgttattcttttgaatctcttttggttattccattatatccctatggtgtttcatcttttgttatttaccagcactaggttacatattctacataatcattgatgtataaaacctctatttaaagtccaagaatcgtgaatcttattttacgcctctgcattaatatttgcttctactttgtttatagaaaaaatatatagtgcaagaggtctgaaaaattaaaacatcctgtttctgcctgatgtgtacgggtacgagttgggagtaggacagagagctctggtgcaccaagccttctggtcccatcactcagggcgcaaacctcaaggatggatttgctctcagggtggctcgttcctctttgcatgcacatgcgcacttggacttcaacagggtctttgaaagttcaaaataaaagattttaaaaaatgtgaaggcagagaacgtaaaggggtaaaatttgccactgcctacattttacccctttgtccatccctttctgggacttacaatggacaacaaaatttaatgactgtgtgaaaaagagtggcatagaggctgggtgttctttccactactggtgaacacttctaggttaaatacttaacgctttcatttcccttccttgttaaaacagaatgcttatttaaagacttagttactagtgcactagacttgaatagagtctgagtactttgaaaagttgagaatcaccgatgcagacatttctaggtttgcttctgttttattttttaatcctctgtccttcctccaccctgcttcctttaatcaagagcctccaacaaattaggaatgtccaagagtcaggtctatggctgtatagtgagaaagggaattaagataggggtctcaggaagcaggctgagtttgagagggaggaccagtcttggtcgtggtgaatttgaagtgtctgtgagatacccaaggggagacaggaggtaggccactgaaacctgtgggtcacaatctcagaccagcatccgagcaggaggtgcacatctgggaacctatttagttgttaattatttctttatttaacaattaaatagtgcttaccctgtcctaggtcctatttgaaactcttcgaaacattaactttttaaaaagaataagaaatcaatcatagttcagtagtttttctctcaagaataataggacagttcaattttttaatagttaagtttataactggctctcagttacgcttatagtttctcttctgtttccatctcctactgccaccctaccttgttttgcataattgttaagttatatcattgcttctcaaacttttttttaaaaaaaactctccaaaactaccgagaagggactaatggtcatcaccagaagttgtctgcttgcagtttcttcggtctttattttgttctaaagattgatgtgatttttgtattctggtccagacactatttgtgcttgttttaaaaaaagatcctgttttatcccaggccttgtgttccttatcatcgtgtacttctggagatatataaactccaatttgaaaaaagcactcacttccatgatactgagtttgtatcattccagttgggcacttttgttgcgaagaaaataagcttactagatctcttccttttaattctttttctctcctgccttagggcatgatggtactgaggccagagctgctggtttcaaagatcctaatagactagttagctgtatcttcccccaacccctccgcctcagccagaaaaaaacaaccgaagatcatcatattcacactttaaccctagatagaactattccataaatataaaatgtttgccagcagagctcattctcatttgtggaaaaacaactccaggttaatttcctattagggagcacattagttttcacgtgtgtgtgtgtgtgtgtgtgtgtgtgtgtaagtgtgtgtgtgtaagggacagtacattaatgtcaattttctcattatgtgtctggtaaaaatatcaaaaggaaagcgcttttaggaaatcctaggtttagatgtctgtttttatctatgtgttacccattttatccttacagatgacaacaaatacttatacttttgctccaggcattttccgtagtacatatattaatgcatttattcttcacaacagtcctattcttattttataaaacagtagcaattacataacttcctcaaaaatgcatagctagtgagctgtatatccatatagtctgactccagtattatttcacctatgtctatagaagttacctatacaagtttaaaaatcttaaaggctacgctcagtatatcctccagcacatagtaagtgttcaataaatactagttgaataaatgatgtgaaatgtgctgggcacaatgtggttcatgcctgtaatcccagctactcaggaggctgacgcaaggatcgcttgaggccacgagtttgaggccagcctgggcaacagagtgagaccccctcagctctaaaaaaattaaataaataaaaaataaacttaaaaaaaaatgatgtgaaatgtgtcttcagtggcatagtagttggtggagagacacacacttctgagaatctttggaaataggatttttaaaggacagtgacctatttagaaaactcagatccactttctgctcacataatgacctaagccacatcatgtatttgcatgtacatgccaagtggttgataatattgacccagcatatggaatgggtctgttttaacacttctgacttcacttgtttgtttgttcaattggtcagaaatattaactaagaggctcctctgcagaaaaccatggttagatacataaattggtaaaatgtgatctttttctccaagcagtatataagctcatgcaggaaatcatttgcacagactaactataaaacaaaatgaagagcatcccaagtaccacattaaaagtacaaataaaaaaacttgtagattcaaaggagaaagatttctcagagctgtaagttagagaaaattgcctatgagaggaacatttgaaagaagagtagaatttctatagatagagtcaaacgcctagcataggacctgtcctctagttccttccttcttccttctagcagaagagtgacatccaactagttggtattttttgttctgttgaatcacttctgaacagtatcactactgctgtgttctaagcatgcttagaacatggagtagtacggagagtaagagtttaagcttaaagacatgtgactgcaagcaagttacctctccatgtcccagtgacaaaagttcaggacagaaaacagatgccttaacagtcacttggtccctctagacctcaatttccacacctgtgaaatagaggaattaaagtagataattcagggctgtggttcatgcctgtaatcccagcactttgggaggacgaggcgggcggatcacctgaggtcaggagttcaagatcagcctggccaacatggcgaagccctgtctctactaaaaatataaaattgggcatggtggcacgcgcctatatgcctggctactcaggaggctgaggctggagaatcgcttgaacccggaaggcagaggttgtggtgagctgaaattgtgccactgcactccagcctgggtgacagagggagactgtctcaaaaataaaacaaaataaaataaaataaaatagataattcagatagtctgtgaccgctacgattttcaagttaatagaataaaacattgaaattttcactacatttctgatgtttttcagggttggtcaaattgtattgcttttattttattttgtttatccccgcgactgagccatccccttacagaccgtgagatttggggaggtatctggatctcagagttaagggggcagcaagttgaaaaacctcctcaatgattctgatatgttaagaatcaccactgcaaactcccccacccccaaaaaatcctagggtaaaaaatttatgttctgctgtaaccaaaagagtcagtatttctaacaaaaacaatttttttgaataaaggagatttgaaaccattattttaaaaacagcaaaacatgagatgatttaaggtaagccctctgttgagaaattaaagaacttttttctttcccacctactttctgtaagaattgagaaatagttcgttctaacttcaaagttgaattaacaccaactttcaagacagcacttcttgtcattcccaatgtgaaggctttcagtatctttaagatacaaatgaaattcctaggcactttaaatagtaaaaagcagaatatttaagaaacatcttccatgtactcatctaattccacatattagccagtatataatatttacagtcactaaacgtataatctgggtgttaaaccttggaatatgtgcttgtatatggaagtggtcttttaaagccatcattagctatgtgaagacacatctgtggctttttttctattctgaatcactttcccccaaacacattgaatctaagttgttatattttacattttatgcatttgtcttgtcatttttttcttctgtacctagggtaaggtataaagggatgtcacttgggactgggattacatataatctttaggtggttttcacagttacagggcagtgtactccagggactgtgagctcaagaaacaatttggtggcactttcattttctgtggaattcagctaatccagaacagcttgaccttgcagcccagaggactcaacttgatgaagagcttagacagagaccaaatgaatcatatcaaatgtgaccattatggggctgaagatgattcctaattaatctttgatcctctgaggtgtcacatttcccaaatctatatgtccataagggaaccaatgaaaatatgaaaatggcaatttacctaatccttgaactttgtggcaagccatctacttatgaagggctgtcattttccattctacaaaaaaacattctcattctatataaaacaattgtctaccattttcttaaataatgtgaaatattgagggcaaaacaaataatttaaaagtctattttgatgattgtattactagcagcatctttactcctgtaggagttccttaagataatactctctgaaggcccagttttcccagatgttgaaatcttgagaaaagctaacaaatggactcctgttccttggatctggtgaataaatattgtttcattctgaaccttaagtatgaatggtataaaacatgtagttgcatttctggttaaatatcctgtgaatctgtaaatgatacctctctgttctgtttaacaggcatgtccagacatcctccagctcctgatatccctactttttatcccttgtctccgggtggtgttggacagatcaccccacctcttggctggtaagaaccttgctgcacccttcagccaggcatttgaacacatgttcctccactttccattcatggaaattagatttatgaatggtaacacttgtggagttgaagaaatttcacatcaacaagcaaggtgctaactttattcatttcaatttaaaagattaaaaaacatacagactttgaaatggattgatccgtttgctaatatgggtagaaaatgactgtagcatttgctttgaagcttatagttttatggattccctttgtggctttgggcatttgctatgcctgtacaaagttagtgctcagtgtggttcttcttttctaggttttttaatgaacaacttatatttttcaaaaatgaatttagacgcattgaatatctaccgttacttgtaagtgggcaagtgaggtaaatgacaaaaataactagagagaaattcaacaatataagagcattttttggatgttaatgaagtaagcatccaatttgagttcagagtagtaaaaaactgatttgggggccttctttttttctgaatatgaacgctagtgctctttattttgttgtttatttctaaaaatatgcttactgctgcctccaaaatcttttcaattatgaaggtgaaggaaatatattttgggaagaaagaataacatggtatagcctatttttattattttatgattaacccacaacatttcctcctcccactcccatgctctctccactcttccctctccaattctccctccatagaaataattctcaactcaagcaattgtttctctcctttttccacttgactctctatgtcacagcccccatgtcattgtaccccatctccctacctggacatccttgcattatccttcttcagctaggaagggtcatcctgccatggacaatccagctttctctctttttctctctctctctccctagcattacatctcttagtcagtaactgcttgaacttaattgattatgcatacattttcaaacctagatcaattattctgtctgaacttagtgacttaggggcaatagtcctgtgctgaatcgtaccactggcagctggaaataaagtctgtgtaaatgaaaaatgagagatgtagagagaacagagggaaaaaatggacttctcagggtggagagaaaataattccagtgaattaatcttttatttcttgactttaacatgtatatgggggaaatggtacagtgtttttaaaatgtttatttttatatgaatatacagttttattttcttctttcttcccttgcctgaaattctcaaagattctgataaagaagtcactcagctccttctctgaagggaatatttcactattctcagggttatgttatattcaataaacatttaagtgcttactttgttcaaagcattaatggggttgggagaggggatgggataaaagagatgtaattcatggatggtttgtttcaaagttgagggtgggagatttctttcaaggcaaatgacactttgattgggtggagggtgaggaaggggaacggttacgtttctgaaacaatcccggggtctgtaatacttccacaagattctgtttgaatatctccctcttctcccctcatccaactcttactactggttggtaactggtgttttgtcattgatgggttcctttcttctgtgacctcaggcaaggtcagcctgtatatcccatcacgggtggattcaggcaaccctacccatcctcactgtcagtcgacacttccatgtccaggtaggtggaggtggaaactggggcgctcgaggacaagttgctcttctcgtgcttgcatcctgtgcgcctctgcttgccttttggttggctaggagggtgcatacctcagccatgtgtctgtctgtgcagtgtgcctggctcccacactaggtgtcagagagagtcccgggtaggagctctgcgctgtgccccggccggaccagccacaccatcgggcgatggactcagcctccttggaaagcgttgcctccaaacaaattcatggccgcctgactgtgggatgggaactgtccggaaagcggacattacaagaagagtttgtttgattcaaaatatgccgggggtggggtaagggaggaggataaaactggtttggtctcagctctataatttgcttcctttgtggaaagttgtatcagtttgatgcggcagtgtttgaaaatgcccagatagtctagagccttcctggatggaggctgtcagaagagacagaacagtgcggacaggctggcaggccatacagggtgtgcgtcctagtgtgtgaatcaggccctgtgtggacatggtcgtgccagcggagctcgggaggcctgccgcgccgcaccgagaagctgctgtgtgtgatgcttttgcttctggagaggatggcactgtgccctgtgcttgatgtacacacacatttggggtgcatcatctgtgtgttcgatgtggctttgtcaagggagctagcattattgtgccggaagtcaaactggtgggttattaactggttgtgaatatgtcttttttatatgggtatagtattcaaagtttctgtggtgaattacagctttaaaaaaactttttttttcagtgagttgtaaatgtagctgattgtgggaggaggtggaattaatatccttccccttaaaacatatttttatactttttaacattgtaagaactatctgatgatagaactctcacaggcaaataactatcatcatgtatttttgcaagtaatacatttagcaaagcatcattatttggtcaaatatttgtatttttaccatgcttccttcatattttaaaatttgtttttgaaaaatatatatcctagcagagttcctttcaagaaaaggaaattaattgtgtaggctgtgatgaaagacctgagaatgttgttcttgctgaattaaatgtttactttaaaaagtttgaaaagcaaaaatttctaaaacatatccaaatttatctagagagcttattgaaaatactgtctttattttatttttcttgcctggcagtttccctcctttgtgttggctggtggtggatattttaagattttttttaatactgttcaagcgtacttgggaaaaagcctttggcaagtgtagtttttaaccttgatgcagaactttatccttcctttaaattcttctccttatttctgttaccagttttccataagatgagatctctgaaacattagtgtatttctgcacagaaaatcattttggatgatgttaatggaaaccttattaaatgggagactgattcctatccgttttctcagttgttccctcctaatatggatgaggaagccaataatatgagaaaattcccattgtgatggtttgcttaggaatataggcagagattttaaaacatgatgtgttttgctttcatttaaaaatcatttaaaaagtcaagtcttaaataaagtgttatatttccaataattacttttcgtgaaattcctatttcaaaattgctttgcaagaaaaatgattcacttttttttttccacccgaatatagaaagaaaaaaataattatcggcccactctaatttatagttaatgcttctgtgcgtaaagatgtgtttttactcttagccagtagcagttagtggattgctttgaaattccatctagcttttgctgcaacagccagtagtacattgttttcttctctttcctcctttcaggttttcccatcatatgattcccggtcctcctggtccccacacaactggcatccctcatccagctattgtaacacctcaggtcaaacaggaacatccccacactgacagtgacctaatgcacgtgtaagtatccacccgggctctgctgtgattgccttaggatactgaggatttctacactgttgctcctttgcaacagtgatccttcacccctttgtgttgctgtgaaactcagtgcacctctgccttgaaaactctgtccctgaggacattaagcagcttcattcctactgtgctgattttgattctgaggttgcaaaggagcacggaccctaaaagatcatgggaaccttaccaaaatggaagaatcttcagaacataggcattcggagactcttcagctgtttagccatttaccactgaattttcatttggttcagattattggggagaacctgttcctacctgagtgaagtagattggagggtttaatgcactttcttctggaagtgcagttaccctggctccaagcttcaacagcacagaattcaagggaaaggaacaaataaagcccaggattccctgttgggccagggttgtctcagactgtgagtgcaggcctaaattaatttactctgaagagatgagtaattagtttcttaatctaggttttgtggatgggagggtgggggtgagaggcagcatgtgatggtccataaagcccttgcgaatgtatgcaaaggcaacatgcatttgtttgggggaaaaggtctaaagatttattagcttctcaaagtgctccttaaccccctgcaaaagttaagaacctctattctgaaagaggaatgatcacctgtgctgtgtgttcagcttcttctgaggggaccagagaagtcctcagcctcagagcccatctggagcatcttcacaatgccaagtccatttctacttggtgttcatagttctataatgacaggtccactttctcaaaccaaagggttttattctcagtcactgagtagataggaagccctattggatgggttgtttgcctctcagtgttttgtcaaatgagtcaataactgctcttccaagttggtggtggtctggggtgagagggttgtcgccatcctgagtgtagccatgtgagcaggtgctctgcttttctcctcccccatcccttcctcattccttcaaccccttcccctaaccaccaccaccaccaccttttaggaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaagggtaagtagctgagtcatgtgtaaatgttcatggtagccatggaactgcttcatgaaaatctgccccaatttaatcacatatcaggtggtcatagaatgtgtttgcacttcaagatatgatatgatgcattttaaagaattttgataactgtttttactgttattcttttttttgagacagcgtctcactctgttgcccaagctggactggagtacagtggtatgatcatagttcactgcagtcttgacctcctgggttcaggcgatcctcccacctcaacctcccgaatagctgggactgtagtcgttgtgccaccatgcctggctaattttttttttccaatttaaaacttttaattaaaaagtaaactttaatgttgaaaatgcaaacttggggagggcaggaatatcacacacaaggctgtcacttcacacttggagggttgcacagaggccgggcagaggcgcccctcacttcccagatggggcagcagccgggcagaggcgcccctcacttcccagatggggcggcagctgcgcagaagcgcccctcacttcccagacggggcggcagccgggcagaggcgcccctcacttcccagacggggcggcagccgggcagaggcgcccctcacttcccagacggggcggcagccgggcagaggcgcccctcacttcccagacggggcggcagccgggcagaggcgcccctcacttcccagacggggcggcagccgggcagaggcgcccctcacttcccagacggggcggcagccgggcagaggcgcccctcacttcccagactgggcggcagccgggcagaggcgcccctcacttcccagacggggcggcagccgggcagaggtgcccctcacctcccagacagggcggcagccgggcagaggcgcttctctcttaccagtcagttgggtggccgggcagaagggttcctcacttcccagtcagttgggcggccaggcagaggcactcctcacttcccagatggggcagccaggcagaggggctcctcacttgctagacgggacagtggccaatgcctggctaattaaaaaaaaaaaaatttgtagagatgtggtattgctatgctgcccaggctggtctcaaactcctgggctcaagcaaacctcccaccttggcctcccaaagtgctgggtgaataagtgggagccaccgtttctggccctgttatcattcttttttttttttttttttttgagatgagtcttgctctgtcacccaggttggagtacagtggcatgatcctggctcactgcaaactctgcctcccagcttcaagtgattctcctgcctccgcttcctgaggagctggaattatagttgcctaccaccacacctggctaatttttgtattttttttttcagtagagacagggtttcactgtgttggccaggttgatcttgaactccagacctcaagtcatccacccacctcgacctcctaaagccccattatcattctttaaacagatatttattatccttttgggtcaggcatgatgcctggagattaggtaataattgctgaataaagtagatgcagccactgggcacggtggctcatgcctgtaatctcagcactttgagaggccgaggcaggcagatcacctgaggtcaggagttcaagaccagcctggctgacatggtgacaccccatctctaccaaaaatacaaaaattagctgagtgtgtggtggtggatgcctataatctcagctactcgggaggctgaggcaggaggcaggagaatcacttgaacctgggaggcggaggttgcagtgagccgagattgtgccactgctctctagcctgggcaacagaaagagactctgtctcaaaaaattaaataaatatccacctagaatttacagatctataaatcattgttagggcctctattagccaaaatagatacagcccctttctggagcttcaagttttatgacagaatacagacattagacaaataaatagccaataaatatataataaaaattatgataaatactgtgaatgtagggaataagattcagtgagaaagaacagtaggggcttgggcaggcccctctgaggaaactgtatttaagctgagatgtgagagtaagtagagacgaatggggagaggtagactcccccacatgcagatggagtagcatgtgtgtgccgcctctgaaacaggaaagcgtttagctcttttagggagctacagcaaggcctttgggggaccgtcctggcaaacagaggtggccactccttccaggacagaagcagagctgttctaccatgaggctttacatggaagaatgtatatgatcctgaggagtcttgattctagaaagactgttctccaaatctccaagtgtacacctgccaggtttctgggttgcccttttcttttcattcattctttcaccaatgctatgatatttttctgagcccctgttatgtaccaggcagcaggctacaactaggatagacactctaagattgtttatccaactgtcagccaaaagacatacatagtcagtccttccaagtactttgtatgggattgaagtgatttcagttagatggctgaagagtggtaagaaaagtttgagtttctctaatttaaattacattttcaccatagtcacgttatcattataattttagaaatgtttcatcttaatttgttgatgctcttcatatctgtgtggtagcctcttaatttgtgaccctgtgtttgtttttgcaacctctcaagaaattcatgattggcaaatgaacattcagttgaggaggatctaacaacccttgtgaaacatagaggatcatgtgttagctattgtcgatgataattttaccaggtctgttctgaacctaataaatttgagcatttataacagaaaacatttaggagatttccagtccatgtgaacaggagggaagcaggccctcttacattatcgattcccattggatagcctcaaaatgcagctatttccaatctgcaagtcaccagggtttccaggggaggatgtggtgatagattatagcttttttggtgtcctgtgtacaatgccctatctccctgtggattcttagacacttaataacaataattacaatgctttcccaagccagatcatggcagatgagtgattcccatcatcttggaagaactccgccttaaaaactgatgatcattttccctgactctttaaaagaagaaatcagaggaaaagaagggctgatgtttttatttcagcttgtatgcaactcttagttttttcttttttcttttttgagttaagggccccctggccctccagtgggaattactttcctgctgaatacagagagtgaggatatgatatgaaggtatgcttcctattcttaatgcacatttccaacaattgctactttctcagctcccttaacaatccccagatccgagcatgtgtcctaaaggatggttcttatttggggtctctgtctgtctctgatttagacacctgtttctatttataggtctctgagatctttgattaagatcaggttttctatcctttcataactcccctctggcagggcagcccttgctagctctttaaagtctctggcatcaaaatcatgacgttttacactgggataatttgagttcttaaaagtggatcttaaatccatcccagaacattttatcttttgatttttattcatctttactatatctctaaaatagtgttcatatgaattaatcaaagttttatttttaatccatattataaataataatatcacaaattttattttaaaataagccttttctcttcagaccttcctggctattaaaggaaatccatttatcacaaatttgtcatgagaatgttttatcttggaactgtacaagtttattcaaattaaatggatattttccccacaacttggtgaaatcttgacaatgagatttgatttttaaaaagtttgactctttattttgcagtaaatagagatagagaagcatttttagtcaattgtgtttcagaaattcctgtaaagaaagaccatctttcaggtctgtactagactttgtttttgttttcaatgcaaaactttaattacatcattttatctactgttcattttggtaagtgatcttctatttgtgagtcatttttgtacattagaaatatcagagaacttcctggctaacacggtgaaaccccatatctactaaaaatacaaaaaagtagccgggcgtggtgggacgcacctgtcgtcccagctactagggaggctgaggcaggagaatcacttgaacctgggaggcggagcttgcagtgagccgagatcgcgccactgcactccagcctgggcaacagagcgagactctgtctcaaaaaaaaaaaggggggggttatcagaggacttaaagcaatggaacatgtaaataaatagtttagtttatgcctactttgcctccttgcctttttttcagtttcgttagcttgggtctttttgtcaacctgtttcttgttttaactgaaaaatacctcgttgtttgggtagaagacccaaacttgatacctattttgggagttaatttgtatttatgattccaggttttctcagctgctgtaagttacgtaaaactatactgatacagtaataaaaggtgttgtatataggggaatgatagttgtcaaatagtaaatttaaaatggaagacttcctgtcttcttttattttttttgtccctaatttttttccttattggtaaaactttgcctcttgccaatcatccttatttagcactaaagctaattgtgtaaatatcagttttcttttttcttgttgagacagagtcttgctctatcacccaggctggagtgcagtggtgcaatcttggctcactgcaacctccacctcctgggttcaagcaattctcatgcctcagcctcctgagtagctgggattacaggcatgcactgctacgcctggctaatttttgtattttaatagaaacaggattttgccatgtttgccaggctggtcctgaaccactggcctccagtgatctgtgtgcctcagcctcccaaagtgctgggattataggcgtgagccactgcaccctaccataaatattgcttttcttttacaaaatcaaggattagccaggcctggtaatgtattcctgtaatcctagctcagtgctgcggtgggaagattgctggagcccaggagttcgaggctgcggtgagccatgatcacaccactgtactccagcaacacagcgaaaccctgtctcttaaaaacaacaacaacaacaacaacaacaaaaaacgatgatgtttccttttgtatccagtttggtttttctccctgtgaaggtctgtaatactaggtcagtgttccaggtttaaaaagctgtcagttgctagcagcagtgtgacttttccatcccaatttaaaccactgctgctgccccagacacagattcttctcaggctcgatttgtctaatgtttattctactagtacaaagaactgtacttaaggtaactgtttccagggttgttttgttttgttttcctggcacctccctctaattttttttttaaacaaaagcacatcacctgatttgctttaggctcagggcaagccctgctgtgtgtcatgctttttaacctcacgctctgcacttctaaagcaattaaacaataaatcatctatcctcttcagcacagactgcctgacttttaaggggctttcaaaggaaacggactctgttacccttctggtgggaactgctgcttctcgcactggtggttggaactggaggtggggtgtggccggaaggtgctgtcatgtctcatgaaatcagcttcatgtactgttgtcaaacaagagcagcaggtgtttgttttcttagctacactttaggggctgagtccaagttgatgaggacttagacatagcctcctctaggagaagtttttctctctcatcaacctctctcactctctcactctatccttcctccaacccacccatacccttcttatttaaaaatcattttaaaaaacatgaacagggagatcaaaattaatatgcagggcagccatgaatgggaaagaatctcatagcctgcaatgggaaggaagcaaaatgggaagctccacacctgagagttgggggagagcaggagcagggaggctcccagctgacagattgtgtgtgcacacaggtgagcacatgcgggtacaaaagtgagcgtgtgtggtgtgcacatagtttatgtgcacagaggagcatgtgtgttatgcatgtggatgtgggtatatgtgctcaggtgagcatgtgagtggggtgtgtgtgtgttttgcgtgtgtatgtgctcaggtgagcatgtatgtttgcgtagtgtgggctctggtctcatccttgtatagctaccatcgcctctgtgtcataccctcatggacagtggttctcccaaatcccagatggttctccctggaaagttctgctggcagatcctggcattggggaagttgggaaaatacatgaacactgtctgctggggactggggtgagtcatgtgcagatgtatgcaaagcagtgtgcaaatgtaaaccccttaaaatcccagatacctttcctacataaatgactttgttatatgtgctatataatcagttatgtaaaaaggagacaaaaagtttgaaggatattagcagctacattcttcatattagaaattacagtctcaaattctagatggcaaaacaaacttaaataatgccccatgctgtccatcagaaggaggctaaaagccatagccataaatgcttgtgtgactggacagtgtcatcagtgttgtccctatagacagcgtctatatgagtgtgaggagacaatgaagagatggagatacacaggctgacttttcatgtccttctttatagataatcatatgattaaggtttcaggctcttcatatgacaaaatgggaaagtgttcatatgaggagagggtatatctgttttaaaagacatctggaaattatcacgttttgcataaataaaaagtacttgggctcagatatcagaatatgctagtaactgtgaaaaacagtgaagttgggtgttgaggttcaccagtgaaagttctttttaatttatattggaaaagagaaagggtgggtgacagagatcattttactttgaacactttgattgactttgatgtgtttcatgtgatatcagagaacaggatagagaaaccaaagtttgagtttcactgtagccactagactccaaggagatttctacggcacttggcacttggtcttctgcaatttaaaaataaatcaaagtttaaatgcttaatattttcattttttgatttttgaaacataaaatatactattgctattttgcttacttttgtttttttcttccttcctctctgttttagtggcatgccctctcccgtgaagagcaggctaaatattatgaattagcacggaaagaaagacagctacatatgcagctttatccaggctggtctgcaagagacaattatgtaagcccctcctccataccagtggctctccactctcactcattcgctcttttgcgttcaagaaggaaatgtgttttaggtgtatataatgctggtactacttattttttggaagttaatgaactttgtaataaggatttcatggatatattgcattatgaaagcttcgagctatctttttttttttgctatgggtgctaatgaatgcttttaaataaaatttttgaaataaactaataccttattattaaaatttgataaaagaaacattaaaaaaagaccataatcttactatgtaaaggcaacattagtaataactacttatattactttctaatattttttctatgcgtggtttttttttacttgtatatttgtgtgcgtgggtgtatatatatacatgtttgttgcatacttctcgatcttatatataaaaagcatttctctgttatggcacagtgtttatgtctatcaatattccattaagtgaatttcacaatttatttaatcttattttttcctgcttttagacatttaagttgcttcctattgtttttcttacaaatgtaaatattccttcaatgaatatgtctatacataacagtttttttctgtatttagggctattatttatgttgaatagattcattgtggaggtaaaggatataaatgttttaaagttattttgcgtttttttttttttgagacggaatctcactctgtcgcccaggctggagtgcggtggcatgatcttggctcactgcaacctctgcctcctgggttcaagcgattcttctgcctcagcctctcaagcagttgggattacaggcatgcacccccacacatggctaattttttgtatttttagtagagacagggtttcaccatgttggccaggctggtcttgaatgcctgacctcagctgatctgtctgcttctgcctcccaaagtgctgggattacaggcatgagccactgccccggctattttaaatttcttcatacatattgtcacattgctttccaaaggactgtattattttacacttcttataaacagtgtattcaggtgactgttttgccacagactacttaaaactgggtaaaaaaatcttttttcatgttatcgtaccccagcatctatcacgtattctattcagtgtaggtatgtcatgtttaagtcatactaattttatcagcaggaaatacctcacttatagtgccaattgttttattactgtagaatttgagcatctcacttatgtagtcttgatagggcaaagacttttattttatagaggggaataattttcactatttaagctcttaagttaatttaatattttgcagttattatgtctgagttcatgcagcctgctataataaaataccatggacatggtgagttataaacaacaggtttatttctcacacttctggagcctgtgaagtccaggattaaggtgcaggcaggtttggtgtctggtgagggcctggtcccagtcttctggctgtatctttgcaaggtagaagaagggggaagagagtgctctggggtctcttttataaggacattaatccccttcatgagagctccttgcttaggctatgatcacctcccaaagactctccctcattataccatcacattgggggttagaatttcagcatatgtatttgggagaacacaacattcagtctatagtaattctcagggtctacgtgagacgagcattagaaatgccagccaggtcagtcttaataaaagtgaaattatttctttttaaaagagcaagagtgaagccgttaattaatatacaatttaatatgtagccattgctttaggtgctgctgtggggctcaagttctcacaagagatgatgacaaggatgcatatctgaggtcatgcacacatggaaacttatttctggaaatgggttgcacaatttatttcctataatatgctccacagaaaaagtcactttactggtcaaggtttggagctcagacattggatataagtttgacacaggaagtaagagtctgtctgttacttatgggaaacagcatagtcagctcttctgagttattttggttgccttaataactaccatatgctgatggttaggaactgtcttaaattcttgacagcaacccagtggtggaatgaatactattacatgaatattattactccatttttcaggtgaggaaattgagaggctgaagagtttaggtaatttatgcaaggccttgtagtaggtggctaagctgaagttttcacccaggtcactctgacttcaaaatctacgtggttttcctcctcctgagtggattagctcagtcttccagtaccttctttttgttttgttttgttttgttttgttttgttttgagacagagattcgctcttgttgcccaggctggaatgcaatggcatgatctcggctcaccacaacctctgtctcccaggtttaagcgattctccagcctcagccttccgagtaactgggattacaggcatgcaccaccacacccagctaattttgtatttttagtagagacggggtttctccatgttggtcaggctggtcttgaactcctgacctgaggtgatccgcctgcctcagcctctcaaagtgctaggattataagcgtgagccaccacgcccggcccggtgccttcttaagactgctgtagttgaagaattttcacccctgagccaggcttctgttttctgagcagcaattaccatctctatatagagctcctgccatgccctgtaagtaggaagatcagtgttcacccagagggtttcaaaagtgtcttctggccagccatggtggctcacgcctgtgatcctagcactttggaaggctgaggcaggcagataacttgaggtcaggcattcgagaccaggctgaccaacatggtgaaatcctgtatctactaaaagtacaaaaattagctgggcatggtggtgtgcgcctgtaatcccagctactcgggaggctgaggcagaagaattgcttgaacccgagaggaagaggttgcaatgagcccagatcgcaccactgcactccagtctaggtgacaagtgcgaaactgtctccaaaaaaaaaaaaaaaggatcttctaatcctgccttaggtgtcttttgggtgtagtttgtctaaagggggagagctaatcttcctcatatgacctttgtaaacttcattgtgctgtgaattttattcagcattgcttcttgaatgcctttaaatttgtttttctaattcttaagtaatgagttttaacttttaaaaagacatgaaacaaacacctacatattctatctctttctctatctgctctctcttctccatgttgatgggtgggaagaaagtagttttaaagaaagctactgtaatgtgatttatctttaaagatttccctctgcacaacttttaaaggaaattgttttgcatattccttgaatgaagggaaagcccagcttcgttcatagtgttttcatcataatcaaaataagtcattcaattactgaggcaaacagaagctgatcaatgatagtactttatctaaagatactgttctttaaataacagtactgtacagggatagaataaaggtaaaattaaggcatttagtgccagaatggtatcctgatcctcagtgagatcgtgtgaaatatatatctcaattattcagtattaaaataccctattacatgacatagatttataatttgaacttgtttttttaactttggctaataacaggctaattaatagtgcacaaattttcttgggtgagattagccaaatatttataatgttagaacttttcaatttagtttttaatgctttccaatattatacagtccgtataattttaacaaaaaaaattttttgtttttaccatacatgaattttggtttttgtatgacttgacattaatacatccaaactacttagttctctttgcctatcataaatgtagattctcttgaagaactggttgatatcctagaaggtaacaggttatttgatttagcggtagaagcgtaacggtgcaggctcagttggtcactgtgtgctggctatgttctagacatgtgtgagtgggggagcgtggtgctgagacccaggtggtgctctggggacagagcccattatagcacctgtgaggcattcagtcatgcagtgagctcagggtcatagggagcgaggaagaagagccccagctctgcctgagggatggaccaacaaggtgtggagcagagaaggttcatggaatagataacacttgagacacgggttgaagggttgggaaagaagaaagtgtgaaataaagttccagacacatgaaacaaccttgtagcaacttctgaaccttgcagtaattacattgaaaggaccgttgtggatacttgaaagaagcgtgcactccctctctactccctgtccccagagcacctttaataatcttgaaagaagccccacttataggggcggattacttgaggtcaggagttcaaggccagcctggccaacgtggtgaaactccgtatttaccaaaaatacaaaatttagccaggcatggtagcatgcgcctataatcccagctacttgggaggctgaggcaggaacatcgcttgaacctgggaggtggaggttgcagtaagccaagatcacgccactgcactccagcctgggcaacaaagactccgtctcaaataaaaacaataataattattattgttatgagagcaagaccctgtctcaaaataataattattttaatagcgtatagccatggtccgcttatagtaaatgaccaacctgcatcaggtattttcaaataactaaaatggaacacatatcatatccaatatctctagcttatgtctgctgtaataatcaaattaacaaataatttttttaaaggctataagattgtaccatatatattttgtggctctataaaagtgcatatttctgcacctcaagatagttcttcatgtcacttggccattgaggctttacagcttcagaagggtgactgaaatcatcctccccaacactgaggcaaagagcagatatcagtgaccctgagaaacggcacatcaaaaataatggagtcttctttcaagattgttattattttttgagatggagtctcactctgtggcccaggctcactctgtggcccagtggagcaatcctggctcactgcaacctctgcctccgggttcaagtgattctcctgcttcagcctccccagtagctgagattacaggcgcacgccaccacgcctggctaatttttgtatctttagtagagacagggtttcaccatgttggtcaggctagtcttgaactcctgacctcgtgatctgctcacctcggcttcctgaagtgccgggattacaggtgtgagccaccacacccagcctaaaattatttttgaggacaaagtagttatgaaggaaaagggaaaattagaccactgtaagtgggatctaagctttttaatttggcattgagatgttttgaaatgtatttaaaatggtgtgcatatccatgttattttgtctgttttgggaagcaaggtccttaattgctagaaataagtctttgagatatcttcagttttctcaggttctctcactctcttctccctttctccttggttttgtcgtttctgtgccacagggcctgtgggtactcaattaacaccagggaacttttaatcagacaatggaattcacagtaaggtttatcttaagcactaccagaagtgggttctaagtatgttggttagtaagaaaaggaatggctcattaagctggctttccttgaagagggtcctatggccacagctctaggacatcattatccgtgtgtgtgtatgtgtgagagagagagagagagaaggctctatggccacagctctaagacatcgtgtgtgtgtgtgtgtgtgtgtgtgtgtgagtgagagagagagagagagacaaagtgtctacccacggtgtcaatattgatgatgttaaatatgaagctatagagacaaaggtcaccaggtcactattttctcccgttctcttgctttctgactttgtttctagatagagatggtgaagagggagagagaatgagtcatctttacctctttgttgaccacctgcctgtacttccacatcacattcatctgtgtgttcatggtacaatctgtgacatgacagtatacctctcttcttccagggtaagaaaaagaagaggaagagagagaaactacaggaatctgcatcaggtaggcaccatgagactttccagtcaatcctcaggcttctgacaaacaccttttaaggcagtttgcatctctctacacactgctttcttctgtgactgtaactcatgatgctttaactctgctttttcttcctgaaattcttttaaaaatttaaaagacccttcttttaaatgtgactgtgggaaggtacatgtaaaaactgtttcccaaaccctgtcacctggaatcctggttgtaaactgtgggattttgtttgtttgtttgttttatttttgcttctgttgtctgtgtttactttgctttaacactcttgcctttttactatgttatataactccttaaagatacaatattttatgttgattaaatgatgttacctggtgttcccttgagaatctcttttgtgatttgggttttttaaaaatttaaaacataatgatagggtttgtctttcttgtacattaattcaagacatcagtgaggtcccatttattttccttttttctttcattaaaaataaggccactacttgtactgcacaaataaaaatggctggtataagaaccatgaaaagtaaagcaaacaagttcacatgatattgtagctactacgtatttggaatgtacaaaaacctcttcaataaaaatttgttaaagacacaattttctgcaggtacaggtccaagaatgacagctgcctacatctgaaacatggtaagaacgactctctggtcctactgctgacgttagttgttataaaaagaggcacttgcttgtgaatcttcttgctcataatgagttcattcgacattgctccttaaagaggagaactcagcaaaatcaaattagtgctttaaaaaatctgatggtttttataccggctatgtatttgcaatatagtatgcttttatcttttctcttctatcctctttggcacatttattcttcctccatttcctttcccctaactctttcttctaaaccatttcttactgatcagtggcaaatcggcctgcttaaaaaaagaacaaacaacaacaaacagtaagcaaaatgccatcttactcagcaaatccagggtgggtttgaggagcaccattttagcccagaactcccaagcttttgctcagtagagactttttctcaattgaaatcacatgtagtcactcaaaagtaatgtatttgtttctagtcagaaagctatatatgctttatattttttctattatttaatatggcatgggcacttatttaactgtgtttcttctatcaagtatttctctttattggtaactattgctagattttgctctagtatttataagtaatatttattttatttctttttactataattttttatttatttccacatgaccactagcccaaggaacctgacattgtaaattaaggcttggtctttattaagctttaaattagcagggtgtgtacctcttctcctggtaacagttctcaaaggagctgcctttggttatcctctctaagaacccacatccagtcaatcaccaatccctgtctttggggtctgtcttgagccttttctctcacacttaccactgccatagccctagttcaggtgctcagactttccatctggagtactgtaatacacgttaataatttttctgcctccaggctttctttctaccagttcatccttcacgttgctcctggagggatttcctacaactcagattgtgcatcacttcccgacctggaaacttagccagtacttcccattggctaaaagataaagcacccgccacttagtgtgtgggtctgcccagtcctgcccttgtagctttgcccccagtcactcttgctctctgcctcccctcactttcaccctagcccttctgagtcctatgatcagtccaaacaaaattattagcagttccccacatggcaagagggcaccgcacatgctgtccctgggcttcgaaagcccatttcctctacagaggactggatagacgtgtgcagtgtttcttaggagaagagtgtttactgcagctcatttggcttttgactaaaccaggtggcccttacctaaacttttagaacttaattttggtgctgaggtttcaaacaacttgcccaaaaggggccagcagagattttggtaccaaatagatctgaattttaaatcagttgattccctgagcaatctacttcagctttttaatcttcattttccttacctggaaaaggggaatatcgatacctaccccctgtggtggttgatgtgcaggatctgcccagcggccagcacacagttggagctcagactcactccttcctcctactgagacctaagtcaattgccctctcctctgtgaaactttcttcatctttattcagattccccaggtttttccaaatcccatcactgtagttttatgatatcaaaattcttctaaactaatactgagtggcaagatttcctccaggtgaaaggaggaccatcccttcatataagatcaaaaaataatatactcattttaacttagtggctattaatcgagaacctcttctgagccagccacctggctccattattagaagcacagataggatgtaagcatggctgatgacacccaccccagtagctcatggcttcacagtagaagtaaatctagtcaaaatcacaagccttgtaattttttttttttgaaaaaaaaaattgttttaattactgaacacttaggaatggccaaaagttttttcatgttctgcctgtaaacagaaagccctcagaatggcagtgtgccaagggctggcactcgatttacctcacttctgtttgcaccaaaatctgtaaagctaactatttatattaaaaagcatggaaaaatgtatttctgtatttcagagtttggtagtcgatttggtgttcttcaagatgagcatcctatggtattttagatgtaaaagatggctatttttgtcctaaagtgtatcccaaacatctttttctagcaagtcacagctgtcattgtgctttcttgtcacttatttatattttcttaaggttaagatgttctctctatcctgcgcaagaaaaacaaaaataaccctctctctccaccctacccgcctaaaacattctcaggccatcccgccgctggtgaggctccagttggttgagcttcctgtaatcagagtctctggtgttgccctccctctcattcccggatcagtcatgcagcctttgaagtcactgccctgcacaccatccgagtttggagaccagaactggcagttattggataagaattgtagagtagagaggagctcagatccaccttcataaagatttccataaattagacatgataattatttctgttgtacccccaccccttcctttgttgtaggaattcagaaacattctgtttgtatagtagctgacttgttatagtcatgattcagcatttattgagcacctaagataggccctatggagacttgtatgacctggaaatagagtgttggatggagcaaagaaggtccctattctcacagtgcttgttatgttgctgtgagggtagttgattaaaaaaaacaaacaggaaaatataagtactataataaaaataagttagggagtaacttaggggtctgcttttagattggattgtcaggaaaggcacctccgaggaggtggcacttagaaataaccaccgttattacagaaaaatggagggggtcttctgttctggaacagagccctggcaaagaaatgaaagacaaagggaacagagcgtcacgttatggaaagagcagagcccaggaatgaggccacccagtctcccaggttagctcttgtataaatttgtgcggcctggggcaggtcacctaaagcctctggtttctcagtataagtgaaggattgtgcccagcgtcctctgagatccctgtctgtctctccctcaagtccaactttctggtctgctttgcttttgtgtggtctgcactgcctcccagtgttattatagggactcagatctctttttttatttcctaatttatagtcatcattttatgtctgagtggctctgtataactataaagcttctgcacgaccttgaaaatggcttatacatgatggggatgttcttcagttcctgtacagatcatcccctgtgtccctccttcctccccaggatggctaccttgtgtcctgggatattcgaagcattgcctctagtttgagggtttgattttccactaatgtaataatatggttccttgtttgccagactacagtcatactagtgctgacctcaccttagaaatagtaaaatacttgattagaaccaatcctccaggctgggtatggtagctcattcctgtaattccagtactttgggaggttgaagtgggtgaattgcttgagcccaggaatttgagaccagtctgagcaacatggcaagatcccttctctacaaaaattagctgcgtgcggtggtgtgttccagctactggcgaggctgaggtggttggatctattgagcccgggatgtcaaggctgcagtgagctgagattataccaccgcactacagcctgagcaacagaacatggctctgtctcaaaaaacgcaaaaaacaaaccagtctgtcagagtgtgatgtggaatatcacacagctggttttcaattctgaagggaagttgacgagtaaaggtaaagctaggccagaagcagtggctcatgctggtaatcccagcactttgggaggcagagggtatataccatcacttgagggtaggagtttgagaccagcctgggcaacatggcaaaactatgtctgtataaaaaataaaaagcattaactgggcatggtgacacacacctgtagtcccagctactcaggaaactgagattgagaatagcttggacctaggagttcaaggctgcagtgagctatgattgcaccactgcactccaacctaggtgatgaagtaagaacaaaaaacttgtattttcatttctttaaagatcctatgggtttcatggaatgcttcccattttttgatgggcagcgccagcgcagtggccgcatgcagcccagcggagaggctggctcctgaatcagtgctttattcacccggttgtgttcctgtctccccgtatgtttctacttttgagcattaaaaaatgtttcaccctggtgaaatcagattgaaacaaataaattaccattaatgtggtctcaacactgtggggaaacttttaggataattggaaatgagatccctaaaagccattcctccaggttggagatggtggtccccaagctgcaggatctttgggagaggccagattcatctgtttagcttttcggactagtcatttgtgggaatgctgggagcccagggcctcaggggataagactgcacacactgtcctttgtccagctggaagaccggtgtcatgaacactaatcacttgtttactcaccacgcaaacatttagtgaggactgctgtaagtcacgaatcctgttaggcggtgggggtgtttgcaaatgagatcctatcccttcctggaggagcttcaagtttaagaagatatagacatattaagtgggtagttataaaagagtatgttttatgctgtgaagaagtggcatgctgtgccttatataaaaataaagagaataagaagtatataaatcggagtgaaatcaaggaaggcttcctgtggtagatagcactcgagctgtcaggttggtggcggaatttgggggtttgatagcacagtaatagaattgatgtgagtttctggtgtttgggatatgtttgatttggaataccaccttaaaatttgtcagaagttagagattattatcaaatactgaactttgctttcttcctgacttaagatttatatgaaattaaagaagtaaagaattataatgtttgaagtgctggagagaattatgactctgagtttactaattaaacaattttcaaaattggcttattaatatttactttatcaaaacaaatataaaaagcctaccacctttaaattatatagattgaaaagatatttttagatactttatttcttttagttgtatgacatgagagttagtttaaaagaaggaacaggctacttttaaaagataaaaaaaggctgggcacaggggctcacacctgtaatcccagcactttgggaggcagaggtgggcagatcatgaggtcaggagttcgagaccagcctggccaacgtagtgaaaccccgtctctaactaaaaatacaaaaaattagccaggtgtggtggcaggcgcctgtaatcccagctgctcaggaggctgaggccggagaatcacttgaacctgggaggcgcaggttgcagtgagcagagatagcaccattgcactctagcccaggtgacagtgagagactccgtctcggggaaaaaaaaaaaaaaagataaaaaaaatcatctgcttaaacacatttggctaaataaaaacttcagcctttatttccctagggccaagagatgagcatgagaggtaattgctaagctcaatatagtagttaatgttcagtgcttggatttacattttttaagaagattgtttctggcttttctttgatgatgatgttcgagagcctgatgaggtggttaagggttgagaacttggggctcctgggtcctgtgaagctgtgctacagagctgacaagttgcagagtgggaatagaagcaccagtgagaggactgcaaccctgagggtctgccaggagctgtgcctggtgtccaacatttagccctgtcctcttagagcagccagggagtgttctaaatattttcagtggtctcaatgagaaaaatatttatttcctatgatttttgaagctcactctggtaagtttgacacttttgcctaatgtttgttccaaattctgttccacaatgtagtcaccaacattaaatatcagtaagctgctgggttatgtttagttagaaaacaaagccagattcttaaaaattaataaaattgagaggaaattggaggcagctgaagaactcttaagtcttgtccaagtctcagggtaaaaattaaggcttcaacaactagaaagtgaaaaaatgacatcctgttttccattctttatcttttgtaacatatttagaaagcacctcagctagaattgttaccaaacaagcaaaagacccctgggggttcagaactcttgggaaggaagcctgcatctagggaggggaagggggatgtcaaactggggagaaccaagtgtcgcacggcagccagggcaacacgtggctgcgcagctacccttggccacaggtcggcacctcctgggaaaacttctgcaccctgctcagcactgtcccacacttggcctgcagtggttttttttttttttttttgaatagtggcctagcccagttgggggtaccttgtgctgccattttaccacagtggtgaggtcctgtggaagcgactgctggcgtgctgtttatcttgcatggattgccagatcgctgcataggaggtggaggttgtggtggcccagagaggctcccatatgtgtcgtttctgggaatgctccagtctgaggtgacggcctacctgtgtcttccttctttttatgcttgtgttcagaaatccctgtgacacctgtcacagactaacaggaaatgtgtacaggattcacaaggtgatgacacttgactacagataatctcaggcttggtttcattgtcttaaatagcaatggcagcataatgacagtgtggttagactcagttatgcgtggactgcaggttttcacatcctggccattgttccaggatccctagttgcattcatgggagccttttgatggcaagtgccggaaacaaatggtgctcacttaaggagaaaggggaaatgtgttttaaggatataggagcatcttgtggaatccaaggacagtagagcagttgggccaaaaagaaaactggaaattggaaagctgtccagacactttccctgctgcttccatctgtccctccctgaaaatcacttcctccttcccttcccagattgactctctcagttctctgagccttatgtttagagcactcaagctatatgttgttacaatatcatctcccaaagagacaataattctttcaaattctgtagaagcgactctggttagcccaacttgggtcaaacttccaccccaatctataatcagctgtggccagaggagaaggtcacattgtacaaaatggctgtcaggagctcactgctctaacagtgttggagttgggataatggagaggagagctggacagcagcccgacagatgtccgctatagctcactaggaagctgatagttggggtggttttatctagacagctctgtgttaataaagaaattgggttgggttcatgggtacagtgaaagcttttaagaatgggcagtatcccttccatcaattatcttttctctccttaatgatcagaagagctagaattgtgtttaagttgccttggggagcagaaatagagaaatagaccctcaggtagcaagactgatctgatgccattaaaaaataatagcagagggagaggagtatatgaggttcattaaaaccctcttgaaatgcttcatgtttagtattgttcatgaaaacttaccaaatggaattaagatcaatgcactagaatatagaataaaaaagaagtattttggataaattttgtttaatagaactgtttgttactgagttgtgaggaactgtgtggaaatgagcccttctggataatggagtttttcagagaagctatatggtttacatctttaagtgtcaaaacatgtaatttttcaaaacacttttggatgcaactctgtcttcttcagcagagtacattgaaattgatttgaatacgaatacctcatgccattattttacagtgaatattatatatgccacaaggagtatggtggtttgtataatactattctaaatgaccccaaataacatggaattttaagaaactgctttttaataattcttttgtggcttcctttgctgtttgggactataccctgtacccacaataatatgtttcttctgatctgtgtggatttaggaaccaggaaaatgaagcttaattgaataatatgtaaattaaaagtaaatggggtctgatttggggtatagagaaaggctaaaatgtgctattttaagaaaggctaaaatgtgctatttttgcacataaatttcatgacattactgtgataccttgagatagttttaacgtgtttttcctcagcagtgttcttcataaatgaagctaccatgttactgagagccagatgagtgggaaatcctgctgctcatagctgtctgtgacctttagcaaagtaactttattctttttgacagaatgaaagaaaaattaaaagcattaaaaattaaactcactttttggcataaggtttacatcaatctctacactaaatttttctaactgcctatatatcgtttttgtgaatctaactttttttttgtattgggattactttttctcagctagcatcatgcttttagaagcattctgtttcataagagatattttaattaattggcagaataccctgttggtcttaattttctaccagaagttctgtaatagtatgaatcttgcttgctgccccgaatgtgtcgtgtgaagttggaacagcagaaatggtcccaacctgtatggaccacctgccacattccggaggctttaacagatgcttctgcatgtgttgcctcctctcgttctgtagcagccccattgtggggtggaggggacagatttcagttctgtctgaaggatgagaaaataatcacttgtccagggccatgcagctggcgagtagcagcgctgcgtctgcagagtgaattaccatcagctctgagccccagttctccatcctctgctgttactgcactcactacgctgcttcagggcgtctgccctgcactcgcccggctctgcacatacgtctcccacatcccgcagcgcacctgatgaggtagagcagcttcttatcttcactttacagatgaggaaacaggtttggtacgttcagagtgcatgcccgagatttccaggtggtaaccgatggacccaggatccaaacccaacccaggactgtcagtccttagagcccacactctaacccatacaagttctcacctccctgtgcttaaccagatgcacaggtgcacacacaaatgctggcataactgtggaagggcttggtttgggtaaacaaaacaaaaaaagaccaaagtgtgccctgatcctgtcacctcatttgtagaaggtgaacttaacatctttagtgtgagagaacgtctgttgagagaaatgtggattggatagcgtttggaggtgagtagatgagggaggtctacctagctagttattaccctctggaagcacttcagctgacagaactacaatgggcttttgaggctctctccttcaaaacttgctcaagaccatttctcccatgtttcccgtggtaggaaggatctagcggtcatgacctgcaccaggaggtctggcctaccaataggacacatgtcctcacagaggagacaaacacagagggctaggctgatcaggaagagaaaccagtagctacagaaaaattcccctggagtaattcattaacggtcacaggcttgtctcaaagtcatcttgacattgccaaagtctggttgagctgatggtaattcactctgaatagccacaggagaggaagccttgccttggtagaacatgaatccaggagtggcaatgacccctttcctcccacctccagcttctgggaatctttttgctttagagctttgtggttaggggattaactaactagtcttgaatgctgggactaaggagtcattcagctgcagaaataaaactcagtgttaaccttcctaaccacacattttcatttttcttttttctcaaatgttgggtaatgtttactgtcaaggagctgaagctggcttttgtaggttatatttccagtcttagggacttaaatttcaaagttaacttatgcgtttgtttctctttatcatctttcttcaaacagagcgtgatatcctgggggtggctgcactgttacagatgtagactgcctccaccaggatacaggggttgttgcctggggatggacagacagaatgatggaaggtaggaaggagagaagaaagtgaatgataatttagttccaaggtatggtggagagaacacatgttgagagttcagaggctcatcctgctgcctattagttgggtgacctttggcaagttactgaacttcaggtagcctcagtgtccttatctgtaagtgggtgggaagatgcaaactgtaatgatgataatgtgaaattctaaagtccatgtctcagtgcctggcaaatcagtgcgtagtggacagtgtttttgttccttccccctcaccagcttcttgcagacaagaccaccttcaagtcaacaagactgtcacttttatgatgccaggaggcctggggaacagcccagcactgggactctctaggggtcaccatgggccagtcattttatgaccatattcctaagtctctgctaaaaaaacaggattagactagctctgtcacgcttgcttcctgctgtagaagtctgtacctctcttccttcatacacacatgacattgtgcagcagaagagttcacaccctcaaatcacaggcttttgtcagtttttcccaaggtgtaaaaatggagacaattggcatgaggtgtgtggtgtgatgctggaattccatttttgcaattaaaatctgtgaatctgtttacctctcataaaaccaatctctaatattctcccctcaaattgcacatcgtttaaggctcctgcctcttgttagtagcatttgagagtggcgtaaaaggaagaggacgacgaagaaagggtcttttattccaactcactttttttgtatcctcaccaattctgaataaggaagtgatattacatgatggggcaggggtgcattttgttcctggacaccagctttgctgcccttgccttggcctggacagcttaaactgactggccagtgagccctgagtggcaccctgacagggctggcccttgcctgctcctgaccctccactccaccacctcagagctcacccatagacttgtctccttggccctttcttccagaggacagcctggggaggaacccccaggacatgagctggccaagcgctctgcttttggtaggattttacatttatttgggcttagagagaaggagtttccccctttccctttcttcactcctgagtcagggtctgtaaagccctattggcccagggtcggtgctgttgacctcccagaaacaggcccactcttgaaatctttagattcacctttattgcttgggcttttagtaaggaactctacccatttgggttcatggttccatttggttgatgggatattttgtcaagattggaatttggtccaggagagcatcaggggggttcggttatatggggtggggtggggtcttgtgccgcctttgcatccccagtacaaatgcgtggtgactcctggtggagggagcccaagtctgaacatatgtaagatgggccttgcctcactccctttgaagcccagccgcagccggagagcagtaattgctggctttgattgcgcagacttcactggtgggttgggctgtgccggggctcgcctggcctggcccagcttcagccgcagccccccagtgaagccttagatgtgggaaagctccagcccctggagcctcatgcctgtggtttcttgaaaataatctggactggacctgttttatatctgtaaagcaacactacaaggcccccgtttctcccacttggaagtaagacttggtctcccctgacatccctgtattttaaaagagccaccagggacaaactgcctcatttcatagtgaaggaatttctttgctcttttttttttttaagcactagtccctgaaagggattagttgctttttggtaagcaactgtacagaggttctctgaagccaactttccaggagaatttgcaaggtgaccccatggaataaggaaataacaggtgggaaaatgtgagactgtggaaagaaatgactttattaggagatatagactctttcttggcaagtgacatactatcctttaggtaaatggctatctctgggcacccatgtttgtgttaatcactatattatcacttgtactcagcttaagagaggaggagaaggcacccttaggtaaggcagtgaagggacaagaagactggtggagccggaagtgcagggtgctctagattggaggtgttagccctgcttgagaatggggccacagcagggccatggaagttgtctgtacctcagtacttcacagttcgctgtgccaggcagtggtgggatggcccaacagaagggcaggttgtctccctcaggcgttcctggctgccaatggcgagtctattctgagtcccagtgcttgtctcaggcgctagcctaggactgcaaggccaggcctcaccaggaaactaaatgttttcatgtcagactgagaggaaaaccttcccaggaagagcaacctggaccaagcctttgaaaatctgtgatgcaaaattataatgtaaataggaatctgtggggtgccctctctcccaccccaggctctgctagagccctgtttctttctccgtagaaaggcagggtccttcgtagctctttgatcctcctgcgtgcaagatccatacctctgtgggcctggcacagcgaactgtgaagtactgaggtacagacaacttccatggccctgctgtggccccattctcaagcagggctaacacctccaatctagagcaccctgcacttccggctccaccagtcttcttgtcccttcactgccttacctaagggtgccttctcctcctctcttaagctgagtacaagtgataatatagtgattaacacaatgctgtagtgttttcctgttaaacagggaatggttgattttccaggagaatagaaaatgaaattgtcattggaggacctcctcagttgaaatcattctgtggctgatttcctcctattttgttttttgttggttggttggtttttgctttttcagtagctacccaggtatacaaatagcttctttgcagttctgatcatctttaggggccgcattgggcataattggaataataatactagctaacctgcttgcagggcttgctctgtgctgtgcactttgtgagcactttaaatataggagccaaacctctctttccaaaagcctgaagggcaggtgtcctcgcagttcccattccatagatcaccatccttccatggaaagtactctgtggactgtaacttgccatctagacttttgtattcattattaaactatgtcaaagtttccttttatttctcttttactttctttttccattgaaatgaaagtgtacgataatccaccattatttagaatgagtttctaaaaggaaacttgtgcttgtaacacggatagcacaatcacaagcacaaagtgttgggattcatctgaggctgtcaagggacccaggttgagaaggtgcttccagcatcgctgccaccaaaggaaagcagcctccccaagttcaaagcagcggaagcaggtgctctctggagtgaaggaacggaactttgccatgcttttactttccttttgtctttgtctcatcttgttacaatgttacattttacttttaatcactttttaaaaaatctcagatcattaaagctttgaggatgtgggagttctcttatttgaaaatcattatcaccaatatctggcaacattattttaacatatttgctgagtgtcctttccgaggctatcattagagatccttgatgttaggaaggaaaaaaaaatcttgaaaattgtaagatcttaaggaaaaagggagcggtttgtatcctctgggctgtgagtgtgagcggacagagcacatagcgtcacgggagttggcagtgcgttgggtaatgtgattatgtctgtcctatgtagaatcatacagtggcttcccacagtggaccaaaaacaccaaacactgcagaatgacacatctttccctgatctggctgttgcccgccttccctattcatgtttgcctgtttcctactggtgtttttcaaactttttttttgttctgtttaccatgacccagagtattcactacacttcacatcataactctgggcatacgtatacatggaaccaaagtaaaaatgtcactatattaactctgtagtgtactctcaggatttttgactgatagggcaattcattttagccatccccaaattaacaaaatggattaattaaatgcagaggttgtaagacatatatggtatggaatagaggttataatcttaaggcctacggcaaattcatattaatagcatttcatttgttccttcttgaggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcattttattaagagtgaagttcctgataatctaaaattgctaatgaactgaatccacaggccagggcagagctggtttgtagagaggaacagtttgtgtgagaggggtgctgctggtgcagccttctccagggacaggccagaaccggctgtaaatgggcaccttgccctgtctcctagacatgcagtcctcaaaagtacttgtatggcttgggcctctccctccttttccaggtggtatgaaacagggtcaaaggaaaaaagagggttgccaggattcagatgggagtgagtcctttcctgaacacagatcctcatgggctcccaccatctggttgtcgtgctcattgaaagtccacaggtaccgcctctcttcatagctcattggtattcaaactgggcttccacattgtggggtcccagtggagaaggtatgtcttaacacccccacccatctccccagtcaacattttctaagtcctgagctgtatttcataatttttaccttactagtacatgttataagttggtatctgattaggaaaaagtatatttaaatttaaaagaatatgtcatggtcttccacgatggttttctatcccttgagctactttgagaaccactatcactggtccaacttaaacctctctgctgaaattctagctcgatttcccctttctaaccttcggtgcagctggggaacagctggctaccatacttataataaccctcctcatactgtacttgaagattgccattaaatcacccctcaaatttctcttcttcaggctaagtaatcccaattccttgaaactttcatcatcagtcctttaatcattttcattactatcctctggaacttttccaattcctcttcatttagtcctaaacttgaaccagggaaaaaaaaaagtattatgtttagggggcctacttgttataaaggtttcatattcagccctggccagaacttcatttgaaaattctctctctctgagttctcttaacatgcataaaccaagtagttaaaaaacagtctaaagctgccaccatgatctttttgagagttaactagaaaatccaacaaaacggtaagggaggtgacagtggagcattatgccaacacattgatgggctcttctggatatagagagaaagcaattaataataaaaaagtctattcatcaaggcaacaggcatagctggatctatacctgagacttgaggcttggccaaagcctgctcaactcttctctccctcggttcctcctcctctcaaaaatgcagaggccaagtcccgagtctcaggtgtgtatatcctgctatggtccaaataatctatttgaacttcacaaaaaattggtgaagttgaaagaaacgggttgtttggaccctcagccagttccttccacaaacttggtcccctcctagtttcctgtatttcttccacaataatttttcccaaataactttgatgtcactgcacagagctcattctgggctcattctgcccaaatcctgctttctgtaggcagcagttctgggggagagtcaacagtccccctagagatagggatcaaagcaggtgtctgcggggagagggacactcctctggccacttcttctgtttgtttgatcttgaagggatttggcctccttccctgcagcgaactcagagctgaactgtgtgccaagaagaggctaggtcagccttctttctgggagctgagccttctctgaggtcacagctggcatgcgggtctgtatgaaggggtgttttcctcctggttctagtttggttgctagggctgctggcaactacctgtttagctggaaggtgactttgaactgtttcatgactacagttgtcttaagtattttacacaataattttttcctctagtttggtctatggctgcaacaatatggaaactctaataaagggcttatgaacaataacaagatgtctgtgtggctgtgcttttaaagaagaagagtcatgagcgagtaatgtaccgttctgacagaaaagaggcccctaacatccgcacgatgtagtagttgttgaaaaatcgcatttaccatttctgccacagaatgtgatcttccagatgtggaagatgagaactttaagagctgccctgtgaaacctaacctctaaagatacacacacaagaaaatgtggactgctttttaatagaaactgtaaaatttgatggcaattaagtatcttaatactaatagaaggatgtgattctatacaccgtttatactgatttattgtgggaaaaaataagattggttttcttggcaataattcagtggatatcattctggaagtggctcttctaaatttcttcaactcttttctgggaaaacttttattatctttactctgcagccaggcgtgactcagggagcgtgtaccaaggtgactcagatacacctacctctacacagggtgtactaacagcaactatttaaaataaacattattagcacgaatcaaagtaaacaaactgtatacatgttaattaaaattaataatttatagtaaaacttgagacaagtgaaaactacttgcctttattgaagaagcagtgctaatattgtttatagcattgttcatcaacagtaaactggtgttaaataatagatgcattcattcaatacatttttactgagcactttccaatgggctatgctcaaataactggacaccagaaaaatgttttgtattgtctgtctactgtaggcatataagaaatgcctactgcccgcatttgttacaatgtgcaagggttcttttccctggatggtaatttggacttaaaacaggttatattaggcaggaggtggcccagtgaggaaagcccaggtttagagtccacagagctggacaaaatctattcatcccactgttgggaatggcacactaaacccctctgggcacacttcctcatgggctaaggtatcacagacctctgtcagggtatgtgagaggtaaaggagagagaagcctgacaggaagtgactagtaaatttttaatttccccttgaattgttttataatgtgttagaaaacatgttttgtccagtgcaaaaaatatcttgtttatatattgccttgtagccatagaacatgtgagcttatttctgcctagggaagcagtgggtaacaggactaagcactctgttttggagtcaggaccatggaagtacttgtacaaaaggtgcagagtttggatttattgggtcatctatactgatgtgttcatataaatatttttcttaatacataatagcttgggatgttaccagctaaattattaaatttttgatcccccactaaataagtgggagaaattggtagaaaaatgtatttgccagatggaatgagaacactgcatacaaatagatgtcaccacacatcattttaacggttttctctgtagtcacagtggaatttgtagacttgtcattttctcttctccatctataacttgtctcagaatctgaaatcagtggaatcactgaattatattctacaccatagtgatttttttttccccaacaggaagatgtatgaggcaaccaaagtaaaacagatccccacaagctggcctggttgtcattacaggtcctttcaaagttagttcagactcccactgctcaactggaggatggcaacaatggctttagagtctcgcctgccctccacgctcagccctggtgacagccttcagcactgcacaaagccagggctgtgcagtgctcactgcagggctcactaaagctcagaggtgctttgtgagcaatctcatctgctcgccacatgctggcatcttgtataggctttgcctgctttgcttctcatgttccaattagctggggatgatctttcctcagtgcctggccctacagagtgcaaacccattcaggcagcccttacgaaaaccacctggctttcaagagctttcgacttgaatgaaagacaatatcatggccactgcaacttcttttatactcagatctgtttagattgtctctgttctttcccaggcctctgctccctagaacagcatctctcagactggatgatgagatctttagctggcagggatgaggatgtcaaggaagtgcagagtctcaaggaggccatggttaattgggaaggggcaggcactgcaaactacaaatcacgtgaatgagatgagacgtgctgtcctctcccagcatttgggattaactattttaataaagggatgcatttaataaagggtgtgtgtgagtgtgcacacatgcacacacatgcacacatacacaagacttaagaaggggaggacaacagaaaaaaaatcaagataaaagtattaatacccttacattaggcctgtgatttgtgataacattgtgccagctagtggcagaatccaccatgagactcagtgctgaaagggtagctggttctaagcaatctgtgtgcgctgttcactctgactgctctgtgtgtgtgtgtgtgtgtgtgcacgtgcacgcacaagttaaagtctctgcctatcaatagaaaaagagggaatcctccctaactcattttatgaggccagcatcatcctgataccaaagccgggcagagacacaaccaaaaaagagaattttagaccaatatacttgatgaacattgatgcaaaaatcctcaataaaatactggcaaaccgaatccagcagcacatcaaaaagcttatccaccacgatcaagtgggcttcatccctgggatgcaaggctggttcaatatacgcaaatcaataaatgtaatccagcatataaacaaaaccaaagacaaaaaccacatgattatctcaatagatgcagaaaaggcctttgacaaaattcaacaacccttcatgctaaaaactctcaataaattaggtattgatgggacgtatctcaaaataataagagctatccatgacaaacccacagccaaaatcatactgaatgggcaaaaactggaagcattccctttgaaaactggcacaagacagggatgccctctctcaccactcctattcaacatagtgttggaagttctgaccagggcaattaggcaggagaaggaaataaagggtattcaattaggaaaagaggaagtcaaattgtccctgtttgcagacgacatgattgtatatctagaaaaccccattgtctcagcccaaaatctccttaagctataagcaacttcagcaaagtctcaggatacaaaatcaatgtacaaaaatcatgagcattcttatacaccaataacagacagagagccaaatcgtgagtgattcacatgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtagtttatagattcaatgccatccccatcaagctaccaatgactttcttcacagaattggaaaaaactactttaaagttcatatggaaccaaaaaacagcccacatcgccaagtcaatcctaagacaaaagaacaaagctggaggcatcatgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaacacataggcacgggcaaggacttcatgtctaaaacaccaaaagcaatggcaacaaaagccaaaactgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagcaataggaacacttttacactgttggtgggactgtaatctagttcaaccattgtggaagtcagtgtggcgattcctcagggatctagaactagaaataccattggacccagccatcccattactgggtatatacccaaaggactataaatcatgctgctataaagacacatgcacacgtatgttgattgcggcactattcacaatagcaaagacttggaaccaacccaaatgtccaacaatgatagactggattaagaaaatgtggcacatatagaccaaggaatactatgcagccataaaaaatgatgagttcatgtcctttgtagggacatggatgaaattggaaatcatcattctcagtaaactatcacaagaacaaaaaaccaagcaccgcatattctcactcataggtgggaattgaacaatgagaacacagggacacaagaaggggaacatcacactctggggactgttgtggggtggggggaggggggagggatagcactgggagatatacctaatgctagatgacgagttagtgggtgcagcgcaccaggatgtcacatgtatacatatgtaactaaccagcacattgtgcacatataccctaaaacttaaagtataataataacaaaaataaataaataaataaaaataaagtctctgcctagatatggagattttcgggttggacagagcttttccatttcaccctccttggtcctactacaaattggtgtggtggaaggatagatttctctccactcccacccttccctgcaacttgaatattgacgctaaagggctccagaaaactaccttcccagcagcatataccaaaacctccacatagaatgaggcagttggaaaccactcaaactgcctcaagtaggaaattcagtttcaaaaatgccatcctcactccctactagttttggaggcatcccaatttcctgtcttctacacctgcaatctgagtggtgaagtggatgttcaagagcaggtagcaagggtagagttcttattccaggaggttttctcttctaatacctgcttgcctgagaacagactacattttctcatagaatattccagtaactgcatctgtagaagtgaaactgaggtgtctccatgaagtttattgacatcatgaagggctccattgccactctgtcatccaaagggattctacctcgacagactaatttattttaggagatggggtctcgctatgttgcccaggctggactcaatctcctgggctcacacaatcctccacctcagcctcccaagaagctggtattacaggtgtgcaccaccccacccagcttgacaaactgatgttcaagttagctatggtatcctctcccctccttgatgatgaatcaagagcagcttgaatttgtttaaaccctaggggccatcctattgctcccttggctaaataattaatagacctactagggcctcccacaattttgttctgaataaatctttaggagtaacctaatgtcatttaaaactactggccactataatcctagcactttgggaggccaaggcaggtggatcacttgaggtcaggagtttgagaccagcctggccaacatgatgaaaccccgtctctactaaaaatgaaaaaattagctaggtgtgctagtgagtgcctataatcccagctactagggaggctgaggcaggagaatcgcttgaacctgggaggcagaggttgcagtgagccgagatcgtgccactgtactccagcctgggttacagagcaagactctgtctcaacaaaataaataaataaataaataaataaataaataaaaataaaattacattatgatagaatgaagcatcattatgctcctgttcatatgccaccacttctctaattaccatgtgttaggagaatcttgggaacgtctcttctacacacctgctgtttgtctggggtcttaaatcatccagtctactgctcacacataacatgtagcctacctgagtgacagcaacccctttctgactagccccgaccagcacctctctgaaagtgtgggaagaccttccagaggagctgtggggtggagtgcagagccccagcactggtctttttgccaggtagcccaactgcttaatttctgagactcacttttccaagactcaggcctgctctgaatcttaagcctactccctgctgctgtcacatgttcagggctgtcatctgtaacccgatgaacataggttactggggcttccttcacaattggcctatagatgctaggcagtgtgctcaacacctgaaacctacttcgcttggtccccagcaaccctatggcataggttccatccttatgcccattctaccagatatacccagaaaacaaataacttctctaggttacacaggtaaaggcagtggaactgagaactagaacccaagttggtttaattgcaaagcccatgctgtcaagtagttgtgctggttaatcctgtagcagcaactacagttggtgattttcactaaaacattgaataacatcagtatcaatgacagggttctctgtctttcaggagttaaagtctgttatgccatgtcaaatggtagcaagaaaaaaaatgctaaaatagacattaaaactgtgatgatgaaacagtgagaccaatttaaaaaatagaatttacacagccaaatggattctttcaaagtatagtactgaaagcacagccatgatttcattgttcaaagcattttttcgattactatttatgtagcatcaatgcctgtttataagaaaattagtctcataaaattatagccacaccttatacttttggtagacttaatgagttacttaggttgaaatgttaaagggattaaaatcaaggtggggacaagacaaaagcttgtttcaaatatgtgaacggtataactcacaaagaaagcataattagtgtatgttgttgtataagctgtgactaacatagtggctgtaacctctccaatgatgactagttgaatctcaaatgggtttctgaaagctgatgtgttagtcaaaacacttactattaacggaacccagtggagagtcattttctttttttttttttttttttttcttatttttgagacagagtcttgctctgttgtccaggctggagtgccatggtgccatctcagctcactgcaacctctgcctcctgggttcaagcgattctcctgcctcagccttctgagtagctgggattacaggtgcccgccacaacgcctggctaattttttgtattttcagtagagacagggtttcactatgttgaccaggctggtctcaaactcctgacctcatgatctgcccccctcggcctcccaaagtgctgggattacaggcatgagccactgcacccagctgagagtattttctaacaccggatttgttcatagtagtttccgagttccaagacatggttccacctacccccacgctgtgtcattgaagttcccaaagtggaaatacgctttacaattgatgtcagaaa

SEQ ID NO: 23 - DNA, 3584 bp, Homo sapiens
gcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaa

SEQ ID NO: 24 - protein, 399 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 25 - DNA, 48445 bp, Mus musculus
  misc_feature (1)...(48445): n = A,T,C or G
tagttccctcctcttctgtcctactttgacttggtgctgttcttttggggtcaagagcagaaattgtgatgaacctctgtctgttttcccttaggaattctgggagtgtcccatgaccccatgccgggtagtcttgagagaaaaagaacagatgtcttagatccactaaaagaaatatgtttcttttcctctcctgaagtttaaatttttttttttacatacttcatgcaactatttggtacttagcagagcttgcagaccctctcttttggataaaataccctctgaacatttaaagaagaggaaaatgaggatctgggagttgtgggaagggaacagtgtctaactgtgaaggtggagatctgtttccctccgagcagataataaaaaatgtacctccatctccacctcattttcaatttctttcaaaccttggtctggcgtggtggttcatgtctgtctttctagctctctgcatcagaggtaggaagatcgcaggctccaagtcaccctgggctacgtagtgagattccatcctagataagggagagagctcaaacttcttcccagcatggaagaatcttttataaactttagtagaaaaatgcacaggaagtataaggggcagtaatagggagttactgaattgaagaaaattatataagcgcatttgtattagaagcaaagttagagtttgttgagaaaatgttttaataaagatttacatatgatttgagaaagaaagagtcctgtgggaagaggccataggtgtacacacacacacacatacacacacacacacacacacacacacacacacacatatacacaaatgtacctaaagttaagtatgtagacaaagaattcagccagtccatcaaggggtggtgggtgctagggtagctttctttatgcagttgggactgatggtgtgtgtgtgtgtgtgtgtgtgtgtgtgtgtgtgtgtgtgtgtgctgtttcactggtgctaagggttgagaatagcagcgactattgcatgctaggcaaatagtctaacacaggactattgtttatttttaagtttttaatattgagacaaatgcttaggatttgcccagcctggctttgagtttactttatagcttaggagcccttgaatttagtgttctcctgccttagcctcctgagaagctgatataacaagcctgtgtcacactagcaggtgtggttgagaagcaaaccgtaatgtggggggtgagtactggtaaggtaaggaggagaagaagagttggggagttccgggaataggtccagactttcccgtaataaggctactgcaatacaactctgttattgtgttagccttcagccccatttggtgtgtgctccacccctgccccaccccatgcttatctagatctagggtacttcattttcctactcagagattttcatatgagggtagttcaaaagggagagagatccatttcccttaagtactcctgctgaccctgggctgttggccctgcagtgcctggaaaagaagcttgctcgagatcggaggtatcagagatgctgccagtgaccctgaggttggggtgggctattagagattgcagtagtatctttctagcatggagccgttggtgtctggaaaacatacatttgagaaggttaaagttcacatttactgtaaagcagaacaatgataaggagtcctacagtcagcttttgttcttcgtacttgatttctttatcatgacacattcttgcagaattatatttctttgtttcatatgtagagacaagacgacaacttgtaggagccggttttcttcttccaccatgtgggcactgcagatcacactctggtcctaaggcttggcagggagtgctcaacctgttcagttatttagtttcccttcttgttatcccgggacttttgggatagcattggaaatgtaaatgaggaaaatacctaaaaaaaaaaaaaaaaaaaaggagaataccttaacatgaaactagaaacttacttctagatgggaaaatttctgagttgaacatgtaaataaaatgtaaataatacatttattattagagggtgccttggttagggttttcattgctgtgaagaaacaccatgaccaaggcagcttttacaaagaacaatatttaattggggctggcttacaggttcagaatttcagtccattatcatcaaggcagcttctagaagggagtggtgctagaggagctgagtgttctgcatcttgatctggcctcagccaggagaaaagtatcttttctgcactgggcagagctttaaaatccacccccacagtgacacacttcattctacaaggccacacctcctaacagtaccactccctatggccaagcatattcaaaccactacagagggtcataaggtgtatccatctgtgtagggctttacaaaaaattaaaaggtcatccatttatactgtcttataaataaagcataaaaggcatatattaaatcacagcttatgctagtaaatttaaaatattttcagataatgtggtagacttgcttgctacagtcctgtaatgataatttattcttagtcctaggccatttctgagatgctcacagatagagacttgcttgtgcattacaaagtttacactactgttctatgctctggaacccaccctttggttttgaatatagattttcctttgttagatagacattatgaaacctcagtgcactgtaaacagctgcctaaggaatgtaatagtttcccttctggcttcaagtctgtaacgatcatttgttaccagtgtaatagctgcagtttaaaaaaacattctttgaaatgaagatctctgatagggtccatgattgattatttctggggtttgactgtcttgcccaaatagtatttaatgcagtttgtaagggagctctttgatattagtctgcatatcagtgcttttcttggcagttttagtgattaagtcttttgtggaaattttgtgggactggagagatggttcagtaggtaagctgtgcaagcatgaggacccgagttcgaatcgcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttacacacacacccacaccaccacacacacacacacacacacacacacacacacacacacacacaaacaccacacacacacaatcaccacacacatacacacacacacacacacacacacacacacacacacacgcacacgtacggtatgaaaatcacttctataggtgtattgaatattcacttgattgagttattctttttcccttttgtatccaagactttcagtgtagaaaaaattattcataagctgtaaagtagcaagcatcccaaaacttataaagtggaacaaaactttataacagtggtaacaaaacaccatacaggcaaaaagcgatcatcttttcatagtagattcaatctttagctggttaagaaattaccatatgagtttgcttggctctctcttcctgccatgttttatgtcacctgtacttggaagtttgtgttcattcttctctgtgtgacttttcgcttttgccacagatgcagtagcttggccatagatgacaacttctgtctgggggaagggtctgcctgtgtaacactgtctggcctgggactcccaatcctcctgctatagcttcctgaagtctggacatttctgggtactcccactcctgacttttatatttgtttgagaattctattcttctgtatcttggtgtctcagtaccaaaatgaagaccttagcatgttggtatatgtatgtgtgtgtgtgtgtgtgtgtgtgtgtgtgtatagtacatattttatgaaatagctgctacataattccatatttaaatataatttttctccgctagtatactattgaaacattgtcactattacaaatgaagggtgttcctattaaagacttcccaaaacaaaatacccatcttagatttattgaaaggacacaatcccctttcctactaaatacagtgatgcttgactcattttgcccctgagcttgtatataactaaacacagtggtggatgggctcttgagtaagtatctttttaaattgaccttttctcattccaggaaatagttgagggtaagaatggccaatcagcagaggccctggccagtgggaccaagagaagagcttatcactgagagctggcgtaacagtcccacagctgtttttatatataaattataatactatgtaaggaagaggtgaacatgtcaggattgggcttactcccaagtttgccaaactataatacaattaattgtgttttaattttatcatttttctcttgatatgagtgatatcatatctcttgatgtgatagaagctggaggaaccaagtggagccaggcttgagtccaggagctctgacaagaatgagtcaacccttggcgaggggaaagccaataaacacaaagaaataaaagggtgaaggaggattcattacttatgcagtcagctgaccactggggataactcccaaagtgctattcttctgaacaaggaaagcaaaatgcatttgttatactgatctcttagctcctagcctctagatggaaaacatctagtcgagagactcaaagagtaaagccaaagtttacttagccaagtaggcaagcactccagaaggctaccgaggctttcccagagacgggcagtgagccaaggagcttctgtgttggggattttcatcttgttatggacagttttgaagtgagtggtgtattggtgggataagctgaccgtttgcttttcctccgaaatcatggtacacctgattttccttgtgtggtgcttcaccctataatcccctagaaaagcccaataaggtggtgcggatggtggtggtgatgttgcattgaaggctgggactgaagatgcagaagccacatgagcacatatgcccaggcaaatggcctggtgctttagtgcctgatacattgggagcaacctgctgtcagcttcaaggacagttaaccacaaagggctgttcctgaccaccaggagaggagacagctgccaggagaggagccgcagctttttgaattacctcctgtttcactcctttctgagatggctgatggtccaaggttgatcttgtgagagttggctcagacgttcttgtgatccaaggtgttttggattttgttatttttatctttatatatttaatctgcttttccccctaaatacattttcagtttttctcatgttagctcacaaagcaacgtgattcctcacggtccctttagatatatcacactttgttcttacctcttcatctctctcctgccccaatgccttctccctcgcaccttctccacctccagctggtgtcttcatctctttagctctttttcaaaagacatgggttattttatgtgtgtgtgtgcatgtgtgtgcatgtgtgtgtgcgtgtgcatgtgtgtatgttagtgtttcagtatgtgtgcttgtgccctcagagacctgaagacaatgttggatttcaggcgttacagtacaggtagttgtgaactacctgactgggtactgggaactgaactctgggtgcctggagatgcagaaagtgcctttacccacggagccatctctctagtccttctactgtcatatcacatatactccattgttctattcaccctctaggtatataaaacaacctgctcagtttacctgcttctgtatgttttctggaatgaccagctgacccaggataaccaactggcgtgttcttctctgcagaagacgtttgcccactctcatctctgcttattttctgtagttatacacattacatcctaactgcagccccctccttcctttcctcccagtcctgcccttacaaatttcatccctcattacccactccccttttcagagaagaggaagtcccactgggtgccaccccacccttggcccttggacatctaatcccagcaagactaagcacctcctctccacttaggcctaactaggcagaccaagtaagcaggtaaggggatccagtggcaggcaacattatcagaaacagctcttcctccaattgttagaggatacatatggagaccagagaacagcccagctatttgtatttgtagacatattttgagtctgaatcttatttctgggaacatggaactgaggggcagaaccaagcctaacttctacaaatacccgagtcttatgtgccagagttgctttagagatgtattgggcctgggtttcacactctgtattttgatgagttgtggttgtttgtaatggtctctgactgttgcagagaatagtttccttggctagagacccccatttctgtgggtgtatggacacatatttagaatgtagttatggattctgctagggtagtaatgtgaaggttgtagcttgtcctccaaaattcatgacctcacttgcctgggtagttgcctaagattgtagtatgaggtgtgatttctcgcttgttgagtgggtcttaagtccaattaaagaactgatggttactgccaaggtatgtgcccctgctgaaccctgggagttattatgccaggttgctctgttgtggttcacaggtgcatgagctgcataggactatgagttgttgccttcctttgcatgctcacatagctacaacttctgggctcttgaaagctagtctgagagaggaggctttcaggcttgatctagcacgagtcttccaggccctgcatcgaagtacgtggtgtcttcaggatagtgacttaccctccacctatgacagacaaccaagggtaataggagtctctttggcaaccaggaccaatgacttaaaagagggcttctagtgtctggggatggtgttttcattagtctttggctcttgggaacacattgtcagcaaagatgtgaaggtttcatttatatatacatgtatgtgtgtgtgcatatatgtgtatatatatgtatatatatatgtatatatgtatatgtatatatatatgtatatatatatatgtatatatatatatgccaacttatgtgtttcataggtaattttagatattttaggtaattgtacaattctttgacctttttagaattctctgttattttaccctcctctacccttctgaatttatctcccatccccatataaagccctcccacttttttcattttcccccacagaatccttagacccttctagtccccttctctaatgatcccctgcccttcccacctctaccatggccctgttttctggagttctttaagcttatgcactcacatctggatctttgaagcttggaagctcagatgagagaaaacatgtaatgtttgctttctggatccgagttactgtgctcagtgtgatattttatagttgcttccatttacctgcaaaattcataacttcccttttcttttcagctgatggtaagaattgctatatagtttaaacaaataactgggccatagattgtgggactatatgccgattttctgtttcatttctggtctatatctgatacttgattgttggcttgctgattggactagtgtagttttagactagatattgcaatgatagagcatgtgtcttccaatcctgctgttctttgaaaatttatgttgaccattctagctcattcacacttacatgtaaactttcaagtaatcttaataacatctattttttaacgtcattgaaaaagtattttattagaatttatccatatatatcgatatagggagaattaggattttaataacattgttttccaatttatgaatgtagtatatttatttaagaatcttattttttttctcagtaatccttcagtttttactgtctaggatttcttcagttaaaaaaatagttttcatgtactattgtgagaagaattgaattttgtatgttagtttcccagttattcattgctagtatgtagaacgatcagagttattatttattctttttcctgagactttggtatactgaatagtttgagaagaacatgtgctagcacctgcctattatacctggttttagaaggtctgaagagtagattcagggccatgagttccagcactcactgagataaagagtgaattcaggcttgacccaaaatatatgatgtgatgtgatgtgatatgatatgaatatgatatgatatgatataatataaccctgccttgaaactgcgaccacaaatgatggaagcagatcttccttcctttaaaggaaacccttagtccttagttccagcttttagtacacgtctctcagaaaagccctttttaggtcaaatgggctttcttctaggtgttgataatttttatatggatgtgttttgttaattaagtttgtcaatatattgtcatatttttattactttattcttcctactgtcaaagaaatattaatttcttaggtgtaagttttacttgcttatattattttttatatattggaagatatgatttactaatattttatatttgtgtcctgaccaatatttatatatgttttgattagttagttatcactgtatattggattggcaagattagttgacgtctatttctcaatatatgttttagtattgatattatttctttaattgtgtgttggaatgtactattgaaatatttaggcctagaggttttgagcataggtgattcattgcacagttaagctttgtctatagagaaggaactactaagttttatttgatctttgcagatgtagtcattggaacacatggataatgtccagtttactaatgctttggccctaagccttgtcttgttcatagctctcgctaacattctcaggctttggagtggtgctctttgtttctcttctaatacttttcaggtttatcttctattacttatatttaatttcactgaaatttatgttctgttgattccataaaagccacgttttgtaacagcaattattagatttttgtcaataatttatttcactgatttctgctcttttgttacttcttgggctctaactatttgggcaaatattcatctaagagaaatgcagtgtgccttgaccctttcatctaggcacactgaactcatatgtagcattgatactttattatcattttgtaccttgtctgcctcttttcagctgtgttcataatatagtctcactgtacatatgccaaatctgccacacattttcattttgttctagaaacatatttttgataaaatgtgatgaagttaatgtcaaaatatctatataaatcctcacatctattcaattagtttttttctgacatatgataacagttttcaaatcaagtcatatggacaccagacaaatagtttttataaattttgagtgttgtggggtgaggatttaaatgacgtgtaatatctgaagaaatgtttcccctgaatactaaatccaaaactgagttggtggaatatttcctttatttgtaattcaagttaatctacatttggctattgatgtttctatttaaattctaagtcttagactgatggagaggtctactatatatcctgtattcaagatagtataataaatgaccaaacttttcgttttcctttaagctatttccgtgacagaagaagtaatactacctcagctggaaagtctttgacactgaaaagtgagtctccgctttaaaatctctgtacatttgtttatcctcatgtgatcaccttaaagtaccgctagagttgttttagaggcagcctgcctgaggagttggggattctggggtgactgtccttactttcatacaaaagaaatgggcactggcattcctggaaatcacacatttttgaaggaaagatgttttagatacagccttccatttgttattattcaaaggttttcagctaaattaattatttcatggtagtctgatatatagacttatatatgaaaaagaaaaaaaacattttaccttggtgaaaagtttggtactcttgttttggtaaattggtcattgcttagttctttttgcttggtatttgaaaatgtgattacacaagctctggaatatttttcttgactgattactctacttttgggcaaagcttccctagaagaaatgtaaatactgaggattctttcctctagataaatccagttccccgattcaagatgctttcttgaaattgctcctttctaggtctatttgtaagtgtgctactagctgagcatggttatagcatgaggtctgaggttttatatgtctgcctgttacataaatgaaccccttagagttgttggctgagtgttagaaatgagctcccttcttttaaaatattcttggttttctaaactatcctaatttgcacactggccaatttctgctgtccagagacacaaccggttacatttcatgtggatcctggagactagcaaggccgtaggaaactggttctgccttcagcattgctgattgtgtgggcaaaggagtgctatgtagtaggaagaccatgggcagagttggtttagagcgtaagaattgagcatctttctggactcttgtagaataatgagtaagctgtgatgttgctataaaataattaaacaatgcttttatcgttattgcttgctctattccacatgattcatcttttccattctcattctgtaattcctccaaaagattcaaatgaggataattcaacttccatctttccttacggagagacatttctcttccagagactagaaagttccaaggttagtctcattcattttcttttatgtttccatagcagttgtttgttctgtagcttatccatgcattttcatttccttgtaagctgcaacagtggtgctttccataggatttccagatgggaagactttagcttggtcgaatcatggcaatctttagctatggctcatgtagacacatttttactttgacctaaaaaatatggaatagtgcattgaagaacttgccacagtgtcacttgctatctggaaatagtccaaaattactaaagcataaacctccataggttttaagtggccatatattctgaggcagacttcctaaggatagaactttggagatcttatttagattaataactcaagcttcatatctactaattctcctcatttactattttgtttcttgagttgataaaagagacatgggagaaaaatacatagtagaaatagctaaggatttgatgcaatggcaaagcactggtctgttctgtacaaggtcgggggtctgagccatagctgctctccataagataacatagaaacaactaaaatccacaaccagacaagtcacagaggggcttgagtatgtgggatttattgttagttaacattgtttattcttagttaatgtaatgaattaatttaaattaaataccaaggatatcagaaactgtttgatatttgctttgaattggtttgaactgaaaatttatctaaccagttaaatttggttaataaaaataaactcaaatattgtatgtgtttggaaagtactgttacagtataaataattgccgaaaccaacaagcacaacaataaatgtatttattttgaacagaagcgatctataaagaatgagttttggccgcatgagaacacagttaaagaggaagcagccactacaagaaactctatcctaacccagtcaaggtacgctgtgtgtgagtgctcatgagtccctcttcagaatagaagtcataagcatggaatcccccttcagaataaaagtcataagcctgcagacattttgctcattgtataatgaagttctacaacagtcatttacctgagcaagttcacgtctttcctttccttcctgaatgttttctgaacagtattcatcttagtccttgagctgtcatgtgtaaatggagtagctatgtttaatctggaagctgagtggtttctgtagcagcttatttttgtctcctactgactgcattcatctctccaacccttgcctgaggtggtgagcatgcagtggctgtgtccactctgcccccaagccccgaaaatcagtatgatgtttattaaacttagtttctccagctctggttagaccttatacaaagcatcttaaaaacagaataagcttaagaagatttataatgactgaaatggaataactgtgtctccatgattttaactgccatgaatttgcttaaaaatacacctttttttttttttttggaatttcaagagagggtttctctgtatagccttggctgtcctggaactcactttgtagaccaggctggccttgaactcagaaatctgcctgcctctgcctccagagtgctgggattaaaggcatgcgccatgacgccctgcttaaaaatacaccttaaatgcacatttgactctaaagtctctataatctaagtaccaacaaatatatgttatatactctgcagatatgagcaaattttgttagaatgttaattctttatgcaccatttggttattgcttttgagatgggctacatgtaaggacaaaggaaaaagagacagtgtaaaaccaactggacttagaattgtgaaaatgcagtgtgtcctttgtgttagaaatctactattgaagagatcacggagcactcttttttatttttttttggtaacacatatgataaatacccaaacctaagctttatatttctctcagttttagtaggatttgctatgctggattataactcatattcactttccctttctgcctaattttccaaagctaatactcttgtgatttccttgagttaaaaataaacaatgcatcgtcagtgataagaatctttcatgaaaaggaatgtaaaatggctgggtcacatgagtctttaagttatagatttttagagcatctcagccagaaagatgcctctgacctgtactctgtctcaatgataagcaaaattctccttgtaatggtattcgtttcatataaatgagtaaacttattttgtcatttttgaaatctgtaggaatgtccttagctgttatgagtgcatcccagtaaatattagacgcatttcagattttacattctgacactcactaatctatgcttgtttgttgactagcaatgtggtttgctgtttttcctcattagcatcatagcatagtactgagctgtcagcctggctctctgctgtattgcattagggtggagcatggagtccctcaaattgattagacagctaggtaaggaggaaacaatgtcttcaggggatgagtcttccttatattccctggagattagagatttgtaggacatttaattgtgctctttttgatgtttaaattttgatgaagtgatggcttttaatccattgttacttgcacttagcttccctcaggtcacaatctgattaaattatacaaaagaccttgtccaatgttcatatatgtcataggataatagaatatttgttttgaaaaatttcctggaaaatatatgccctgtgtgtgtgtgtgtgtgtgtgtgtgtgtgtgtgtgtgtgtgtgtgtgtatgtatgtatgtatgtatgtatgtatgtatgtatgtatgtatgtgtctgtgtgtctgtatttgtatgtgcaagtcctgaagaagtttttaaatcgatcagatcgggtaattgaacctttaccaaaagaaccttttggccttaactttctgtggttggttggtttataggttttaaagattcaacttccagtttaaattaaccatgtcattttgaatttgattaccattctttgctattcagcatatatgataacaggaaggaaaaagtgagtgaagacaaagtcgaagacatttggataccccgcgaggataaaaataaccttgcacaggattcggcttctgagtcagaatactccacagtagaggaatgcttccagagtttaagaagaaaaaattctaaagcgtccaagtctaggactcaaaaagccttctacttggaccccttcaataggcacagttatcctttaagctccacgagtggaaatactgaaccgtcatcaaccatctcaaatgccatctctccctatgcctgcttctatggatcttcagcagccaaggagaaatgtggatggctggacaaactctctcctcaagggtatggacagacacattttgtttactaagtagccattttgatagagtaaacattgttctttactaaatctgccagtgttctgtaccctctgcaatccccaagatactttttttttttttagaattaatttttttattaggtattttcctcatttacatttccaatgctatacccaaaagtccccaatacactcccctccccccactcccctccccacccactcccactttttggccctggcgttcccctgtactggggcatataaagtttgcaagtccaatgggcctctctttccagtgatggccgactaggccatcttttgatacatatgcagctagagtcaagagctctggggtactagttagttcatattgttgttccacctatagggttgcagatccctttagctccttgggtactttctctagctcctccattggaagccctgtgatccatccattagctgactgtgagcatccacttctgtgtttgctagaccccggcattgtctcacaagagacagctatatctgggtcctttcagcaaaatcttgctagtgtgtgcaatggtgtcagcgtttggaggctgattatgggatggatccccggatatggcagtctctagatggtccatcctttcgtttcagctccaaactgtgtctctgtaactctttccatggttgttttgttcccaattctaagaaggggcacagtttccacactttggtctttgttcttcatgagtttcatgcatacgtttaacaaattgtatcttatatcttgggtatcctaagtttctgggctaatatccacttatcagtgagtacatattgtgtgagttcctttgtgattgtgttatttcactcaggatgatgcccaccaggtccatccatttggctatgaatttcataaattcattctttttaatagctgagtagtactccattgtgtagatgtaccacattttctgtatccattcctctgttgaggggcatctgggttctttccagcttctggctattataaataaggctgctatgaacgtagtggagcatgtgtccttcttaccggttggaacatcttctggatatatgcccaggagaggtattgctggatcctctggtagtattatgtccaattttctgaggaaccgccaaactgatttaaaaaggacttttcagtatgtttgcaaatgctgggccctaggtaggtaagttgcatgaagtacagtactgcagtatggtttggaatagcaacttcaggttgaaattaaattagaactaaggtttgggttaaaacttcaagttatgcgtttacctccatattatcactgtccctttctaacttgataataaaataaatgtgctttcctgggtcccacttcatattaaaacaaacaacacagaccgagttatcattccttagcttacactctttggattttgctcttgtcataccagtgttctgtttgagaagacaagctagagaaatgaacatctttgtttaaggtttaggtcaccttgttctagtatcctaattttttaatgtgcatcaatgatacatcaagggtttttatatgatttaaagcaacttaaagacatttttatatttgaacacattagtattataacagctttgctttgaatttttcatattttgaatatgctgttttagtttttatatgttgctcagaaaatcagaacccttaaataaaatgtcaaaactgatttatcatttcagaggtaaacaaataaagttctttcctttttgcattatgtagtatggagaaatctttgggcatagatgccatttttaattagattctttttctaacttttttttttagatgttatttatttaattgaaggttttgttatttttatatttccttgtgtttttttacattaccttattaatttacatcacggatgttgccctttctcccctttgcctcttagagggtgcttcccctctttcccatcaggcatccctcctgtccctggggcctcaagtctctgcaggattaggcacatcttttcctaataaggccagacaaggcagccctctgctaaatatgtgctgggggccttggatcagtccctgtatgctctttggttggtggcttagtctctgggaggtcccaggggtctggattagttgaagctgctggtcttcctgtagccatcccttcatcctattagactgaagttggagagctctgtctaaccttctaattttaaaatatttatttctgctgtccttcaagaatgactgcagtatttgggagtaaactttcggatgtctaagtaacacatgtgagtcctcgcgataggctgtttttctcttatgtcccctgtgattgttctgcaaagccttggtttaatccaaagtaagtttaggagcaaaggttctttagaagcagatccacgcatagtaatagtatgactcatatctcttaaaacgtaaagccaaatataatttgagtattggtcctatcagtactaggtatatgaaccacgtgtcctttgagaaacagattttgaagagaatgcatatttaaatatccaaagcaggggtccatacttatgtatataagttcatgtaataaatcattagaagaaacataagctctagtattttccagcatttcgtgtctatgaattattggtagttagggagacgtagctgtggttgcagaacactaatggaagactcagagaattcttggtgtagagcagtctgtagctaaggcttactgggtagcctgcaatggtctgttgcacttgacagacttgataggctcatgctctgggcacattgagaaagcttgatcattttggctatctctgggatagttagaacattttccattttgtcttttaataaaacattgattttccccccattccttgaaaacctccctatggggagggggggagctgtgatttttagatttatatttttccattttgggaaaaatgattcagttatttttttaatctagcttaaatgttttctcttggataacaatatgaatggatataagaaaataaataaatttttcatgccaaactttaaaaatatctcttatacatgatggtgtttcctggcttaaaagaaatacttataactggccaaaaatcatatagtaaactcaaagtagaatctgaaactcgccctttcctggctggactctgttgctcttcaaagctgtttatggtaatcattggtttaataaggtggccctcctcatttcttacacagagcttgctgagctttgtcttatggccagttgcttctggtacatgctatgtcaactgagatgacattctaacttctataccagcaaccatcattctttccaaaaatggccaagtaggaaatatttgtgaccctacagcttatgtgctttctattgtaacttttcaactccgttgtgtcaacatgaattcagatatcactaagctgtagtaacagtatgggaggctgtattccaataaaattttatttgcaaattcttatggcaggccaggtttccatcatgggctttaaagcataaaccacagaagtggatgtctcgtatttcatataaccgctgtattgtacctcactgcataccagatagtataacagaataaaaggtattaaacaatattttcttttcatttttccatgaacacactttatttttaatgtacagggattttgtaatacaagtggatgaattcaatgcaatgttagtatgtgaaaatttatatatggccttgaaagcaataggtctgcattggcagggcagttaccctttggtgtttttgtaattggtgttccttaaagctgtatatatgaatggtctaaatatagtaataataagatgctagctaatatttttccaagtaggacttttaagtgtcctcaacattcatgagtgacttttaaggaaataataaaatgtacaacatggactttacatggttgaatacatgttgtctttggaaacagaaacaacagttttgacatcctgtgaaaactatcatttttataattcataaaaccacaattttataaagaaaacaatgtcttgatgaaacattgccagttgaatttaaattccagaaagttgggcaggcatggtggaagatatctgcaattccagtgagaggcagaggcaaatggatcagtccacgctggaggtcagttttgtctatacaacaagctttgagttagagtggcctagatatagtacagcctaagactgttggtttaggaaattatgtagcaaagctgctttggggatgggtctcagtggtagggtgtctgcctagtgtagacaaagccttggcttcagtcccccagtactgcaggaaaaaatatgtatggaagaagcttttaaaacaggaatccataacaggagactcataaactgatatgggctattgccattttgcttggtttcctttagactttgaaggtaagtctttataactgaagatacaacatacttcagacacaaggtagaagaatgaagcttaaagtaacttggaagcttcctgtcagagggatagccctcatagtatctaaatgtgctttggatgaaagaaagaagagagagagaaagagagagagagagagagagagagagagagagagagagagagagagagagagagcatagccctatccagttgaaatcctgtgaaccatgacaatgactggcatggcaagatatccccaaggacacaataattggaggttggcacaggtacttgacagctgtccagttggacttactgcctgcttaatagacagaaattcatgcttttatgcaatacccagtcatttgcctgtgggtaggaggtcgtgtaccctggaggataccctaccattgccacattccaacatcagtgtaatatctaactgcgttctaaatgggtattcttacactcaacagctaaatacagctcccattccttatcaaagaagctggtttttaagcatgaagagaacattatagaagggaatgattggttaaagtgcagtgagctgatcacagggttcccagctccatttgatacatctattaacacagcactatacctaaggatcacggaatattggaaagaaggagctagaaagatttcattagcagcaaaccacagtatttgttgctaggtggtgacttctatatatgagttgcacccatacaatctcaacaatgtgtttacccaagtaagactagcacagtggtaccatggaagaagagttgtctgtgattaatgactgctgagagagagaaactcagtcttgtctagaggtaatctcctgagagattatcctatcttaaatggtcatctctaaacacacaggcatacatgcaagcatgcgggcacagaggagaaactgagggaaaccaaggattgaaactaatatgagtacagtacttatatatgactttaacaagagaaaaaaaacaattaaaaatactgagctcctaccagtgtttccagctagacaaaacagcttttattaaaaacaaaacaaaacaaaacaaaacaacttaatttacagtactttggctttaagaatatttgattgggctatgaggacctattgtgtcctgacctatagttcctaatttcaggggtctcatatctatataggcacaggtgtgaaggactaagtacattttatctcaggatttctccaatattgaatttggaggaggagtcttctaaattataaaggacaaagaacatggttgaatgtgctgtgctgtttctaggaaatgcatcctgaaaccttgaagcccatccaaaatacagatgcactttctaattttttaaacatactcttataattgcttatgtggctattgtaacaatttgagcatatttataaaaacaaggatgatgatatagaaagactttcacatttcatttgacaggatcttttaagattttattttctctctcttatgactgtgttttgaaaactttttcattccgtgggactgcctgacgtagcagcaaaagcatgtgttggtagagacagggcatctgaggatagcacagaacaggtagtgaaaacgattgcttaggaatgaatagaaggaggtacacgggatcaagatgcctccttggcctttctggtaggaggggcagaaaaaaatataccaagtgttaggacattggtagggaaaggctcagagatacagtgtaaggttgcaggggggggggagcaatgcttcttcaaagatgtatagaagggaatagcatttgttgttcgacattggtaagacttttaaatggagttttagaataaacacttctctgcctgccaagaggaaaaatactctttggcaggtgatatcaggaaggactggggtgtgcgacagagctggggtaagaccaaaaagtggttgatatcattttattgtagatggagaaaaaaatgttccaggaccagtcaggagaagccatcagtgaaatcagacttccagttaacagggaaagggaggaaagaaaaaccagtggtcagttgccaaggaaaggtcaaaccaagagaggtttgagtcagagcaggtcagccagggacttctcaggaagtgagaattgatgctctttgggcctttgtgagtggtttctcagtcagtgtccagtgatctgggctacttacgtagggcagttccccaccttgctgcaggaatgaggatatctctggtgtttgtaatactttcccatggcaaggctggcagtggaaggctactttgggaagctggcccatttatttttctgttaagtaataattacctggttgaactggaagttgaatgaaaatatttgattaaaatgatcacttttatactggtgaaacagctgtgcattttgcaaattacttatcacctgtaatagcaagagaacaaaatgtgttgtttacagtgtaagggaaaaacactagtttcagtttccattcaagtaaactgactaattcagtcagtctggctgaagaaaaatgcttaaggtcataggagtcaggcaggctaaattagagctgccaagatgtctttctttcaaaatgtcacttaaacctgcatagaactcagcaccggcctttcccgcatactagtgtaaggttaagaccaaggccagctttgtggaatccttagaactgacacttaattggcactccttactcctcagtcttctgtcccttcagagcacttattgctgctgatgatatttgactctgttacagggacagagttctagtccttttcttagtgatagacttaagggaaagatgctgtcatttcaccttgaactttgagagcccagtccctttaactgctcccagatcacattatttaagtcagaaagttttctaaacaagctagtacacagacaaaaatacaaggcaactcttgccatgcagtctactcacaagccacctccagctttatcatttatttgtatctttaagaaactgtatgtattgcattttctttttttctttttttggtatttcattaacatttccaatgctatcccaaaagtcccccacctgctcccccacccactcccccacccacccactcccacttcttggccctggcattcccctgtactgaggcagataaagtttgcaagaccaatgggcctctctttccactgatggccgactaggccatcttctgctacatatgcagctagagacacaagctctggggggggggtactgggtagttcatattgctgttccatctatagggttgcagatccctttagctccttggttactttctctagctcctccattgggggccctgtgatccattcaatagctgactgttagcatccacttctgtgtttgctaggccctggcatagtctcacaagagacagctatatctgggtcctttcagcaaaatcttgctagtgtatgcaatggtgtcagcatttggaggctgattatgggatggatccccggatatgacagtccctagatggtccatcctttcctctcagctccaagctgtgtctctgtaactccttctatgggtgttttgcattttcttggcactgaagaagaagtctattgaattgtcttgaacccaggtctttgcacatattgaacacgctgattcacggatttagaacaatagcctatattttaaactgacacacagaggcataacatttgaatgtattgataatattatttttccaaacatttgtaccttctgtaatgcctcagttatgttaaaaattatctataccatctcaaacgttactcagcaacttctcaatagtttgttttgacattttgtcccctctggtgtgtatatgaatagaactgtgctctcatgtgcttgggcttttctgcataaagagttaatctttggtttgctgccgaggaagagctgtttattcttaccactgtcctctcctctagcatagacacaattgctatcattctcttaatttagttatctaaagattataactgtaatttaattgcatactcctgactatcaaagctattcatgtttcagttatgtagtatagtatcaataatttttatttcacaagaaactgctagtatttatttgaaataggacctcatgtgttccatgttcggcttgaacttactatataggcaaagatgatcttaacccctaatcctcctgcctttacttcaagtttatattttaaactgcctctttataaagctcccattctcagacccttgccctcactttcacagtcacttttagagttatagtataccttcttcctaccaccaatgatactacaaccctctgagaatctttaaaccataaaaagagcagaaccctatgtagtctatgtgtttcttatatatccattggatcttctctctggagctagaatcacaattgttagcctccacataggtgttgggaatcaaacctgtgtagtttggaagaccaggcagatcccttaatcgctgatcactaacttccatccattgtgtatgctagggttttataaggatgactccagaaagcaatgccaatttttaacatagacgttcatatgttctgtctcataactactcgtttctgaaaattcaggtttcctggggcaggggcaatcccaattggtatagtgtgtactgcacaaaattgaggacctgaggtcaatcccaatatctgcataaaaatctgtgatgctggtgtgtgcctgtaacccaagtgcatgggatttctagcctgatagtctagtcaaatcaatagatcagtgagagatcctgtctcaaaaataacatggaacgagactgaggaagactcctgacctttatgtgtatgtacacatgtacatacacataaaaatcaggcttcacatgaaattatgggatttgggacaacataggtatacctagaagatgctgtgtacagtgaaataggccaaaccatagaaatgttacataggtgtaacatctaaatagttctcgtagaagctgagtatagaatagtggttaccaggggaagagagtggagggggaggtccagattcttcaagcagtacagaattatttatacttagatcagagtaagctctgctatacactgctcgttcaccctgtattagcagtgtgaattaaatcagcagtgatccattataaagcttaaaaaggtagagtttattggctcatcataagattataaatgtctaagctgatggataggctaattaccttgaattagtcataacaaaatatatacatgaatgagaacttcaatattgtaccatataaatatatattatatatttaatatatataatagataatgtataatacgatatataaataataatacataaatataaatatataaaatataaataataatatataatattatatatctaaatatacccataaaacagtgttaataaataaaatttgtgctttcacctttacttctaaaattcttaagttcttagaattttttgctaaacagtttgatttttcattccgacttacaagtaaaagacatggaggctggagtctaaagtctaagtctgtgtttgttttgttacccaaagcatctggtgagatactcttagaaactagtgcttggatttgcttaaaagtgaggaaatgtactttggaaaactgctgacatttcatagaaattctggagaatcgttttgcgtgcacttatgtcaaaatcacttcattcttaaaactccatcatttaaaaggctcatactttagagagggattagaggcatgcatagcaagctaagacgagtaattaggtaaataaacatgtaggcgtctagagactgttctagactgctctagactggtttgtgtcagagcactggttaagaatggacaatacctttcccttttttttaggattatgcaaagaaggccttcgacctcagttgcatgctgtcgatcccttctttccacttgaggttatttagaataaatgtgacatgtaatctgagtataaatcccaagagtaataaaagccttacatgtaacaagatggccttaggatcattccagttgtgtaccttaaagggagcatgctctgtctcactctctctgttaatgctattgcagagcttattagattagaactctttttattgaagcttaaagatgcaatctttacatctttaaaaatattgaaacaaagctgggtgtagtggctcatgtcttttttccaagctcttgagagtcaggggcaggtggatcttcatgagttggaggccagcctgatctacatagtgggtctccaaaaagacagcattacatggtgagaccctgtgtcaaagtcaaaacacaacagaagaaaacaaacacccactatgaccaccaccactactattaaaaaatcccaaagtctgttctttccttaagaatgaatttaaacaagagggcctctgtgtgactccttcataaatagagatttaattgcatgtatttacatgggtatgaaagaaagctttctaaaacacacattttgagacaaaacctgacaacagacattgaagcagtttttatgaaagcagttgaaacttcaaaacacctgccctgccggagctcaagggaagactttatagaaaactgtttgctgatacttcacaaaccttataaattattctgaaaaaaagcctcttaaagaaatgtgtcccttcagaatgctaaaagtaagagaagctaaaacccaggctaataaacctcctgtctgtggtacctttattcctgaagggactctgaaacgttttgcaggattaagcttacatgtaaactgtgtggaggtcaaatgctatcagttattactaactaaaggcatgcctgggctgtttggctgtcaggtgtcctggaacgtcttctgggtgcttgttaagaatgctgtcatctggaagagagtgtttgtactggtagtggaatggggagggatgttataactaacgtgtggttatgtgcctgaatctgtaaggtaaggatgccattttttttctccttttgttgtctggagattaaatgtgttaatgcttataggtggctcggaagagttcctggaacaaagcagtatgtgtgctactgcctggaactttaatatttcttcttgggaatgcattattatgtccaatttaactgcccaaagtggcattgtctttcataattccttattattgatttgagaatctcttgaagcaaactgggctgttgaacgtgtagttttgtttatgtatgtgtgtgtggtatgcctgtgtgcagggcatatttgtataggcacacatacatgcttgtgtgcataccagaggaggccagagtctgacactgtatatcttccttgattactttctatcttttatattgatgcaggctttctctggtgaacccagagatctgtgatttagcaatcctggctatccatcttgcggtgggaatcttcccgtctttacttcccaaacaaggagaatacagacaggcttccacacctatgtgtcatttgtgttggtgctatgaacctgactcccagtttcaggtttgaatgccagacactacccactgagccatctctcaagtctctgttaaatggcgttcaaaaaacagatgtttacatactttaagatgtcacagtactttaagagaaacttaaagtaattaaaaataaaattaaaataacaaaaggggatgtatattactagcctgtcctccaactgataattctgtctcagcttcgaaaatgctatcactttttgggtgatacatatcaattgtagagtggattttaagctgagaacttgatatgagccaggcgaggaaccatgtagaaatttctgagtattgaatatgtcttacaggaaaaccgagaggtgaggaaggttctagggatagacaggtagtatgactcagaaggaattgtccacagagtaagcacccacaaagacccacaaagacccacaagacagaagtagaagtaagaagatagcaaaacgtctcatttctgacctagaagggcgtttctctgggctactcattctgttatttacaggctgggacttaactgttaattccacatagtctcaaagatatttagcaatcttaaaaaaaattacaaaaccccaatttaaaactgatgagctcatgaaatagctacctacagttgagaagattatactttctgggagattctttcttgccttaaggttgttacaagactagagttctcaaagcaaagcccttagcctagtgggcactgagctgtccatctccctccaacatccctgctgtcctccacatttctctccatcatgctcttggatgatgcctctggcctctcacacaggtaggcaaggctggcctgtagtacagtggaggtcagctgtgaattcagcacaacactgaaccctaaactgactttaaaattaggaatgtttatactgtattttttttttcttgtttgtgtgtgtgtaacccaagggcatcatttttgagctttaatttagtagatggcggtatcgacagtcttgcaaacagttgggcatttctgggtttcgacagaattctgtgtgaacttgtggagccaggtgggggaagtggctttaggctgaagagcttgaatttaggctgttacgtgctcattagcacccatgtcaatgtgggactatggtgcatggctactcacatttataatcccagatctcagggtggaaatgggaagagcccatgagctccatagcccacagtctagcacagatggcaaaattcagcccctctgagagaccttggttcaagaaaggaggtgaaaagctgtagaaaactgcttgggattgacccctggcttttccatgcatgtacacaagtatatgggtacatacatgcacatatgcacacatgcacacaattatatggatgcatacatgcacacacatgagcagtcatatggtatacacctccacagagacaaacaaataataaaatagctaactaaatggtctgaattatgctgtgttaacataatttctgggcccttttcacttgctactcttttagactgtggatttaattctgaattttcataaatttaccggcccttctgcaactattattttagaacaagattggatatgagcccggttggatgttttctttttctttcttgtctttctgttaggttttaaaaggactaagcttagtcatattacttgttcattcatccttttgggcatggtgtcgggggtagagggagcgagagaatgagaacctatttgggtcttagtgttcatagttgatcataaatagaatatgaatcatttctggactttgtccctgtaaaagagtaaggtgcattgtgggatgttggcattaagaaagtcaacaaatatataaagagattgcattaacggctacagggaaactagaggcacttttccaggaaaactctggttggatatgtactagtttgtcagggaaggaatttgtctgtaggtgtcttagggataatacttaaagttagtaagggaagaaaggggaggttaggaatggatttaaggtctctattctacccctagatattgatcttattttatatcttaaagttgaaaattacatgttttattaagctcttaggttcagtttcaatggaagtgaggtgtggctctgcacagacctctggctttccctagttgctgttgggaccctggaggaagaagcacatttgtttgccttggaagaactggagagagagaagaagacactaggtggagagtggataggtgcatacagtatataactaacaaggagtgtgtgcatactgaagagtgcctttccttcaacctgccagtgctggggatgtgggagtccttggattgttggaagtgaaaagtcagctctgactatggaaagcattgctgggagaagagataggagaagccaagagaggtgaggaaggagccgatgagggggatcagatggaaggaggctgttgactagtgtggttagatgaggttagggcccagagtgttctttatcattaatttaatatttgtatatgaaattgttgtatgtgctagggaacttcatttctttccctgttttgtcattagagctggttggctctacggatgcatatgtttgttaatgattagtgtgggaatctttctgtattttacacaagtaatagacctttggctggaaagcagtgagaaaaaactcccccagggccagaacattctttttctatctttaactgtcacgaaagccacaggaaatgatactaagtctttaaatgtgttttaaaactgcaagagagagggagagagaaatgcttagtggtgactggttttacttttttcaataggaagttagtgtttggtatctattaaaagcagaggttatcgtggtggcatcagcccaggctgactgtatatagagaagacagttctcagactagggactgttgaatgcatgtttgttgggaggagttggggaagaaacttaaacaaaacggaaaccacatgtgtgcacaaaagccccttcagcagtccactgtaaactcagcaaaacgatctttttaaaagtctaaatatcaaaatgggattatcttatttttcccttgattttatttggtgtcagaattttaaactgcatttgccttttatatgatcctatttcaacagtatgctgtttaaagagattataaatactctgtagtttgacaaggatttttcaacatctttaacttgaaatacattattgatatgtataaattcaattaacaagaccacattagcttagcaacatagcgttcactcaccaatgatcaaagtaaaataagatctgagccggagcttaatgagggatgagagcatcatgtcatgcgccccttgaaggattatcttcttggtggaccatgggttcagtggtggagggggtgccctcgttttgttgtgcagggaccctcacagctgcatgtgaaggcaacgtcgacattatattattttgcagatacctacattatctaaccagaatgtgctactatacacagtctcacagtgcaataatgagaaatgtagacctgaaagttgttacagcctcttgttacctctattgtctaagagaacaatgaaatgtactcaacatagggacattacagacacatttgaattcgtgtcatggaatgtaaaataatgcttttcatgtattttacagaaaacgcatgtttcagaagagatgggtgaaatttgatggccttagcatttcttactacaataatgacagagtaagtactggcatcaaagattattttacatacactaagtgtgcggaaaacaagggaatagttgaacacttttaagagtagaaaataatatattatcaacatgaaaagcaagggaatatgacgtaatcactctccatgatttaatttcatagaatgtatggctaatttttatttttagtgtatacatctttttttttaaaatttttaatttttttttttttggtttttcgagacagggtttttctgaataaccttggctgtcctagaactcactttctagaccaggctggcctcaaactcagaaatccacctgcctctacctcccaagtgctgggattaaaggccaccactgcccagcaagtgtatacatctaatagttatttttagagcatcttctacaaattataggaaaggttgtgagctatgtaaagatgaatacaaagtttccttcatccctcagagcaccaagatgtatacaaaccacaccataaatagaaaattgaaaagcaagtaggggtttgcctcatcctcctgggagtgagaagggtttgaatggaattctattgctatgagtttggaagaaaagaggtttgtacatgaagaaatgttggagaataataattatttatagaaagaatatgaaaagaagcttacatgagaaagttttggccatttgctacaaaacatatagtgttttctggttgtgttgggaatgagctttgtgcaagggagatgggggagatgatgctgtgtggttagagcctactgaacgtcctgcatgttggtgagagtagctgagttgggcagagttctgggaatgtcttcttaagctttgaaaatgtccttctttttaggagatataggctgaaatatttgtcgggattgtgttattataactgaaagcagtaaaaaatagtattgcctgtgtatacattttatttgccaatatatacatgtgtttgtattcatgtctaattaaatataataaattctgtattttatacagtggcatgatgagtcctctgaatcctagcttgtgtgttattgtggatgaagccattagaaatatgtaaaagtcccacctgtactgaacccgtacatctatttttttcttattctttaaattagatattaaagcaactgtttacatagcatgaccatatataagatattataagtaatctggaggtgaataagcattcattaggatatgtataggttatatggaggtacaatatcatagttaagggcttgagcatttgtgggtcctggtgtctgatgagtttctggactgaatgtctctcagatactgagcgatagtgttatcaagtgttaaattttgaagttacataggtaattattgtactaactttttgccgtatgtttggtaatttcctcagtgaacaggtgaaactgataaatataccatcctttagttaattaaaatgagatacttttcatcctaattatattttatatttgaagttttaattttaagacaaccatattcttttacttatatattccaattcaacattgtattctcagaagttgatactgcattatatttgtggcttgcttgtttttggtttgaaaagagatgtgtctactcctggaaggcaaaagagtttatatacttacagacagaaaatagcacaggcagtaacaaactcttgcaaccctcgtgagaactgtagaaggcttcaggttggattcatttatacagtgacctagatagagtaacacattggtttaaaccaacatcctcttggcttgcaaagtggtgggatgaatatttgtaatcattacttgcttgacagctatttctagtttgtttgtatatcttaccttcatggtatatcacatatgtgtccatgataccactgggaattctgtgtcctgagtcccgaggatagcatttttgttattggttttctcttttattgtatttttcataaaatatatgattcttgtcttttgcctctttttcaacttttccaagatccttcccacctccctgtctacttaactgtaagtgtatactctctgtactgggtagttttatgtcaaattgacaccggctcaagttatcacagagaaaggagtttcagttggggaaatgcctcaacgagacccagctgcaagttattttctcaattagtgatcaagcagggtggtgccatctctgggctggtagtcttggttctataagagagcaggctgagcaagccaggggaagcaagccagtaagtaacatccctccatggcctctgcatcggctcctgcttcctgacctgcttgagctccagtcctgacttcctttggtgatcaacagcaatgtagaagtgtaagctgaataaaccctttcctccccaactgcttcttggtcatgaagtttgtgcaggaatagaaaccctgactaagacactctctgtttgaagaaaaattaaaatgaacaaagaaccaagtagtgagaagcaatgacagaaacaaaaacctatgaagaaaatggcttcgcggttcaggattaggttcataaccagagtgacctgggagaaactaactgctactgtcccacaatgtctggtcttcttgttggttttactggagtgcagagaaagtgtatttaggagtgggggggctttcttgtcttgtcattgtgttggtgcagtttttcggtactccaacttaaggagggatttctgctatgtgtccaagcagactggattttctctccatcatctcagagcccatcatacttgcactgtagtgagcctagtgtcacttctgacgtttctgcaacaaaaattattgttaaacgtttataatcatgtgatttcctagaaaccttttaactgagcaccactccttaaaacatattccagttacatgtctcttgagacatttcaatcacttgtgcccagatgattggtttcatctcgccacaacattccaccatttgggagttgtttcctttcttctttttttttttttcttaaaaattggatattttatttacttttcaaatgttatcccctttcctggttccccctccggatcccccctattccatcccctctccccctgcttctatgagggtgctctttcacccacccacttctgcctcctcatcctggcatttccctacagtggggcattgagccttcacagggccaagggcctctcctcccactgatgccagacaaagtcatcttctgctacatatgcggctggagtcatgggtcactccaagtgtactctttggttggtggtttagtccctgggagctctaggtgagggaggggggtctggttgttttttaaaagggcacagtttttacctgggcccctctgaaaagacacttgcttacagatcacagctaatgctctggtcagctgtgcagtttggcagctgtgtgaattgaacatttgaataatgaatgtctccaagtgcctctaagtgtatggttgggcatcagggtgatatgcagaagttccattttctggtttgcttctatgttcctctgcattgcccagcgacgcctccatgatgacttcctcatcaaattacagaaacagtgtcatccacacggccctgatatctgaggccctgctaagaaatctaactcaccctgattcccactcgtcggtgtgcagaattgttctgtggttgtttcatcatctgaaagtggcagataaatgacagatttgacctagatatctatgtggtcaaacctcaaggggcgctttcaaatttctttaaggaaaatttcacactttggaaaacaggcatttgaacctgctatccatcttttttctgatttttgttttgttttgtttttactcactactgtctttatattgttgttacataaaaaatatacagtcaactctacagcgttgaaaaaaatcacaagttttgcctgagatcttataatagatcataaatgaggtgttaggtaccttgtggcttcctggagtcgacttgacaaagtatttagtttgcaaaatacttctgatcatttctttgttttccacatgtctctacgagaagttataatctgttaaataaagtatcattgttatttatgggcatgtaggtttttgttttgtttttaatgaactgcctgctagtttcttcttccttttctttctatttttttcagtgttgtttggatttccttcactgacaaacaggttagaggtagcacagaacaaactgctaattatctcattagggagctttttttcataagctattataaatcttaggaaattaaagttttgtaaaagaatacctgggtaacaatgtgtaaatgattttagacatttaacaattccaactgtctggtgtcagccacggcatacatataacaaacttatttataagctgtctataaaaaaagccctgcttcttctacctctgtagatcgcctgacagtgggaagttgttctctctacccagtttctacagtgtctagtggtctagatttgccctcctcttgtcattttaacttactttgatttccagagttctctttgataaaccaatgatgttatgcatttctgggtaatgatgtttggtaagccaatcctgtcaagtgtttctttgtaataacttccatgattatttggctgcatacactgggcaacttgaggactattcatttccctgccatgttttcactctgtgtgttccttctcatcttctgtttgaacctctttagttatttaatccattgaaactattgttagctgttgaaacctaaatgaggacctgtaggatggctcaccaggtaaaggtgattgtccctaagtgtgaggacctgggtttaattcctgggacccacacaatagaaggatagaaacagctccagcaagttttgctctgacctgcatatatatgcccatacacatacacataaataataaaaacaggttacaggtaaaaagataaataaatttatattgaaaaccatgtgtaaatttcaatcaattttggtgttctcctccataaaccttggctttgttttctcttgctgaatgaccgttgatctgtaatatgtcataaattctaccaggaaaatgagttgaaaggatgaaggcaatttagaagagggttataatgaataaggcatttaaattaggaaggtgtgtagtaatattgaggtttagtagaaatgataaaagaaattccaaaaatattaaaaatgagctgtcaaggtttggtatatttgtaattagacatgggattcaatcattcaaaactatttctgaagcaacaactataagaaagttggtaagggaaatagttgaatgatctagtgtctacactggaagacattaataagagtatcacaggttatgacaactttgattattgtataaatttaaatgtatgtttattataaagcaaacatacacatcactgataaactggagtaattgcacagataagtgtcaccgccttaggaatggtaggacctgaaagaaaggcaccaataaataaagcagactaaagtcttaggcaaccacaattcagagcctcagacaatttatactctgagagttaagaaagatcagatgagtgaagttcttatgacttcaattgtgtaaaactgccaggataagctcaacattgcaataacatgtttttccattgaggcatataaaagatagtttaagtacttaatgggatcacaatagcaatagtcaatgatgaattatcagaagtaagatcactcctgtccactgcacctagggagagcacagaaacacattccaggaacaagtctgtgttttgaacaaactgaggtcgcacgattcttatcctctttccttggagtctgctcagaattcttctcaccggactccatttctggactgtgttcccacactgaggatgaaggttcagagcagaaataagttgttcagtagagtgtatttatgctgatctatgaaggattcattttaaatgtgaagaccatccccagttgagtatggatgggagccattcactttctggagtcacatgtcaatgccatgttcattgtcagctacaggagaagttctaggaactgaagtgtacatgttgtatgtatttagaatgttgttagattgtgaaaaggactttgacatgtacatcaattcagggatgagatgttggacaggaagagtgaaggagaagttgttaataaagctaaagaagattcctagtccataaggtgcatgttggcaactagagagggcccatccttcctgaagaacacagtgttactgagctcatctgcttgtgagggcaggagggtgttgagaggagtgctgtctgtttggtacatttgtctcaaactgttatcttcagtatgggtatctgaattcccatataaggtaactggagtttcttccttatgttagtttaaaacagtggttctcaacctccctaatgctgtgaccctttaatatagttccttatgttgtgttgatccttaaccataaaatcatatttttgttgctacatcataactgcaagtttgctactgctctggatcataatgtaaatatttttggagacagggaggttgagaccactggtttggactttgtgttcatgtgacaaaatgtctggcataagtgggaagagctttatttggggttgtggttttgaagtatttggcaccagtgtttctgagctaatgcagaagagcagggtggcagggatgcatagtggaacccatgtcacagccgccaacacgcagggatcaaagaaggaccagagccaggtgtaacctttaaaatatactagtggtgaccctcatgtttcccaattagtctctacttaagattacaaccaccatctaaaatattgttacaagccaggtctcacattcttgatgcatgccctcagaaggacacttacttattcaaactataaaatgtagccactgccatgggggagaatggaagaaaaatccataaagggcctacataaactctttagatatttgcatcttctggatgtgagggtggtcttacagcctcatctttctgtgttctaacagtcagggagagatttcgccatgtttataaaacacttaagaattaacaaaaagaattaagggtttatgtcttttgagttttgtgtcccaaaatttgaattcccttctgaacttaaattacacggtttcttggatgtataatgagtctgaagtttctaccacaggacagtattaatatttcactctcgattaatcattgatggtcattctgcccagtagtttgggagttctaagggaagttacgattgagagaaagcggtcagggttttgaggaccctgggagccaaattataacatgtgtgtaaatgctgattccgacagcagatgcacatttcttcatttgctgtgattgtttgtcagaggcatcttcttgcactgtagcacagggatgaaagcatgaacttctatgcctggctgttgtgtacccattgtttattagagaatggaaaagaaaaatgtgactcagtatgagactagagtcatcatcacccaagcactgaggatacggttagttaatgagatcggacaggctgctcagggaggttttgttctctgtgtgatgcagcagtactttgagatggttctgtgacagttcctgttgtgaccagcagatgcctgcaaacaccatcgaatcattgtgaccagaccgatttagagaatgtattctgggtttaggaagtgtatggcgctggtctctcggtgttgtttgtatttggttctttgccttttaaatctagacaactagaaaactgaaacgatcattttcttttaaaagcacaggacattttgcaattttttttgcagtattgaaattcagtgtgtttgtttgtcattttaaaattttacatcgaaatcatggaaggaaaactgctgtgaatactgagcctttcttattttaaaatatgttcagaatgtcatacaaatctgtctgcatcctctctaactactacaggagatgtactcaaaaggaataattcccctcacggcgatatccacagtccgggctcaaggagacaacaaatttgaaattgttacaacacaaaggacttttgtttttagagtagaaaaagaaggtaagattattttcagtacctctttcttttcccccctcccccatctctcctgtaagaatctagctgtgggacttaggcagacacagaactgagtgctcagtccacactgaccttgaactctgaatcctctgtcttcatttccacaaactctgagaattcaggcacacaccaacatacccgtgtctaagatgatttcattatcactgtgcacatacttagagcccttcgtttctcacaaagcaagttcgtaaaacaggtaaagaaaactatagccacttttacctctattgctttcaaataatttatatttgaagaagagttctttgaatgcataatgttcaagcctaaaatgaccaagttgctctttgtgtggttattgttatatacaaaaatcatttagtagggagctattaagtatgggacatttgtttaagctgtagccatataacaataaaaagtggacaaatcctctctcagagactgtttcagtgtgtgatttttgatagcgcaaagtaggtatttaatactaaacagtggatgtcctaattatatacaagtagattttagggatgcttaaacaaggaagtccttagcgaaatatgctggctggcacagtaatctctgggttacagatttgtgctgactcttataactgtatcattttcatgggaatcatgaactatgtgactcctggtgcaaaggtgacatgtggggagagaggaatgcttgctgctgagaggatgactcgggttcacccttgggaaccatactgtggcagggacagttgattcctgcaaatcctcttcagacttaccccatgcgcaaggcacatgtgtatctccactcctgagctcatagatttgtatgtgaacacacaagcatacacacacacacacaccacatgaatgtgaccacaacagtgcaaatgtgactcgtgatttggccttagtctaaatgtatacagaagaatatttcctgaagttggttagtacaggaggggaaaggagtgggaaaggaatgtacttttggttgattctcatgatgtggatggctgtaaaccacactaggtttaaataacacaggtgaggctacatcctgattaaataataagagatttaccttgttttaagaactgtgttgggatagatttataactgagctgattttttcacagtcctatcccagtatgctctatttcaataatgactatttgaagaacttactggatattgtgaacatgccaggcattttgtcaaattcagcatcttagcaaccttgtaatgcaccgtgcatggttattgttcagttttaaacatgagagcatctatcagcagagacaaccctgatgctaaccatgagaagcagcattgccctttagactactctgatcccaggacatgtgttaacatatggcaccaagaaagtgtgcaataaatatatatttctaggaagttcccgcgattactgaagatgatcaatagtgagtgtatccagctgcctgtcagggaacagtgcttttttcagactttgattactgatggtttataagatcaaactagaagcttatgttgctgctgaaaactaaacatcacactaagtcccctaaaacatggcataaaaatatcaaatagcaatgcttgtaggacgtattatatggtataacaagtctgtgttgatcttgtatatggaccatgtagaaaacatctgatacttctatttctatgtttaattttaaagacatttttacctaaaatacaatcacgatgcttccttccttcttctcctttgttcagcccctcccaagtgcctgccctcaaactcctttcgtgttctacccttaagctcaagataaccctgttcttccccaatttttgttgttttagacacacacacacacacacacacacacacacactcactcacacatacacacgcactcatgcacacacacactcactcatgtacacacacacacagaggcacacatgcacacacatgtatttacaaatatataaatacaacctgttgagtcagtttttgattgtatgtacgtggtttcaggaataatcagtttatattggttaaccaattgggtgctcgctcatccatggaagaggctaacttcctctgtcagcgatcagcagttgcctatagcacctgtccattgctgtggacctgtgaggattttttccctttcctgtaacatgtctgttggtattgccattgttcagatgttgtttctgcagacatttctgggagagacactgtcatagcagcagacttcctggtattgtctcttaacatttttcctacccaccccttcttctaccttatggcctgaaccgtacattcaggagctgtgatgtagatgtggctgggctcctcactatccactgatgtctgtattgtgtctagttgaggtttcctgctattgtctccatttactttaaagagaagcttccttgacaacgggtggtagctctacttctaggtgagtgtaaggataaaatttagagtgtagcaaggaattatgctagtctagcaaaatggctataatagattatattctcaaacccatgacctcactagccctggaaagttagctatgtttcttgtaccagacattgttccctcctgttgagtgggctttcagtccaattaggctgctgttggttaccatcagcatgagagagccgcttcctttcccttctagacatcatcccattttcctcagtgctgtggttcatggatgtcacagccgattgttaattacttctctcccttggaaacttttataatattttctggtactagggaaactagactgtaggactataactcccaaagccatacagagcatggctgttgctcttggctacctcctagaggttgaaggtaagctcaggttgctgaagatatcacacgcttaggacacagaactcagattattcgagatcacttggtatttacaagaaaacaaccctggaacagagatcactaaccggggctacagcacctccgccccattcctttataaatcaccccataggttcttgacagcctctaccctggagcgctttgtagagctttgtgtctgagtagccacttctctaaatcaaatcatacctaaaataccattgcaggttggcattttccacattcaaaatgtctaatgttttgattattctgggttacaggatagaagaattgctgttttcttaattaaatgttcattatgttgaaatagtattactttgaaaatggtctccctcagagagaaatttcatattgactcctcttgctctgagagagataaggtgggtgtggggttcctggcattatggtctccaggcatctgtggacatattcatagctatgcatatgacagtttccagaaaggtgatgctatggggacccaccctcagggttagagtagagatgaataattctgatggggatcgtgctcagcacagctttcacatcttggctctcatttttaggtgatgtgtttctgtccatcttaacacattacagacactggattgtaggctggcctgtaagtcactcatcaacaggcttcaagacagtccccaaggcggttctgactctgttacctgggaggcttttaaattactaacagtctattagacctggcatgagaagcagaattataaaaacaacatggccagaagcatgcaattatgaaatgttttcagactctcccatcgtttaccctccttattctctgtacaggtgactctgctttgttgagtactccatactgttctggaaatctcctcaagatgtttcaggactgtgctaggattccaaattcctttaaagtactaaattacaaataatgacttttgaacaaaggaatgcaaaaatctctgtctacttttcactactattaataatatacttctgggagtaggggactagctcggcagtgaggttattgtgcaagggcaagaacctgggttccagcccgcagtgcacataaggccagggatggaaacaagtttgtgattccggtgctcctgtggtagaatatgaggcataaaggagaatctggatattgaccggcaagttactctatcagcaaacaagagcccatcacaagtaaggcaaaatgcctgcacaggctgtgctctgacctctgcactaacaccgtggtggccatttgtgtacacacacacacacacacacacacacacacacacacacacacactaaaggtgactgctactcagtactactcatatatttgcccactttcaaactctatatgtatctgtaaacttttctgaaatttgaatggctattctgtagcagttagtggcctctttagctctgtaaatgttttctcttgcgaataaatcagaataaagtggtgtgtgtgtgtgtctatatgtgtatatgtataaaattctctttacttccacaccccacttctcatttcctcctccaaaaggttctcttcgcacattcatgtcttttgtgtgtgtgtgtgtgtgtgtgtgtgtgtgtgtgtgtgtgtgtgtgtgttgatttatggcgcactgattttaaccaggatcatctgtgtgtccgtgtgtatggaaatgtctattgaagcctgatgacctgacagtttgctgcacaactgaagatgactgtccctcgcccagaatccaacagttttaaaaaattcctcagtcaggcacagggctccatgaggcctttctccattatgatggtcatttgatataccagtcttgtcatgacccagtgacccagtaacctagtggcctttgcaatggtgatcctgtgctgaagatcgcatttcaagtcccccccccccccacatttctctcttacatgcttatctggtacggtaactctggcccaaaccccatggttgggaaggtcatagatcctcacctctgttgtacagttaaatagtcttagcattctatccatagatcctattctttacagtgaactgtagtgactgtggagacacatggctgctcatagtgtttacaataaatgagagatgagtgttcagcctctagcagggcactcattccttagtgttcgtttacttcccattattcttggaggccttgggaggaaaatgatcctagggatcgatcattttatagtagtgctgctccaatttatatgcttaaaacgtgcagttgacaatttcaaattaattactgagagattgagataatatgctagctgtgatctaaaaaccacaaagctttggtttactttattacatatagttgttacatttgaaacatttattaatatccagcaaagcaaccattctttagattactagatacttggcaggaacatcttgtatgagatcaacattcacaagtgataaccacagtaaggtggaaactcttcccaaaaatgtagcatatttttctagtgcaagctggacctgttgacgaagatgtcacactgtggagtgtttgcttgttgacattaactcaagattccagaatgctttcaaatatataatagcttcagggatatttggagtgtacttcatccagatatgtaagaaaaccctcatttgtgggggataatgtaatgcctggaaaatcagtattgactttgatcattgaaccctttttagtatattagaagttgaggaagtatagtgataataataataatttagaaattattattgtgattacttattgtgaagtaatcttctatcctttattaagtatgagtacatctcatatgaagacttattataacccacaatgaagttcctgagggtagccttgtaatagaagctggcctaaatcccagggtttggccctgtttactctttctataagaattttttgctacctgtgattcagtctgcttaattaattaattaattaatttttagccttgataatccctcttctgtttaatttgagggccattgctatccttgaacataaagattcccttttggtttttgcattttgtcttatttttctacatctatgggtcctttcttgtaaagtctactaagatatgttagctctctgaaaatgggcagtgttctgtgaactggattatcctgccatttctcatggctaatttatgagaccctttattctgggctgttcatttttaagctaacatccgtgaatcagttatgccttactccctttaatacactgactctttgaatgcccttatatttcattttaattttgttatatctctattgtcttattcctggattctatgctcccagattgtcctaccagccgtaaacacaggcatccagtcagttgtctctccttgctagttatccagaagtggttttggggtttccttttcttctgtaattcaaagtagttagcggatggtgtctgtgcatatttgtcataattgtcttgcacgttcaacagcatcgttatgctcctgttaagtctcagaactgatgttggtgctgctgctttgttttcttgtgttgtccttgcccagtgtcctgatctgccattcttgcttcagggtttctttcttttttttcctcttttcttattcatttaatttttttgacattgttcttaattctcaatatctatcacatatccccctttttgatggtgccaaatgcagttgtgtaggagttgaactaactttccttataatctctgcaatacctttctcaatgaccttcagtaaatcccttctctctgttaaatggactcatgcattattcgataccatttggatgacatttattctagtctgagctccattatttgttcaaatctaacttgacttattgtcttggttactccttggagactgttatcacatttctatgccaccagtagtgtgtggtgcataattaaaggtcacttagcttttatggagggagcgttagtaccatgttttacttgtggatgccaagaagtgcatactgacaggaggagcctgataatagctgtattctgagaggctctactagagcctgacatatacagaggcagatgctcgtagccaaccattggactgagcacagggtccccactggaggaattagagaaaggactgaaggagttgaaggggtttgcaaccccataggaagaacagtatcaaacaaccagagctcccagggtctaacccaccaaccaagaagtacacatgaagggacccatggctccagctgtatatagtaaaggatggcctagttgggcatcaatggtagaaaaggcccttggttctataaaggctcagtgccccagtgtagggaaatgtgagggtggggagacaggagtgggtaggtaggtgtataccctcagagaagcaggaggaagggtgatgggatagtgggtttctgggggtgggggtaattgggaaaggggataacacttgaaatgtaaataaataaaatatccaatttaaaaaaaagagagaatcatttgttgagtatttccctgcttaatctaccagttgtgtactgatgctactttctcccgtacctgtcacctgccccctgcatctctgatgaagtaacctgacagacagcttaagggaggaaagacttatcatggttcaggcttcagagagttccttgcatagtannnnnnnnnnnnnnnnnnnncatagtagcttggtctcatgtacttgggacgatccaatcccagtgggaagggtacgtaaaaatagaagtttcttcatctagatatatagaaaaagctaaatggaagaacagtacttgtttggccttccagagaactcctctgtgtaactactttttccaactctgactcttcactcctctctccataacctcccaaaataccatcactagctggcagccccaagctcaaaccaggaccctaatggaaatatttcatttcaaaatgatagcagagagaaaatccggtctcatgaatcatctcagtcatgaagaaggtattagatctcctggagttctttctaaatgtagtcttatttggggctaaaatggcgcctgagatgtggcatttcctgtatgatcctggaaggtcatcatcctggctccagggcatctgcatagggcatctattttgctaaaattgaactgcctctgctaacagggaaatttaggctgtggttgtggtagagcatctgtacattggcttcagagcaagatcttaggttgatactttttatttgtatgtcttacatattttctcctctaatttcagaagagagaaatgattggattagcatattattaagtgcactgaagtcaccatcacttgcatcacagttgcaagcagctgtagcccctgagaaatgtggatatcttgaattgagagggtataaagccaaaatttttaccgtgttaaggggcaacagtgtgtggctttgcaaaaatgaacaggtgagttcgttacactaattgtgaattgctcttctttaatgatagcgactgtgcttagcttttgagagctatgtgcatttttatttatagtttttggttttgctttaaaaattctattaactataacaaagaaaatctggttgactgctgtgtttcagccaagttcctttatcgggtgtgcgggtttgttttcttttagtggactgagaaagtagcactgttgaaatgtatgcctaaattgaagttatgtatagctgtcagaaaataactgaaaacaaatactgatgttcatgaatgggcctaattccacttccttgtgataaaaacccagaaagaaataattggtaacccagtgtattagctgcttttctgttggtgtgaaaacaccatgaccaagggccctgtagaagcagcagctgattttagcttaaggttctagaataaatagagtctgtcctggcagtgaagcatgacagaaagactaggtaggtctgagcacaaagcttgagccataaccatgagcagaaatcagagacggtgaatgggaaatgctgacaattaaaggtctctaatcctgccacagtgacatacttctttctgcaaggccatacttctaacacttctaacaggtcccccaagcagtgctacggactgaagaccaaatattcaaaaatctaagcctacgtggtacatgtcttcttgaagccactactctaagtttaattatctttatttttctttgagcacttattctatttgtcatgaaattgctttggtaatagagggatagtacagagaggtaggtattgacatatgtgagtgcatatacttacagctatatctatatctttatatatatatatatatatatatatatatatatatcaagatatgtacatatatgtgtgtgtgtatgtcacatatacacaattatatgggctttagctattagattattgaatttaacactaaagagatagtttatttttgagaggcttgtgtataattaaagtgttttctgtatcttatgagatttatacttgattctgcagtgcagctttcattttctctactgttttagacacttttgtatgtaaaagaaaattctccctcattaggtgcttagttcttagttgagattcaaaatattgtattttgaatagaaatgaattctagaatgaattcattgaataatggactatggtaagctataatcgttgactcttttcttgtcaaaaacagagttatcaactcaaaacaagcaatagggaaaaaaataaaactccagctctttaactccagcttcctcaaaattcattgtgaaaatattcattattttgggggagtgtatattagtcaattagctgtggaaagcatgactgagtaacatcagcaaactaataatgcgaatatttagcataatcctaaaaaacagtgacatacagctaagcagtgtacgtgaaccggatgtgaatattgtttctgaagtctctgaagataggtgattaaaactttcctcattggaattcaggtcaaaactcataatttgcatctatctgtgttgaagttactctgccaatttgaggtattcatttttgtatgtgc

SEQ ID NO: 26 - DNA, 775 bp, Mus musculus
agctatttccgtgacagaagaagtaatactacctcagctggaaagtctttgacactgaaaaattcaaatgaggataattcaacttccatctttccttacggagagacatttctcttccagagactagaaagttccaagaagcgatctataaagaatgagttttggccgcatgagaacacagttaaagaggaagcagccactacaagaaactctatcctaacccagtcaagcatatatgataacaggaaggaaaaagtgagtgaagacaaagtcgaagacatttggataccccgcgaggataaaaataaccttgcacaggattcggcttctgagtcagaatactccacagtagaggaatgcttccagagtttaagaagaaaaaattctaaagcgtccaagtctaggactcaaaaagccttctacttggaccccttcaataggcacagttatcctttaagctccacgagtggaaatactgaaccgtcatcaaccatctcaaatgccatctctccctatgcctgcttctatggatcttcagcagccaaggagaaatgtggatggctggacaaactctctcctcaaggaaaacgcatgtttcagaagagatgggtgaaatttgatggccttagcatttcttactacaataatgacagagagatgtactcaaaaggaataattcccctcacggcgatatccacagtccgggctcaaggagacaacaaatttgaaattgttacaacacaaaggacttttgtttttagagtagaaaaagaag

SEQ ID NO: 27 - protein, 259 aa, Mus musculus
  VARIANT (1)...(259): Xaa = Any Amino Acid
SYFRDRRSNTTSAGKSLTLKNSNEDNSTSIFPYGETFLFQRLESSKKRSIKNEFWPHENTVKEEAATTRNSILTQSSIYDNRKEKVSEDKVEDIWIPREDKNNLAQDSASESEYSTVEECFQSLRRKNSKASKSRTQKAFYLDPFNRHSYPLSSTSGNTEPSSTISNAISPYACFYGSSAAKEKCGWLDKLSPQGKRMFQKRWVKFDGLSISYYNNDREMYSKGIIPLTAISTVRAQGDNKFEIVTTQRTFVFRVEKEX

SEQ ID NO: 28 - DNA, 117754 bp, Homo sapiens
  misc_feature (1)...(117754): n = A,T,C or G
acagtaatcttgtgtatcctttcaaggtgatgaaaaaaatctattcatcataaaaatgtaagtgatgtgagatttgaacctctgtatcttaatttgtgttggatttagtgacatgcaacaaggcttacttttattttaaaatgggatttattgcccacataacttaatagcatgaatagaataaaaaataatgaaattgacctacactaccctaacataggaactatttttatttttcttgcctctaatttatacatagttttagtaatttactttggcagttactccagagagagtaaacagacaatggctagaggtggaagtgtagctattacagcaaatgttgaagagttttttaaagaggaatctcatttattgcaaagaagattggactgggaggttgcagttgtgggtttttattcttgttctgctactaattggctctggtaattaagttagtctcttcaggtttaaatggcatcatgtgaagaagggagatggattactatctctaaggccattacttaggttgcttgttaaaattccacatttctgagctcatttcagatttgttaattcagaatttctggaaaggggttgtagaatctgaattcacaaaaaagcaccccaggtgattctgtgatggatgagccaaaaacacacattgtaaaacactgctctcagttttcttcttaaagcctatctttaggctttaagaagaagtggaaaataactatgaaaatatttgtaaaaacatttgttagagtagaaaatggcatagtaaaaactgacactcagattctttacctaattaccatgctgcaaaacagtggggtgctaatatcacataaattaaatgtcatcccttaaatatttagcaccatttcacaactgcattctgctttaatttttgcacattttctcccattccttatctctgcttatgttttggatgcctgcaatgtgttataatatgacagtttttccatattatttcagcattgtttaaaatgagctgtgtaattgggtttgtataggttacactgtagtgaccatgtttctggattcattcatccacatgacacatgcagggggcatcttctcatttctgggcactgctctagaaactagaggtacagtggtaacccacaagatctctgctttctggggccttcctgaaggggtaacacataatgtcaaataaataaattaggtttctggtaaccttctatatgtagccttgtcttcctttctgatgatgatgatgattattattggcaagaattcctatgagctgttcctcaagagtagtttacatttaaaatgttacagctatgtgataggaatccagttacattataaccttaaaagtgttagatttatcatttttatattcccaaattgacagtgtgaatatttactttattcactgctgtatcctcaggcaataagctagcactcagtaaacataggtagggtgaacttgttgaattaatgatcatttatagctgtttttattttcacagaagaagttttttttcctccaattcgctttaaaatttttttttctcaaattgtctcttcatcttctttgtccatttatttattgggatcttatgtatttcttgctaattactttatgttctttaagaaagacatgaatcttcatattttctacaatttttttctgaactattttgtttgcttttcatttgtcggttcctttttgttttgcagaaattttgtctatgtcctaaactgttttttaatctgttcaaagctgatagagcttccgtattctggaacaaaaattattttgtaaattatttatctttaaatgataggggtatagtgtgtaagtcagaattttttaaaagtttaaataaggtaatcaaatatggacatatatttaaatatatgaattcttaaataagtggtattgctagttgaaaggaatttctgcaagcgtacaagaggaagagttaagacaattggcgttggtttccatttgttctgttgtcctgacagcccgtctcccttcttctcttgatacttttttttaatatcatgttaatattaatgaattcattacaaccagatgtcttgcttggtgggtttgggtatccatttgatgataattgtggcattgaggtttaaactacataaactcacttgattaaacattctcaaatcagggtataacaagagactcatcctccctcattcccccccaacataatgttccctggtgttctggcatgggagtgaaactctaatagaatttaaatagacctcatagggcgatgggttgtgtggcacagaaaggagcagcaggatggaggtggtggcctcaaattctctgggttttgtatctggcccaactctgcatctggtgtttcccaggaaagctggtgccaatgtcatacaatgccacatctgttttcaacaaatgtttaagcaccgagttcttaaattcctggcatggaaacctggcatccagtaattccaaaaataggtttgagatttcagcagatttggggttaacaaacccttccctatttttctttttaggagtcagttttgtattttcctctttcactgtgtagttttaaaatgtagttttcgccaggtcctgttgctgcaaattcataagaataacccgtttcagtatcttggtaaatatttaccattaattttatccgaatgtttaatatggaatcaatggtatgaatactttctgtaattattaaaaaatggaaatatttatattgaagataaattctgcttttagaaccctcaaatgaaagaattaagtggatgtatcagacccttaatttatgttgctttatttactctttataataataccatgtaaggtagacctgactattttcataaataaggaaactgaggtctacataaactaaataacttgccagtgatcaaacagccagtaaatgggtcagcttcgattctccctaggcctgacctgcagtgcctacatggtcattgtaccacccttgcagtggccagatctgctaagctaagcatagccattgttattttagtgggattcatgattcttgacaacctacgttctatcacagcaaattaaatttaaaatattgcttacttcagaatctattttcagccttctgctttctataatactataactctacccactgaatttttgtgctactgtttttttcaatccagtttatagcattttaaaggttgatagtttggcttatccctggctcatgcctatttttcataataagaataaagcttgctatcagattgtagttaatgggcaatttatttttaatttaattgaacatttaccattcacattgcattctattttttaaaaattatgcctgctagttatttttggacaggactttttttttgtaattaagttttaaatagatactatgttcagttggtttcaaattcaaaaggtataaaataaaaataataataacaagagctagctagtcctgtgtagtacttactgcatgccaggcattcttttaaacattttttttttaattattatactttaagttttagggtacatgtacacaatgtgcaggttagttacatatgtatacatgtgccatgctggtgtgctgcacccattaactcatcatttagcatcaggtatatctcctaatgctatccctccccactccccccaccccacaacagtccccagagtgtgatgttccccttcctgtgtccatgtgttctcattgttcatttcccacctatgagtgagaacatgtggtgtttggttttttgtccttgcgatagtttgctgagaatgatggtttccagtttcatccatgtccgtacaaaggacatgaactcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcttttaaacatttttattccattaatttaaccctcacgaaactgatgctgtaggtgctactgttatccctattttgcaaataagtgaacaagcgagagaggaatacctgaataataaacctggtctgggttttgtcctttggccagtcaaatgtcacagtctttggaaggcctgttaggaacacaactctctcttgtgggttggattcagtacccctaccaccaggccaccaggcatttttttttttccacctactgcatttttctgttatctcatttttagaccaaaagcttcctcaaggcagatacccagtcttatgcttttttgcagccaaaggactaagcacagtttctggcacaactagatacttactaagcactgctttgctttgccaggactgttttcccattaaaaaatgactgtagctgctctgcttacttcacagaactatttaggaaatcaaacgagagttcatagctgtttgtaaacttcatagcatgcacagatagatattaaaccaattatagagtccactctatatgcttaatgaagacagatgcttttaacacctctggacgttaatgcaggagttggcacccaggacaaataggatctcaccaatccaatgtgtcatcctgttctggcctgcttatttgaaattgatagtcttaattatttcaaatggtttttggtttttgtatgttctgattgcatgcattctacagaagcagataaaatggagtctttttggttttcgtttgtagagacagggtctcactatgttgctcaggctggtcttgaactcctggcctcaagcaatcctctcaccttggcctcccaaagtgttgggattaaggtgtgagccacattgcctggtcaagagagaagtatttatgtcttgatagttacatattgcatacttatactgtctaaattagttacataatggttctgctatctgaatcagtgtttcttggcgttggccacatataaaagccatgaggttgtacttttgtttttggaaattaaaaattcttaggttctgcccccagattcatggaatcagagtctctgggtgggagggagagatcaccacaggtaatttttgtgagtatctagggatgagaagtattctaaacatgttctaaatactatttaaatactgtgaaaataatggcttaatgtccacagttttttaatagaaaatgcagttgtttcatatatgatagctctcaagagcactgacatttattgtgttactcttatgtatattttccagtcaatttatgctggtcagttctgtagatactctaattactcaaaaccatatggccatggcaagcagctgataagtgggtggtgctgtggctcacgcctgcaatcccagcactttgggaggccaaggcaggcagatcacgaggtcaggaaatggagaccatcttggccaacatggtgaaaccccgtctctactaaaatacaaaaaaagttagctgggcctggtggtgcacacctgtagtcccagctactcaggaggctgaggcaggggaatctcttgaacctgggggggccgaggttgcagtgagccgagatcgtgccattgcactctagcctgggtgacagagcaagactgtctcaaaaaaaaaaaaaaaaaagtcatctttgccttgtttgggggaaatttgaggtgttaaccagctagcactcccttattttaacagaaattacagctttacatgtggacattttatgactttctgtggagatgagcagccatctattcatgcaggagccttgatgaggctcatcagtttccataaaaggttgtcattcttaccatctgctagtatgatggtcagagtattatgtgtgcccttagtaacatacaggacttacaggccaggcccccgtcagagaatataacctggaatgatctgatacacagcttttgtcaaatgcctcattatggaggattgtttgaaggacatgcagtccacgtatttattctagagtttatttatttattctaaagtttatttctgtatcaatgtgagccatcaaaaagctgttttaaaaatatcttatcttgctactgctaccttacttaatttcctcacttgtgaaagagagattgagttcccaatcacatgcattggaagtttatccaacgggtatgtcatccagcaggagtatagctgtggataattggggaatttaaaaaaaataataatcaagtataaccctgtgccaataggctgaaacttattaaaatgcggcagattggaaaagcttgattttcttccttccgtagagatcatgttaagtgccatttttcattaagtgggcttactatacaaagtggaagtatggcactcccattctaattattttacagcactcagcatttctctgcatcttttcttttatatcactgattgtcagtttctggctagtttctcctagtacagtgaaccattagttctttcatcagaaaaaaaaattcggttgatgatttgttttctaaatgagtcatttccttattctaactaaaaactttatatattaaaaatgtaagaggctttcccacaatttgcgtctggaaactctggatactgttacaagttggggggcatttgttatagaattatttttttccacttactttataagccgggaacacattagtactaaatgacaaaaacctgaagaagagcttaactagatggagatttgttttaacaaatctggtggtgtaggcggttaagacttggtactgccagagaacagggttctccctatttttgtcctcactttcgcatccttagagcctaagaatttgtcctcaattttcccttttctaggattgtgaagttctaaaatgactctgtgcttctagcagttacttccccagaagatggaaaagtaagggctgaaaggctttcttcttctaaggcttttcggcccctcctcttccattctaccaggagttgcttaaatttgattgaaggaaactacaacacatggccacttctaagtgtaggggagaggagaatacacttcttttacttttggcgtatatagcaggagagacaaagagaagaggcagatgaatggctctttcacagtctctaacaagtgtccttactgaaaatgggccagtattttttttttttttgtattttgcctttaatattgctacttttctttagtcataatttaggaattcagagcacatttagtctgaatttattcaaataggtcattttttgatgtacatattgttttgtaaagtgtggagattatttaattgataagtcacattctgaaatccatgtgggtagatgatgtattgcaaactttaatgcttttagaatgcagagtctgttgtagccttttgaacaattttgaattttcatgagacaagctgaacatagtaactatagattttgaacaaatggcagtttttataccaaagtagcattagaggagcttttaggaatctgattgaagggagatgaaagcaataaaatattggaaatgaggtaaaattgtatatctcctaagacaagtaatgcttttgttggagagtaaatgaggggaaaaataatgataaacagcagaggtaatctaagatagtaaaacaaggaaagagcaatcagattgggctccagatcttttttctaccacatacaactagctgaactttccatgtaaccttcttcctttgtgcctcagttttcccatctttttacataactagtaatgatgctaacttcctagtatcatttccacctaggaaactgcttgacatacaataagaggtagttaatatttagcttcctttaatgaatggataagggtgaatattgtgcctactttcaaaagcaaagcatgtctagttcagtgtcagtggcctagtcaatgtttctttcacatggaagaaacccatacgctatcaatagtccaactgtcaagcttaagttggcccagtgctattatgtattgagagtggctacctaaagtgagactgattttgttgtaaaatttggtagaatttattggaatttagaaaatgtaattatactttcaaaatctttttttttgtttctttatagttttttatgtttttctccaaactaggattttaagagtggacttggtattaccataattcctatgaatgtagcaaatgtaaagcaagtggaccgaactgtgaaacaatcttttgaaataatcactccctacaggagtttcaggtaagctatttttaaacattttgtgttcgtactactataggaaagcttgggtgatccacctttatgttgttcgtggtgatttttctcttgtaggccatttaaaattatctccctacttttccatattgtctaatttgttagccactatataaaaacaccttgtaaaagtgacctcaataatcacaaaacatgcaaaaatatgtatttcatgaaatttgagtaatttcttaatacttatttttcttactaggcatggtgtatgttttttttttgaaaatatgtgataaattccttctcatttagaaggaataaaataaaaacatattacattgtctttaagttgtattgctatttatcttcttttagcctgatcaaatacaatccctcatttaaaatcaattcctaattacatttgttccatatgatttcctccagggcttaaaatgataccaaatttaatgaatctcatagcacctattgatccaaatactttagcatttttttatatatctcatattatggtattctactaattgcatcattatgacaatgaaaaagataatttaaagtattaatatggtttaataaactaaaatgactctatagttttagtatacagaataggcataagtcaacatcttttgagttcaactgtattaattcgtttgttataaataatcaacatcacgtggtagtgggcaagtcagaggcaattgttctaggcctttaaaggactaacaattaggaatttcaaatatactgtcaattgtagttactcattttgcatgtcaaaatacatccattgcctcaaattttgagaaagaaatggttgcataaaattaacaagctttatttttacatttgcagattctagccaaaactaaaaatataggtattaatatattggctgtgacaaatttctagtagaaccagaaaccactgagagtgatggaatcctaaagagcttcaaaaagtataattcatgtaggccatttatttttaaggattatttagaatatgttagctgtgattttcattatatttcaaagcatgttcctctttacaacagaaaattttaatatgaatcagttttgtgggtcattgaccaagtatgtagcactgtagcacattcctttgcacattgcaggggctcagtaaatatttcttgaaggaatgaactgctgtttaatgtttttattcattcactcgagttcccagtaaacattaagattcagaataaatcagaacgtggctaaaaatgtgttagaaaactgttagaatagtaaccacttaaaacttttttgatttcccagttccttagaaccatctgggcattcttctaattaaaaaaaaaaaagaatctattcttaaatctgaaaaaaaagtcacaattctggtgggtgtttttgataacatagtttcagactatcatggcatacttgcttggcaaaatattccagtagccctgaaactctgccaaaaacctcttattgatgattacataaccattgcttaggaaacatagcctcttgtttaggcttgtgacctaacaaggcaaattttatgttttgtttagaaaatgtgtatgttaattttggttcaagatgcataaacaaagacataaacagtgtggaaaattaaaaggaaaaaagacgaagttaaatgatttttaacagaaaagacaacccagaactgcctagcagccatatttttcagctgttgtttaatttgtgagtgaaatgaatatgcaaactgaacatactgcttaattggcctttacaagggagatcgataacacagaaacgttaattgtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggtaattagtgacaagttatgctcatcacagctttgtggcagattggcattgaatgctcttcattgttgcatattatatatcctagctaatggttatgagaagtaaaaccagagaaagcttattacatttaaatcaaattcagaaatatgagtctaaacttctcttatgtatgacttggatataaaaatggatttttaagcatgcaatcatattttatgcctactggtccatgtatagattttaaaaagacagtgttgaaaattctagattttaggtgagtatgttttagtatggatcctgaagaagcttgcatctttaacttgaagatttgtccacctttccccagtcatttttggtaagacatatttttcacctcagtgttgttttgagcactaaacttcatatgccagatctggtacctcttaaaataagaatttttataaagaagcatttcacaagactattgatgtttatgaatataaaccagtactatgactggttttcttcttgtgacctcacactggacaacctgacatctcagtgtatttgagagctcagacagttgcccaagtgagtggaaggaagtggaccccagcttaggtgtgtgatcatggaagttttgaagaaagttaaccacagtctaaacttcagttatcctggactgcctgtgtcccaccaccttctcccccactgtatgtacacacacacatacacacacaaacacagatgagagagacagagagagagaattcaactcaagtactaggcactgtgctggtgcggggaattaaaaacatgtataagacatgacatttcctccacaataatgagacaaatgttggactagagttgaatacaggcttcagtgagaatgctggagaggagttcctacctcagctagagcgcagtgagtagtgcagtcacaggagttgcttcaaatcctgaacgcttttctagagcactattcaactgcatttctcatcaaactaagatagatttcctcaccagctaattaataatatcaatcacaacaaaaaatgccagtgaatcaccttctactttgaattttatcccatccttttcttctctccagtttcattggaagagacggcctttgtgctgttcacagctgtttttttctacctttgcttcctttctttcttccctccttaggatacatgttcgtcatttattcactctcttatgtaagtatttagccatggtttcttttgtttcattgtataaacttgcacaagtttgtctcattaccaccatcaggatttctaaaagttatccatttccttctatgtgtcattctctgtcccctttttctttcatagacaagatattatgaaaagttgtagtgtgcataggttttttttcattcctttaacttcctaagttttcttcagcattctgtaatcagctaccttttaactgctgatgagctaccttttctctcaactgtggtaaaaatcttttcaccacatttaccaacgtattttacctctcagtttcggtgtggtcacttactatctttattattgtctctttatttgagtgtctcgacaacatgtctctctatgacatccatcctctctcagcttccaagataccagtctctctttgtgttcttattaccagtctttttttttccagtattttttttcccatgtatttccatgcttgtgaaatacatgtgttcccttgggttacattctcacttctcttttactgtgttgctcctgagtgatattatttatcactttaattccacactcatttttaagcaaatgattctcacgctgttggacaccaaactcttatgattatatgcctactagaatctctacttagatttgccaaatacacctcaaatgtaacatgtcaaaaatggagccatcgttgttcccctcagcccatttcataaaactgcacattttcatatattctcaatcttggtcaaaagcaatactgtctacgctgcacactcaaagcctaaaatctgagacaccttcttgactcttcctctttctttcaaacccaccaagtctcattcattttatcttatcaatctctctcaatctgtctgctccattttattttcctgctgcctcaactcagaatctgtcatgcctaggttactgcagcagtccctttcatctcttcctacaggcttttaagtttttacctgctgggtactgtattgcctgtaggtagtcattataaatgcaaacctatgcagatttcttccaggggaatttagggctttgtgctttgaatagtttctacttaaaaaaaaaaaaaaaaagacaagaacttcttacctattgtagggaaaggaatgaacattcgttgttcattagacaaagggcccttaagatcaaggatagtggactgtacactttttttccttctcagctttgaaataatctgacatagcctggttgctcagtgatgactgaatgatgatttatacagcacaattgaattgacagtaataaaattctgggctcttactttcttccagacatatttgctgaataaagtattcatgtcagatttttaagtacacacttattagacatgtaactagtttttcaatagtcaagtttttgtaacagtaaagaaatattatctgcatttacatacgtggggttttagcaagctttacaaaaggttttcagtggcctatttctagctgattaccaaatgaggaaatatttatacatgtgtctgtacatatgcactcatgcacatatatatatatatatttaagtaagtgtagttcttttttttttttttgagacggagtctcgctctgtcgcccaggctggagtgcagtggcaagatctgggctcactgcaagctccgcctcccgggttcacgccattctcctgcctcagcctcccgagtagctgggactacaggtgcctgccacctcgcccggctaattttttgtatttttagtagagacggggtttcaccctgttagccaggatgttctcgatctcctgacctcgtgatccgcccgcctcggccttccaaagtgctgggattacaggcgtgagcccccgcgccaggccgtgtagtttttttttttttttttttttttttgtcagtgcagatgctgatgatgattgctgctgtttttattgtagccagctgcgatttgtctaattctcaccactactgttagtgctcttgtcatcttgttattgaggaaagcaggtattggtgtgttttaagttgagaagatacgcaacgaacatacacagacatatgcactttctttcaaaacaaggtaaaataaatttacatacaaattaaaatagaaatgcaattgtgttttgactctaggacagcatagatctttaggaccaaaagattccaaggttagaagtctaaaaatggatgctagcatttggagcaatgaactcatcgaggtgagtcctatttaacctgaatggggttgtgataggggttcagtttgcagagactgggaggaggtttgctgtgggtttgggtggcaggaatttttctcggggctgtttgataaagttctcaccacattatggaagtggcttatagcctttttgatagtagtaactctttgagaatgcttcctaaatgagatagttattttaaaagtatagaagatccttaataagtacttagaaaggtttgccagcttgtttttttttaatgctagaactgtatatgtgtgtgtgtgtgtgtgtgtgtgtgtgtgtgtgtgtgtgtgtttgtgtgtgtgtgttttaaacccaacatgggtaaaataataggagagtgaatgaaaacatttggaaaaatttactgtttttaccttggccgtactctgtcattaactgtgatggaggctactttgctgtgtcctgtctccatttttggctccttgttccaccaccaagcacttcagacagcattagcccacctactcggccatttaaagtgaagctgtctcagtttgagtgtcaaagaatgaaaatacttttgctacaatttgtgttgtttgcaattctttccaagctaatttttctccattatttagagtgggtaggctgtattaaaaactgatcatagtatctgctttcatacttcctttttctggaatagttgagtctttcatgtgttttcctgtattttatactaagttatgctttaatttgtaatataattcagtttcctgcagattcaaatatattttatgaactgatatattatggggttttttttttgacaattcagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggtattcaattaaacataacagcagacgtggattttaatgtctttttaatgatgtgccaagattcttgagaaaaagtaaaaaattttatactatctgacaaaattattaattttattttatttccttttgtgacattatttcagtggtttcccccttgtttcatttaaggattcattgtcaaaagagcataaattcttcctccataattgaagtttcctgctaactcttgttgccacaatctgaggatttggaagcaaatgggatccagtaaagtgaagtctgaggactgatataatgtgggaagaaaggatgagaagagatgtagaggcagcttattatttcaaggcaaaagaaaaaaaaaggattctaacagttcctattgtttgtacaaagatgatatataacataagtcaataatattttttattgccgccttctcactgttcttcctccttcctatcctcggcccctgaggggaagatcctgaatttgctttgcactcatctttcaatttcccatagcacttaataattcaaatattctgcagctcctgattagattggaaaatatatattaacattcacatgaaaaacacttaatggttacttcattattatattgaaatattttgattctctgcgcatcagtcattatcatagtatgtaagcataaaaatgtcttccaaagcaagtatgatggattaggtttagaaggaacatcatagcaaccaaacaatgaattgagacctggaggtcttgggttgtaatttaaattcacataaaccaggccttttgtgcctattgcctaattcatggcataattattattagccgccttaggataaaaggaatacagactttatcccatacatgaaattatcagactttcactcattttaatagctagaatcttattttctttccttaagatgtatattttcttttaatgaccaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcaggttcgtcactgtctcttcattaacctggtctcttctgatagatccgtaaaaggactgaagcataaatctattgatttttcaaataagagaaaccatcagaatgaagaaaaatgtaattaccaaaaagatggagatgcctaagactattttttatatcatttcaatgaaaagtttaggaagtcaatcttttatgttcccgtaatcttataaatgtaagattaaaatagctaatcccacataatcatttccaccaacattaaatccgattttcatatatgaataataaatatgacttaagtgcttatttgcaaattttatgcaaagtaaaataagtatctctgtaattattctttggtaaatttgaagtagtttttcttctagctcaaaactcatgtacatattataaacaaaaggaaaattgtttacattttagatttcttgtgccttatttctttaatttttctagatttccctcaacatgatattcattccgagggtgtattaagtcaagagtcttcccagtccacattcctctgtgactttttatatcaagctccttctgctgcttctaaactctcttcagagaaaaaactgcttgaaggtattttttctcttctttttagatattatcagataaaaactttattccattatcaaaacaattaggtttagattttgatttttttgagatgttagatttgatctccaagtagagatatttttgaggatttataaatgcttctaggtgcaaatattatttcatgtactgcagcagggatttaccattggttggaatgctgagtgaattctcaacagaattcacttatgtctaccttaaggctaaccaattctgtttcaagttataaaggttattcctttataactcagcccctttccttagggatggacaccccaactggctcaccagataatgtagataaatgtgaacacataggaagaaatgcaggtttttagtacatattcaattagagtactaagtaatatcaaatagttcaggttttttttttctgatgaaaagtgtgtgtgtgtgtttaagtaaaataaaacttaagcttggtttcaaaaaatgatgggaatctgatttaacaatatattctaggtttggggaattatctgagcagagttacaatggggcatttattcatttatccttccaactccttgtgtcaaaccaatgctatgtatcgggattttagaaatgactaagacacagtccttatgctcatgtatatacattggaacaaatctaagaaatataggcaggaaaatataatgcagtctgccttactgtaacaaagagtgtaagagagattaagctgtacatgccaattgatggtggccattgatcgggctcgggagcctagtattcactaggtggtatagttcagtgatattactcaatcaaaagaatgataggatgacaaactcactgtagagtgttaatcctcatatatgtgatttgaagttcttatttcaatataaaagctttatttccaaatatatatatatataatatatcctaaagcagaattatgttgggattaactatgcattattagattttcctgaaaagaatagctgtcctgtagtgagtgagtatgtactatgtgtaaggcatggctttagatactttatatacattaattgtaatcctcatgaaagtctgcaagatcgttgatgtgatgtcagttttcacctgaatagtgaagctcggcgtgaagcagaattttacacctgatttgtgttatcattgttacaggagcactttggctttggtcaaagcgtgacagccagatgacagtagaatggccgagcatttttatcctttgaattagatgtttttggttctttcgacaattggtttttgtcatcctttactcagcctaaccaataataaatgtcagattttactgagttttttttttttgtcttccatttttactgtcagtattatccctaagtagttaaaagataagtgatcagaagatgaaagttcttggacagtctgtgaattgactatatcaatcatcaaaataattacggtactttcataaaagtttaggagaatgtttcttctaaatactgggatatcacagacttactcttcaaaccacttaacttttataaagatcaaatggggattgaaacacgagattttcttcctaaggcttttcaatatgttgtaagcattctgcagtttaaaaataagctttattttattttttggcaattgtggttataatatttataaaattactagtcttctttaatattttcttgaaacagattggtttttaaatttacttgagtacctcattgatgtaataaacaattgtaactaaataattccttttttgaatatattaacaatggatttttggttaaaatttatttaaaaaagaaactgatgcgttatctgtatatgtaatttaactagggatatttttccattttaaaacattgcattttaggtaatacgaaagtgagcttttgtattttgtctgtataattcaatagcaatgattttagtgaacataatctggcagggtattctttgattgtcttaatatcttccatccaatttaccagcaaattctatcatttcaaactcaaaatagatcttaaagcagttggctactcttcatttccactgaagtcctcccagccacagtcaccatcctgacctacctgtgctgcagtgccttccttaattgtctttctgtatttaccctaacttccctttcaaaannnnnnnnnnnnnnnnnnnnnnnnnnnnnnnnnnnnnnnnnnnnnnnnnnnnnnnnnnnnnnnnnnnnnnnnnnnnnnnnttctttctttctttctttctttctttctttctttctttctctctctctctttccccctccctccctccctccctctctctctctctctctttccctccctccctccctcccttccttccttccttctttccttctttccttccttcctttttctttctcttgctctgtcacccaggctggaatgcagtggcacaatctcagctcactgtaacctctgcctcctgggttcaagtaattatcctgcttcagcctcctgaatatctgggattataggcatccaccaccacacccagctaatttttgtatttttagtagagatgagatttcaccatgttgaccaggctggtctcgaactcctaacctcaagtaatctgcctgtctcagcctctcaatgtgctgggattacaggcatgagccattgtgcccagccaattatctttaaaaatggaaatcacacaggtagtcaggaggctgaggtaggaggattgcttgaacacagcttgggctacataggaagaccgtgtcttctaaaagtaaacagcaacaacaaccaaacaggaaaactgatcatgtaattccattgctcaagtatacttactggctcctcattccagaatataaccttattttttattgtgacctaaaagacctttttaggagaatgacgtgaacctgggaggcagagcgtgcagtgagccgagattgcgccactgcacttccagcctgggagacacagcgagactcggtctaaaaaaaaaattaaaaataaaaaaaaaataaataaaaaataaaaaagaccttcttgtacctccctcccttcatctcctgcatctactgttattcttctccatggtggtgtggtcctctacatggttacttgcctggctgcactggtttcctccttattcctggaacatgccaagtccttttctgcctcttctggaccttttcacctgctgttccctatgcaaagagggcacttccctcagtctggttccttcttcttattcaggaatcaattcagtgccccctagttagtgaggcctctctggcaccctgctaaagtgtgagcccactgccagcccttctctttcataggatgctgtgtatgtttgtcctaccactgatcacatggagatgatcctgtttccatttatttgtttctctttccccctgaagtgaaagctcaatgaggcatcagctttttctagcttgtcaaggattatcaaatctttgataccccaaacagtgtcagcacatggtaggacatgataaatatttgtggaatgaatgaagaatcattttttagggaagttactactagtgtaaatgggtgactcatatatcaatatttttgttttgatctgtggataaaaagatataattgctggcacaaagcatatcttgtgcagaaagcccctatttacaaataaacaggaaaagttgaactatccagaaaaacttctgattttgtttctttttcacccttgaagtttgtgcaatagtgttgtttctgttgaacatcagatttatgggaaaaaatgaattatttggaaagttttagagattaaagtgtggttgtcacctttgcctctgaaagcaagcacctggatgctaccactccatcagcacttgtcaggacagccatagagcaaaatgattaaaaacaaagacaaaagtctgggaataaaatgcatgcagtcccagagttacagaggcttcaaattgtcagttcaggtttttaagatttgaagtttttctggcctctggttataaagactgatctgtatttttctttcttttttttttccttttcaatttagtgttcatgaaaagaaagatggattgcttttgttgaacctaagtacacagttgaataatagcatcctggttttgttttcccttttcccacctcaaccatattttttcccttgatatcttaccttgatttgtttacatagtatttgattttcaaaaagaaagtggttgatttggattactagaaattctatttctgtttatatttaactttgtaaattagcattgaggaattttgaagatattttgttctgtgaaatcctagattgtatagcttaaacatgtttttccaaggctaaatcacatgtattttaaatgaaaaggattactaatgtatcttactgtttgtagtgggtgacgaatactattaatttaggaaattcctcaacatgaagcaaattcatagtttcaaaaataatagttttgtcttaactacctcagatgtattgtacacattctttaccgtaatacattttttgagttgaatgtatatagttcaagcatataacagatacagtgagtaactgtttgcaagcataaagagggcagcttccagaacccacctgcctgttaggttaaagcagcaactttcagaacccaattgcatggagttccttccccagctctgatgctaaatacttagtgtgacctcaggaatgtcgattaactgttatgtgccagtgaaaagggtacaaggaaggggcacaacataactgacataattgggttggtctgaggattcaatgagttaaagcatgaacagtgcatggcacataaatatgatgatgatgatgaagaagaggagtagtgaagggcttatgtttaaacagtttcccctggcttccagttagcctatgagtttaggtatgttgtcctgtaggctgtagctgacaatcaaggtatccaactatattacgcatatcattccatggtagcatttcagtgggtcacctctggggagttctttacctgtgcttgagtaaatcctgtcgtaatgtttttcttcactgatctcaacatgaagattgaattgaaagaatgaataatccctcttgccaatccactaactttacttgcatcttacatataagttcctgtttatggaacagctgagtcctgagtgtcattcattctgtggccccaattttatgttggtagacagcttcctttaacaattaaaatgacttgtggagcagagagggtttcatggagggtaccgacatttctcaaagtcagatttaggagtgaatatctaaattggcccaaacagaccagtatcattcaatataatcttgttaaacctttaaattgcttcccatatcaatgggaatgtcacgatttcctgtcacagctttgttattataaaccctcaaagacaatacgtgcacctgccttgtctgacttctggcccatttcacttacaaaaataaagctaagaaatggttacagaaatgaaaatgctacaggactgactctcctcaagcttattattctaactgaaaatgagtttgtacatacccttttaaagagatctgtcatttgtttcccattagaatttacataatgagatctgcagtcacatttatgttatgcttaattcatttggcactgtttgtttaagacctttgaatggctcccacttgtctaagtgagagaggcacaaactcctgaacacccatcaagtgagactcttagggtctggcctctgccatgaacctgcaatcttgtttcccatttcccaacttcacgtgtaatctgattctctgggcaaatagggtttttgcagtttcacctttctatgacttccctcatactgttctttcctgatattatggaaggattgtagctctgaatgcattttttgctactttagaaacatggctcctaaatcgtaagggattattttatagacatttttctttgcagtttttttttttatcacttcagtatggtgggggggcttacctccttgaatgcttctaatctactaaagagacaacctgctgattatcattttggacacatctcccctttcattggattataagctgcctgagaacaggggtggatctcctaatctatgccagtgattatctatgtactgaataattatgcattttttatttattctcttacaaagattcttctagacgtctgaatacattgttttgaaattacttccaaactccctttgattcgtattttgactttaccttttcttatattttagaaactcacaatgagtgttcatttaaaaattgtggcttttcatgatttttatctaactgtgcaggacatacactgtgactcaagatttgagggccctggaattatatttcacctttgaccaggaattgctttggtctctgttaactttcttttccattgtccataaaggattcgtttatgctatttgcttctgccagttatgattggacttttcatttggtaattcattttcagaatactgtgtcctatctagctctctaggtgtcactgttttaatggttactccttgtgattgttttttgaagccaaatacattgtcttattttctttcatgtcacccccacacccacctaagattctaatcatatgctaaaggaaaaatttgaaattagtttaatatattcttaaacttttaaattagtttgactaataatttgagacttacagaaaagttctaagaatagctcaaataattctcatatacattttacccagatgtatcaattattagcattttacatttgctgtatttttctttctgagtatgtgtatatatatgcctatgtataatacacatacatatgtatcatatgtatgtatatacgggtatatatttatctcacactttatatgcacacttaaaagtaagttgcagacatgataccactttacctttagtaattcagtatgcatttcttaaaaagaaaggcttttataaataatgccctaaagtaaccacagaacagtaatccagcttcagaaattatctaatatatagactttatccattatatctaatatatagaccttagtagtcttaatgtctgtagatctaatctatattttaggtgatgttctgatttagcctgcaggtggtaatgtgctgacttcagtataagatgaatttgaaatcttctgaacaagcattaagggccgtgcagattctgatccttcttcctttgcatacctaccacaagctgcagtctcacttttcatgctacgtttttgttttccttttaatactctacagacattttattctttgcagcttcagagttgtttttcagcaacctctttacagctctgccttctctggttatcaatgtcacagtcatttttgttttgtacattccttgctactagattgtaaattctttggagagcagagaatgtgacaactttatatcccatgcagcaataacatatactttatgtgaaataggaaattaataaatttatttacttgcatccagccattatttagaagtatgtttttgtttttaaaattggattcgtgattagctcaatttgttatttgttttgtttcaaattcttagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggtaggtctgtcattacacaattaggaggtaaaaggtattttcagataattataacaggtaatgagagttttgttatcattttagttctttagttgcttctaatagaagggttgaatggtttttgaagcttacttatcttgcgccttctgaaatttcttttgggaattcactacaaagtaggaagactaaaatatttatagtaggtaatatgaagtgctagcatcttcgaatcaaatcttatgtaaatttttttttttttgagatggagtctcgctctatcacccagactggagtgcagtaggcgatctcggctcactgcaacctccgcctcctgggttcaagtgattctcctgcctcagcctcccgagtaactgggattgcacatgctaccacacccagctaatttttgtatttttagtggagatggagttacaccatattggccaggctggtctcaaactcctgacctcaagtgatccgcccaccccgacctcccaaagtgctgggattacaggcgtgagccaccgtgcctggccaaatcttatgtaaatgtatagcatatcacttatgaccattatagtcatttaattttgttacttattatttaaaatagtggactagtggtaaaattcatttattcatttaatgagtatcataattaaaacaggtaagaaaggagaatattctatgacgatctgttcacattaaaataaacaatatttagtagcatattgaaatgctaaatttcttaaagagctgtttgttaatttaatggtcagaaaaaagtaacaatgaatagattaagcattatttatgtaatatatttgactcacatctactatggtttaaataaatctttgtcaggactttaaaagcaggccatctaagatctttggtgtgaaagtgtcttatcatgttttttgatgtaattaatgaaaaacattgatattaaaatctgaaaaaagttttataggagcatagattttaaataagatttttatatgagaaaggaaagagatttgcaaagctgttatttacataaaactacattgaacatattacctttattatatgatgactagttgagatgacttgttttatagtaaatctgatttgatttttgatgtgaacaaaactgattattaattgacttgtttttgttttaatagtgcttttactctaaatgattattcaatgtaatatgacttatggaatgttaaaataagtagattctatatattaagttactaagtagtaaatgaaatataaaaaagaatagtttatatcagcatattaatatgtttaaaatattcttgataacattactgatacaagtagctatgcagagagaaagtatctacaatgagatgtggttaaaaaataattgttgccataaaattcttgctgaattgcctcaaataacacattggagagtatgacctcaataatgtaggcactgaagatttatatagacatattttaggaagagagctggaagaagtggtaaggagattggaggaagagagactaattgttgagaatttaactagaggaagagggtgaactgctaagattaaatgactgactggacaagagttgatgttaaggggaagaacaagttacactcaagggttttgagcttgttgtgatgagattgattgtgatgcttctaaattaggacatgaaggggatacaacaggcttggggtggaaaagaggagaaaggaagatgactttagcatagggtattttgagatttttaggtaagaatagcacacatacttagcatgtgctaagaaataaatggagttgtgaatgaggaactcaggaaagaattcagagcatggaatgtcgctttaatttgatctatagtaagaataagaaatttggggtaagttgagatgatgaaaggaaaatttatctttcttaggaaaactgtaagatttaatgcttgatgtgtttgtgttctggagggaacctgctgtgtgactgggaccatttgaagttagaaaagaagagggttaaaaactgtttgggcagtgtttgctttgaacagttggtcagagtaaatcaagaaggagtggtgagagagggaagaggagaccaaggagagccctttgctacatcagtcaactgatgagtgtccagggcataaacaaagttatacaatagaatgattaaatgattatacaaaatattccttttgtccaatccagtgtgttccatttacctcatttgaataaaatgcaaaccattaacagaatctaataggatgatttcataacattagtttattttaaaaggaatttaattaaaaacatgacctttgtgttattcattttcttaagagctaaatataactggtagtatctttttatttgtgcatgttttaggcccatctttatctttgagatctacttaccctccgaacgtgtgtttttatttggagctgaaacatctcaagctcaaagaaaatggacagaggcaatagccaaggtatttaaatattatgttactgctctaaatccagagaagattgtgaactgggagtctgtgtttgagcttcaggggtccatgaaagttttatataagattgtaggaataaagttcatacttcattagattttcaaaaaaagtagtcaaaagaggtagctaccttctaggagccttaagcagggaagaaattaaagtaagacttggagaaatcattcttcaaattaaggccatgtttttgatggttaggatattctcaatactgtaaagtcatttctgtataagtctttttataggtagatattttattcaaggtatacacaaaggagaaaagagcagattcaggaaaatatataaatggagaaaaatgctgaaggttgacattttgaaaagttccacaaatcagttaagagaatgccttgcagtttcaactctatacatagcaagaaaaatggtttaagatgctgccatttgaaaatgcattatagttgttcagttttaagactgatagcaagtttagttgttttgaatttggtgttacctttgaatctttaaaattgaaaaactaagataatttgtctaccttctctcatatcagtagatagggaagggatttcctattttcactgtctttattacttttttgtatttgttttaacagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaagtaagagcttttttcttcccttatctttggaacacttttctttattgcatacaataatgatagcctttagtaagatcttgatggcttactcccaaacttatgactaagcagtattaatatttgtgtcttcatgggtgtttattatagtgttttaaaaaataaatttttgcttttcattctcccttcagcaatcagcacaatggttcaaaatggggaaaaactggatgttttactcttggtagaaaaagggaggtaagtgcctttttgctttttattccttatctcaacaactctgggcagcgggattttgttttttgttattatcttgagggagaaaacaatattttaaaacctgttgaaattttctgaatcatataaatatacatatatagtatatattagctctctttggaaagactataccaatgatatttacatatctttataatttttatgacaaacttattgtgatcaattattgtatagttttctatagacctagattcctctgtgacatttgcatttaaatatttggaaagcagtttggtaattataaatatatcttcattgtaagaatatgatgactataaattatattctgaattatctatgcatgtgggtcatgcatagctaaaacttgatttcttgaatttattcagtttttcagtaactattaagcatctactgtgcatcagggactcttaaaggtattggtgatatcatgatgagtaaacagacaagtccctaccatcatgaaacatgtatattattagggaaaacagtgtaagcagacaaaaataattatatgctattctgtccatcaattttaaattctacacagaaaaataagcaatataaaaatagtctgatgggatagtatccgtgtttgctagctaagaaaagagatcttgaatgaaagagcttcataaaacgaaaaagtaaactttgcagtaatccagatagagtatttcaggtgtagggccaagggtatttgaaaacgctaagagtgtgttgtgcttggcatgtccaagttctgcaaggaagctgtggtggctgggaatatttgaatgaaagagagagtgggaagaaatgatttcagagatacccacaacctgatcatgtagggccttatcggtcatgatgtgtgaatatttgaaatttaatcaaaatatgatgggaagctgctcagtttgagagctggggagtggaatggtctgatttatgtttttacaggattactctgactccagatgaataagcttctgggggacaaaagtgaaagtgggtgtttagtcaggatgctgggcaggaaagcagtgacttacctgagaataggagtgagtggatgtttcgtgaagttagaggtgtcaggatctgctgatggattagataagtgtaagagtcaaggatgatcccagaatttttgacctgaacaattactgaattatggtgctgtttttttgagagaacaaattcttggagaatagaggtgtaggatattagtaagtttaagacagtagatcaagagtttggttttgggaatggtaactcggagatgtctctttggtggcaaagtggatctggtgagtaagcggttgaatacgcatgtctaaaattaagtgaagaggttgtatctggagatataaatttgggagtcaccactgtgttgacgctattttgccaaggaactggacgggttcacctcatggagagtatagctagaaaagagagttgaagacatagccggaggtcccccaatatgtaaaggtctagaataggaggatgatcacacaaagaagcctaggaaggagcagccagggacataccagagcaataaggaagacagtttcttttatttttaattttggattcaaggggcacatatctacatatgtgcaggtttgttgcatggatatattgtgtagtgctagggtttgggattctattgagcccatcacccaaatagtgaccgtagcacccaataggtagtttttcagcccttgccccctttggtccccacttttggagtcctcagtgtctattatttccatctctatttccatgtaactcattgtttaactcccacttataagtgagtacatgcagtatttgattttctgtttctgtgttaattcacttaggataaggaccttcagctgcatccatgttgctgcaaaggacttgacttcattcctatttatggttgtgtagtattccatggtatatatgacgacattttccttagcccgtcaaccactgatcggcacttgagttgattccacgtctttactcttgtgaatagtgctgtgataaacatatgagttcaggtgtctttttggtagaaccatttttttttcctttggatagatacctagtagtgggattgctggatcaaatggtagttctatttttagttctttgggaaatcttcaaactgcctttcttcttcaacaaattggtttttttccccttggcttcttgtaatttgcttaaaaaaactcttaattacactggttcagtatggtttgctgtataatagtgcaagattatttgtattcttacaataaagtaagctagagaaaagaaaatgctattaaaatcataagggaaaacatatttactattcattaagtggaagtagatcatcatgaaggtattcatctgtgtcgtctttatatatgtaggttgaggaggaggagaggttgatcatgctgtctcaggggtggcagaggcaaaagaaaaatctgtgtataaagggatctgtgcagttcaatcttatcttgttcaatgtttaactgcgatataaaaatatagctaaataagccttcatttgattatttttattgctgtgacaaggataatgactttcagtggttatctgaacctgcctttccttcaacttcatgggacgacatcaagagctttatacagcgagcatattgctgattagatatttatgtcagattgtgttttttagcttctaggcgtaattaggactttgcatttttacttatttcttagattattatggttaatgatactttagattcttatttttgttactagatgatgatttcactataccgtgagagtattgttaattttatgtccagaaataatgaggaattattaggtatagataggatttgacattaaaatactagcataaatgcagttttacaatcatttattaatatttatggaatgcctactaactgctacttccatggcaggaaaataaaaaaggtaaacaattcaaacttggtgtctgacccctcagagcttatgttcttaaacaaatagacaagtatcagcttaacaaatgtgtttatccttttcattttttcaggttattataaccaacgtatttttgtacccttttttttaacctatggagtatttggccaatgatacataggttttaattaaaatgtagcaaacatggattagaatgattcagtttgatgtaattctatttagtgcttactgcatgcagtccagcccctcatatatggaagatatggaagccagagcactaaatgttttattattttgtacattttgatcttaccgctggactgcagaaatcaggagatgaaattcatttgtaatattatttttgagttcatggaaaagtagaaaactaatgaaattccaaaataatggtcacagacagttaataacatttttggtaattgaaagttttcgtctacatgtgttactaacaagttatgttcaaagtatttttatgaaagtgaagagtaataataggagtgggagaaatgtgaggataaatataaccaagttactttctgtaaatctcttcgtatagctaatgtaccatccccaccatttaaacgcaattatattatcacatgcttctgtctttggtttacttgcttttcctttttactccaaatcaataatcatctgataataacaatgatgacaatgggggcagttaccatgtgccaagccccattttaagtacttaaacagccttcttttgcctatatggtattgaggaaaataattcattttgaagttaaagtaaggtcaatttgtaacttaaatttttttttaaaaatcaagtgttcagtattaatttaccaatacctttgtagagatctttctcaggatataaagcaacaagtgttctaggagtctggatagacactataagttactagaattcaaaattgaagcatttattagaaaaataaaaatgtttactagaaaacatttttataaaattattagaaaacgtgtccatagaattcctacctaattgaaaatggagtagagagaagggaggtccacagtgtgcataaaagtaaagaatctgcacaatagatgccaagaatgtgaggttatgaaccctgatagaacaagaacaaagactatacatacgtgacaggcacagcaccctgtatggtgcaaaacagagtctcatatctacttatttacatagacacataaacatatgtttgtgtattctgtgactacatagacatcatataggaaatagtggaaaaaggagcaggtttgggagagagcctgggagataatgagtttaagacatgttgagcatgagattcttataagaaatctaagaataaattgatgggagaaagttattttttatggataagatattcatgaaaagattaacagattggagatacagattttggagttgccagcgtaaagaaggaagaaagtgaaattacttagggtgattctgtggaaataaaaaggaagaagtcctgtgttggagctttgatgactatacatcattttgggttaggggaatttgtcagggagaagtagctgcttgtttcctcagagagtgaggccagaaactaagagagagtacaaagtgttacaaagcccaggaagagggtgtctcaaaaaggaaggatcagttaaaaatgtcaagtgctgacagaaggacatgcctagtgagaatacatactccataagataagtgatttggagtccctctggtgacttgggggagagcagaagtgaacaggcaggtactagatcagattaagaatggaaattgagtaaaccaagacagctagtgaggtcactttgtcaaagatatctggagggaggttcataggattaacgaggtaaggggtttgacccagaaagggcatatatgtgcagtttgttttcagatggcttaaacttacacaagtttaaattttgatggaaaagaaacagaaaatgggagagattgaaggtctaagagagagtacaaacaagagagcaagatccctcaactgcaaaagtaagaaaagaagaattgatggatgattttggatgttgatagttttctccatgtggtagtgggatgttgagagagataccagtcaattttcaattgctttgtgaactaggagataagagtgatgatccctgagcttctggcatgggtgatgctatgaatgatagtatcatttgccaagatagagaatatgcacttctctcccagtactcaaacatagctagttaattatagctgtgattgttgaaaagctgtttcagtaccatgccaaaatgagaaaatttcattgtaccacccttgttttcatctcccttttgatctattagccctttgggaaatgatgactgtcagcaatggtagattctgttggacttgtcagtgacagataaaattgtggcttttggaagtaacacaacttccaattatttatactgttggcctatagagatagtgtgaatgattgaaagaaagagaaaccaaccagctataagcttgaaccttatatttttgctagtaacagcttgagccagaaatgtaaatcatacataaatttaatgaattaatttcacatatttttcctgttcttatctacctttgattaaaatgctaaactacattaatgtttcttaaaggcaaagaggagaaagaaccccctaaactggaaatgttcataaattgataattatcccctgtatatagtcactatttagatagatattttaatcttcatggtcattttctctatatgcatagcatgagtgtctttagacagaaaaatattgcaataatattttccacacacacagcatttttgctctaaaaagctctaaacagaaggtgttccagatggtgtcgttttaatgtgtattccttgtatactttaaaaattattttggaaaataaagctttcttgatcacacttaggggtttctggcatgctatttgatgttgttattgggacttagatcctgtgcttttcttttagaccttagtactgtttgtgcaaataaaaaaataatattgtcaaatatcacttgttagtgaatattctagaccaggaaggcagaaggcattttcctggacggtaggaaattgtatcatcactttgactgaaatgttcaagaaattacatctttttctcaaaatttgagaactatttttgcactttaacctacatcttctgcatatctttttctaagaaataagttactgtgtttaccattttcacattccatagctgcatgcccattgccatagacacttattatgcttttgttgaaaggttgttggttctaataaacacagtgtgaataagtaaactgtgttatcagaaacagaaaaggctagtgtgtttttttgttttacattccttagttgatatataataaagcataatacacttgatgtctcccaagcttgactgcattttagttttaattgcaaattcttcacataaagaagcttaatactggggaataaacactttatcagtatgtttcacaattatggaacagattacttttctcagtttgggagattagcaccctaagtttagttttccttatttcctatcaccttattccatatgatcttttctcccccttgaatgtgttttatagcagctaatatgttagcaatactccagaggctgaattatcttaaagtggtttttaaattgtgcatgtaattgcaaattaaacagtagcctattgcccacaatataagcttgactgcttttgtaactttctgatgatttaattcttagagatggcttaatctgaatattgccaaggcaaacaagagattctcttctctcaccactcccacaggtttttaaaaaagaaagagactattacaaaacaaatattaagtgattttatgttaaagaaaattatgaagaagggaatgtatgtctattaacaaaaggtagattttaaaacgtgtattatttgcttcaacaattttgtttcagttagttcaaagtacctctatgtaccaggagataagcttatgaagaaataagtatgatatgatggggaaaaaatggacaaaagaatgagcaaatccctctaagatgtgtgtgtgtgtgtgtgtgtgtgtgtgtgtgtgtgtgtgtattgtttttgttttgttttttaaagaaaagtatttttatctggatctacaatccaatgaaggactttagtaggaaaaaatgaagggggcctgagacactaaggtagtccaagaggtggaaataataggttcagagaaataggatgggctagaaacaacctcagtatgggttggccttaaccttgagtgcttgaggaggacacatgtgacaatgggcctggaaagatagattgatactctattagtattttctattgaatttaattcataacttgccttattctggaaaggattgcagagtaattcctgagtatttggaagttaaacatgcttccaaataagccatacttcacagtagaaatcacaggaaaaattaggaaatatttgatcaatgataatacaatcataacatcaaatttgtgtgatggagctataaaactatttacaaggaagttgaaagctttaaatgcttacactaaatcaaatcctctttgaagctttaaatgcttacactaaaatccatcctctaaacttttaccttaaaaatctaaaaaagagcaaattagacccaaagtggttcagagaatgaattgatacagacagtagaaagaatgaataaacggaatatatttttaaaaaatctgagccacaaatagctggtcctttgaaataatcaatttatttaataaatttttaactttttttggaaaagttaagaaaattgataaaactctaactagaagataggacagaagatacaaatcaccattgttataaaactgtgcatcagtttaatatttaaaatataagaaaatattacgaccaacttcataccaatgaatttaacacattggatataatcaaaaaattctctcaaatgcaggaattaggcaaacatatttattcccaccacttctatttaatattgtgggtttaatatgataaagcaaggaaattagaaaaaatcacaagtattggaattataagttaaaaactcaattataatttgttctttaagcaacatggttaatgaaatcatacactggtactattcaaaatacacgtgtctgataaagcactcatatccaaaacatggacagaatacatataactagaagacaaaaacccaataaaatagcaaaaaatgatgaatagaaatgtctaaaaggatgtctatgaatagccaacaagcacatgtaaagttaagtaccagagaaatacaaattaaaaccacagtgagatcacactgaaaaaactaagttttttagaaagtggcagtgcaaagtgttggcaagtatggtgggattgtaaaatagtacattcattttgggaagcagtttagcaggtttttgttttttaaaataatacagttggtttacacttaactatacatcccaacaaatgagctgctaggtatttgcccaaaacaaatcataatatatgtccacaaaatgactcctatacaaatattcaaatcagctttatttatgatataaagtgaggagaccccaaatgatttttagtcagtgaatgtgttaacagagtatggtatgtgttcatatgtgaagtactgattatcattataaagggacctatattaacaacaacatgaatgaatcttaaaaaacattgtgctgaataaaagaagccagacacaaaagagtaatactgtgtaattccattcctatgaagctttagagctgggaaactaatgaatggtgagagaaggcagataagttcttgcctaagattgtgggtggggaaaggaatgcaatgcaaagagttatgagtgaacattgtgagtgatggaaatggtctacatattaatcatggtggtagttacacaagtgtacacatttgcaaaaatatttcaaaccatacacttaaaatgagttcattaaaaattctaatgaccaaacatcactcacagaaataacacaattcatacttttccagaagaaaacaaacccaaaagcttatttggatgagaagtagggtcttctttgagaggctgcttaggaagtataaagaaaaatgcacagcatacccttctaaagctatcttccaaagtcctatgcattacatttccaacatgcctaggatgcttttcaaggcagaatgtaagtgtacagtcttgaagaagagaaataggtcttctattatgagtggctttagtagatcatctttcacgtccattctaatagtgtgactgtaataaattgttcaggaaattctgtttcatgaatcttaggtgtgataggactaagaagaaaggcaacagaaatacacatcagcatttcacttctggaataagtatttttggactcgaggaccagagttttaaattatggagatctgattcctcaggtaaaggaaagctcatgaactaggctagtactgagtagctcaaatgtgcaattcctacctagttctgataccttaaacacgttgtttctggctcttagtttcctagtcatatatggaaaaaaaaacttggcagagatatttccagttctctggctcaaaagctcaatgacagtctaagatggcatgtttcagacggctttaaatatcttttcctttaagggatcagtcaaaacttcggcttatgtgatttgtttctaattacatttttaaaaacacagacatgtataaagaaggaaacaaaatgtccatgagttttctacacagagttaatttaacattttaggaaatgcaattggatttatacatatgtgcgattatgcattctctgctcattgtactaagtttataatatatatctctggatgtagctaaatcacttaacctttccctagtttttgggatttcaacttatttccatttttgcaatgcttggctaaatgcatgtgtttgtgtgcatgtgcacatgtgcatgagagaggaacagaaatatattgaaagaaacagatattgtgccttcatttcaaatcatgtacttatgaaagagtcctgtggttggaactaattgtcaaaactaatgcatacgtattttaagattcttagaacatattttcaaatttatttttagagtatctcatcagcctttaaaatgctatgctcatcttgttatactccagtgatgaacattaaacattttagatctttgataaattgcctttgacacatcattgattttacatatatacgtgtatatgtgtgtgtgtgtgtgtgtgtgcgcgcgcgcgcgtgtatgtgtgtgtccattctaatagtgtgactttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgattaatatgtagaccatttccatcactcacaatgttaaatcacacaacacacacacacatatatttgattcttagactggtttgtggttacatcggctaattctttctgtgacttacctttccatggctgataaccgtatttctgtggaagacttactattttatttttgtataaatccttaggatattatcttttccagccatatttgtagagtatttcatttgcttttcagttttgtttaaaatcttttttatatgagcatatttattttttatgtggtcaagtttattgatctattatttgtgaaggcacttctggttcttgtcatagactaggctcaaatatgattgtttatgcttcatggttattatattgcagttttaatataattgtttttgttagtcctaggacttggtttctaaggtcttattgaactgtcttgattcattatagcaaataagaatttttctttatatggctttgaagtgccctttggaatttatgcttagaaaatagacaattagcataactaatttctctgtaattagagttcatcaacattacttttcagattgtcaggatataagtaaatgtttctttggaattcgaatccaggaatgtgaatttgataacacttgaaatctcaaagtcatccagcatttgtgttgaaaatatctttcgatgctttattcagtgtccacaaattttaggtaagcatcagagaggaaagttagtgcaccaatgctattaaatgtcaaaccatctattgcactacatatatattttaggattcgccctttgacaagttgagaaagttctactcttcactaattcatgaggagacagctcaactcatcatcagtggatttttttctgactagaaagaaaatttgaagttcaaaaatgtcacagtttatggcagaattatactcatattgtaggagggccactgcattttggatttctttcactgcttgctaaaacacccgttgtagttgtttataagcaaatagttacaaagattttatatcatatttaaaactgaattattagataaattatgtaaaagttttttctctttacctaaacttgtgaatatagcaagacataattttgattaagttcacataatcaagaggtttgatgtttctcaaaaaattatctgagttatatgatttcagttagacaaatacatccagcaatagaatacttttgagctaaagatgatataagatcaatgaaaaggctgtagcatgtcaggtgtattagtgcaaatttcagaattcttcaaaaagaaaattacaacacctggaggtcaggactgctgtagtgttgtggaaaatagaaacaatagataaagacgtcaaaaagcaagagatgaagattacaagcaccagtattagtaaaacagtagtagttatagcaagttcagatgttaaaaatgagtgtggtaaggtgcaggtatctttgtcttcttacaggagcatttcaagaaagaaaacaaaggaaagaaaggaagttttttgtttctctttttatattaggtacagtgattatcagaaatgtaaaagattacattccttattacccacacctggcccccaaagccccagaattcatgcggtttattcatgcctctttgggttgaatataaactagccctgtcaagtctgaaatcaagattatatcgttttactttggtgtaaatagacttaaaatacatcaacaattagtttatgttttaaagcaaactttgtatctagtgataggtctttaaaactgctatgtatccactaaatgccagacactatgctaatgaccggagatactgaaatactttctttgcttgcctgtgtaaaggttggagtttcgtggctaaaacattcagatagctacagaaggtgatatgatgcaggacaaagccatcagtgaaagattgagaaggagtatctgtgacatactaagcataagagggagatcaggaacagtgttaaggagttttacctggagtataattctgggggaaggtttggagtagccagccaaagagcaggcaatatgtattacagaatccaggagggtgtgtgtgtgtgtgtgtgtgtgtgtgtatttgtgtgtgtttatgtttcctgagtatcttaagtaaaggagaatgacagatcaagttgcaggtaaaaatataggctagattatgaagactttttatcttgaaaactcaagaactgtaagacagtgatctggaagtgatgtcattagctttgcgttttagatcattctggcaatagtgaggagtagacattacaggggttgagaattgggaaaggaattctgtaaggaggggctgtagtgacctgaaagaacaacatgaagatctgaaataaggcagtcttggaaaggagaggagacagagtgaatacattgggaaactgtagtcaacagaattttgtgactgaagacatgtggcagtggttgggtaaagagactgatctacacttagttaatcctaaatttctcgtggggtacgtggaaaatttttggtgccagaagcttggtatgggagagcaaaagctttgatatgcttattgcacattaaggtgaagatgctcaaatataaatattctttagtagtatagtttatacattagtcattaatgttacgtctattgagtgttgtcctaggtgctattattatatttattttgccaatgatgaaactgaagcaaaaataaggttgacttgtctaaagttacaaaggaagtaaatggcagagctaaaatttaagttcaaaaagtctgattgtcattcccactctcaggtgctctattctcctgcttttcagtcacatggagatctgatttatgaaagttacagcctggagatagggatttggaagtaaactaatttatgtgaaaagattaaactactggcctgaatggcatgtccctggagagtccatggagcttttgtgtgtgctgaggttacaactttgccattcagaaagaggaagtgagattgggaaagagactaagtgaccagaatgataggaggaaaatccagaaagaattatgctataaaattcaaattgaatgctagtttttttctctttttaagaaataaaatcgacaattctaaaaccttaaaaaacgtaaccagaaatatccgttagaagtcacaggtgatagccacaatggttttagtttagttattcagaaagagaataaaagaggctagggaatgaaaagaagtgagaccataaattcagagagcttcctcaatgctatggagtgatgtgactatgcaggcaaaagagggattgagtggaagctcgtggtggatgagataaaagaagagtttgtcttgcatgattgtgtggattttagggtaatctgtcttggagtaagatttttttttaaagagcaaaattataatttgaaatgctttttaaactttacagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtaagtatcactgagtttttattcaacccttagaactgattgtatcgttcttacaggtttttaagtggtacctctattggactgagttaaaaccctttatatttgtaagtatcctagtgaaaaataaaggcagatttactgttcagctaattaccattccttctcccaataagactcatttaaactatacatttttaccatttgctccttcctttatatgcataaaatattacataacattgaaataatctaaattataatatgtacataaaaatagtagattatatgttttattcaagtaagaaaaaatagtagattgaagactatctttcagagattacaaggctagattaaagcctacagtgacacaacacatctaagcatgtttttagaagtgatgaactgtggaacaatatgtcaaataatttgctttctttggcatacataaagtgtgcatgtagtttatattcagaagcatagctattaattttcacaatttgtgctcattttcaacagatatttcaatgaatcgtttgcagataaaaaatacattgatctgtaccatggtccagcttcatgtcagttttatatgctatgttagtattttagatatgcctgaaagatatcctctgttcttcatgtttattttcaaatggttatgagttcttcaaattccttttgttgcatatatctttcagactgtaaatttcttgaccctattttaaatgtaaaaatgttaaaatgttaccatgagcccttttaacctgtagataaatgccatttatttagatcacaaatgtggaaaagaggaaaatgatttgatattttggactgtattaaaaatttttattctcctaatattagaggtgtctttgggtgtttttaatttgaaaagaaggtacaaatagtgagagggctgcagtaaagcattgtgttattagttcattgcttctttatcgagtgcttgttgtatgccagtcactggtctcactcttagaaacacagtggtggaagtaaaaagttcaagacaaagctatgaatcatatcttctagtatgggaaactgataatacactgatatgtaacaaaatatcagaactaatgatatggataaagaaaacacttttcagaaattaaacttaggcatattttaatctcttgttctagggagagtgtcattttaagtatttttcttactttgtatgtaattcaagtgcaattattaatgtccagattcattatgtttttgttatatatctactgaaaaaatatacataaggcccacatatttgggcattactataaaagtttcctgctatgatatgtttttcttattagctataaccatctgtttacttaaaaacagaggaaggagaatgttaccttcatttgttacagtcactcagtgttagtacattttgcagctatacatgaatcacatatatgttatgttttagcaggagcataaccttattgggaatcttcataccatgttagtttcataatggcataaggcctttcttaagcaagaaataattaaaataccttgactagctctgatgtagccaatttaatgtttttctagggaaatcagaattttccttgtgtttatttaagtttaaaataactcagcattcgattttttcaactaaaactcatatattataacaactttatacctctattacaagatgccttcacttgcatgttagaataataaagccaatggaagattgtgtttatatagttatacacacacacttacatatgtacacacatatgtgtacatacatatattcatatatatacacatatagtcctatataacatatgatgtatatgtattatatataaatatgtgtcatatttttatattatatatagttatacatataattgtgtttgtattatatatctactgaaagtatatacataatcacatattgggcactactataagaagcttcctgctatgatagtatgtttatatcatatatatatttatattcagaacgttggggaaacctcaatgctgccagcatatatagaagaaagatttgacagaaacttagaaaacacccagtgattataggatgcagatggtttcattgtagcaattattttgaaccccctgacctgtgggttaaaatctcaagaccaattttctgtgctcattgtgtcattgtgtcaaggtttgaacttgactgagttcatagtatgactcttagggctttaatttttaaaaagtaaattacactagttcttggggaaaattatttcagttatataaacaaaattatgttcaaattatttttcagttaacttacttgagtgccagctattagaaattcattcagctggggatatactatctcaaacgcttagtcagcattgatgtttgtagaacttgcttattcttgcattaagcagtcatttattgaatacgtgctgagtagttctaggcactgtgtaactgccggatatatacagagatatgtcacagaaaataagacataatttttgccttctaggagtttacagatttatgaataagagacaaatacatgagcagttacaagtcagtgtataaaattctctagtaaagaggttcagggggtgctactggtgtccatggtgtaggggtaaattttacccagagaaggcatggaaacagagagcttcatgggtaaagcacagtgcttaccatgagccctaagagaaaatgggagctagttagaagaagaggatagggactccaggaggagaaacagtgtgtgccaaggtatcgagtcacaaagtttgtgctgggagctttgtggtattaaatgtggccagagcttagtgtgagaaggaggagttgatcaatataaaaggcaacaggttaggccaattcaggtaaggttttatatagcaaactaaaatcctcaaactttgccgcataggcagcaggagggcagcattcagatttttaagcttgttgctaatacatacagacctgaattttagatcatgctgttatcattgttgagacacacagagggctgcataagaatatgggcaaggagttgtgacaatgtagtaagaactcagtccacaaataatagcatatgggatggaaaggagagggcagttctgagagtgagatcatgatgaagaatctatgtgatgcagtactgcattttttgtttttaatgtgctgattgagaaagaaatactctgacttgtaaagggctagggagaaggcaatgccaaatattgaggcagagaggaacaagataaagaacatggtgggggtggaaggtgaggtagtaaacagggcaggagaattaattccttcgggttattttgatttgccataagatgtatgggtgtgtgtgtgtgtatgttgcatgtatatgtaatggtatgtgtatatatatgtgtgtatgtgtgaaatcatggaaattaaaacctgagttaaaatgtttatgtagaagtgatgaggttggatgggttctcacccagtgggcaggaagagaagagaattgaggaaggatccctggaatgaccagtaagtattagttgagcagaaaaaattagaagactgagagagcagtcacagagggaagggagaaaaaagagatatgaaattatgatatcatggaagttagggggttaaaagaatttacagggattcgttcagaatgtcaaatgctacaaggagttctccctagataaaaaccgaaaagcatctagaaaaaaaagaacattgttaatattattgatgaagggtgaccccaacagaatggggattgggcagagaagcaagattgtgtggtcaaaggattaacaggcatgtgagacagtagaaagaataaatatagaaaactcagcctggttgtgaaaggaacagggaaaagaagcctgggaggaggcaagggatgcttttggggtttgaattattgtcattgtcatcatcactcttcctcctaaccactgctccttttatttggtatggagtacttcatgaatcagtaaccatgaaaaagaggtaacccaactctccattggaaataaggtgaagatgggagcatacagaaattcatatacaatataggggcaggtggttgatgacatttataccagagagcctcacttttgtcagtgagaaatggaggtaagttgtttgctgggagactaagtgaagatagggcactttaagaaaaagaacatttggaaaagatactatggagagctggaggaaggactgatcaggggcttgccaaaagctgaggctgcaatgatttgctcattaggtttacattttaaatactaaaatcaggagtaaaaagcctttcctgctcatgcatgtttatatcatctcttgcgtaatgatttcatcatcttctcgtctcaacacaaacatttgttttgtttttaaaatatcaaactggcttttgaatttagacttttaaagtataacttttttttttaaacaaaggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttaggtaatatttatacagatatttgtagatatgtgtgtgtgtgtgtgtgtgtgtgtgtgtgtgtataatatagaccataatacatgcttgccttttaatacttagactttaaacatctttgataagctgaaattttaattgaaagaaacaatgtacataatggctgagaacagaaattatataaatatcaatagctgtttctctctacctcaagagaaattcaaaatattcactaaatcgtttggtatatacttagttttcaatggatttcttagtgcatactttgcttcaactttggaatgttacagtcaagtccatgtgtgctactaatttctcattaaaaataaaatgaagcatttactacaggatacattttgcaagattttcacccatgactcttttgtgtttcttctattatgtgttctacatctttagtgtatataacaatttttttaacttttgcttcatttattctagattccatctaatgaaatagagttttgttatacactgtaagaaaagctaattaagagatgaccctagaaaaggagtttattaaatccctcatgggtcaaattaattttagtaaaacctgtttttaacctccgatgatttaaaacaagtccttttattgaaacattacaataacaaagacttaaatataagcattgcctttaattccacctttttactgaagctacttttatttttccatattatagtccttttcttcacttttataatttatgtatatgacatttttatttttattaataaatcataagcatttctcatatatctataatattttccaaatgataatttttatttctctcttgttctaggttttaaaacttacttttgaattattccataattataatgtgtttgtctcatatatttaatctctttcaagatttggaaaatggcttttgaatctagtcacatggcattcctctattgagaagtaattttcctcattgaaagtatttgtttaatctaaaacaagtgatatatttaaagagattaattttcaaatgatgtcacaaaacatgcacagtttgaaaattatcccaagaatgaccctagttagtgtcagcaaaagtagtattataatgaaaataaagcttctcacgatataactacctttcagaagtctttcatttgccttctaatgtttctcaaatcagtagggttcactgtaatcacaagaagaattaagtgtataattttctaagatataaaacacagagctaaatacattgctttaagctcagttaccttgcacccctcatttttgttttaagaaattgtattgaaatgtatgaagctgtttagagtatctctactttatagacttataatttgtctttattataaaattggttatcagtagtacatggcaagactgggcacagtggctcacgcctataatcccagcattttgggaggccaaggcaggaggatagcttgaggccgggagtttgagaccagcctgggcaatatagtgagaccttgtctccacaaaaaatagaagtgttagctcaggcatgatgtgctcctgtaggctcagctattctgaagactgaggtgggaggatcacatgagcccaggaattccaagcttcagtgagttgtgatggtgccactgtactccagcctgggtgacagggctgagaccctgcgtcttaaacaacaacaacaacagcgacaaatatatatttgctaaagttgtcaaattgagtgacaaacaagtcttcactgttgtcagtctaccagaacaaggtagtcagcaggggtaggagtgttcacctttcacttgcatgtgagttcttggagaatttatttggagaaggctttgaatactgggtcaagtaacctttaactcctttgcttttgccaacagtatagtttagctggacccttcaaaagtggccatgttgggcctgaaaagaataaactagtactgtctgagtgaattcataaaactcttttgatgtactgtatacctgaggtagagaatgccttatagccgtgtaccacctatatttatatgacatatgatctgttcttctaggaggactgttaacttatatgtttcgttgaattgctcattgtattttctatatggcctgaaatcattcctgagttttactttcaatttatttagctttattttgaaaatatcatctattttataagatttgtggaaatatgcatactagcatgactttttgttttaagcgtagtagtgttaaattttaaggaataaatgcaatttctcctacagttagaaactggataacgcgaggataaatgtttgcattatactgggaattatacataattaatttccagtaatgtctttgaatgtaatttgggtgtttccccctctttcttatagaaagtcatctactagtgcacttaattcagtatactcatgtgtatggctattgctttcaggtacaggctaaatcagtacaaaagagatatcacttgcaattttgaataggtgtgcacttgaaaactgtgtcatacagagtttcttacctagccagggatcctaatgtcctttacaagtgactttgtacttttaagacatcattagcgtgctgctgattttctgtgaatagaagaggtaaggctaagcaagaaataaaatcgtcttgtttccaaagatagttgcgaattgagaggaaataataagtgtggtctccttgagttaccaagtcagcacaagtgatttatttaaagaatgatctatttccacttcaggtagcataggctaaactgtcactgcatgctctctacagagagtttagatctttgggggtttctgtctctggtttctccagatatttgccttcttggagtcaggtgagtggagggtaagtccttctcatccttctctccataaaccaacaaatttctgttcatgacaaaagcaggaggtctatcatcctctaaatccagattgtagttattaaggcctgggcttgacttcttccattgcactctcaacttttcaaaagatttgaaagtaccctttacctggatcgaaggggtactgtacagttcatagttccaggatagttcatagctttggaaagatttttataatttcatgagaaataaaaatcagaaatgtcattttcaaatacaaatgataaaacatttccatagccagagttaaaatacttttggcttaactcttcagtttgtactccagtttgagtaattaattgaatgtattcctgttaagttaaagttcagtattccataaagtagaagataaaaaaatataatcccacctaaccttctattttaaaagttctttattttaaattacaaattgtaagaactagagcacataatactggaatgttatgtaaataaatgcttttccagattaataggcaattactttagaactttgaacgattgtctactgaaacctgattgtatcacctattaaaatgcatttgtttgtgactgttttacaatactgctgatagacaaatccataacatagataattagtttagatctcaagattgtttttttttccccttcagatacgcaagatgacaaggaaagaattaaaaaatatggagcatttatacgttctcttccaggggtcaaccgagcaacactagcagctatcattgaacacctgtataggtgggtagatgaatgaacttttctcgacatttcaaacacagcactcaataagtcattatttcttatgtgattgtgaatctttctacgtatcataagaactcaccttagtctctctttctgtaattaagtcacatttacagataaatagcactgggaatttcttaatcagaaataattgtatacagtgtcctcaaatgcatctgatgcataagcaagaatttaaaaactcacttggtttggaagctggagaataaaggatgtgcagggaccagaattctgtaacaagaatctgtctgtgatgacagtattttctcatggtggacatttctttattatcagtttatatcttacctgacctttatattttggtatcaggctattgatccagtgaggaaattttaaaaatcaaaaacaattttgtatgtcaaggcatgaaggtctccttgcatttgggaagatatgaggaatgtaatggtgactttaccaatgaggtctgaaggatgaggacatttgaaaataaccttttaagtcaaaactagttttttttttaaatcttagcaggaattattacaaaaagttaaataaatataaattttgattaaggaatatattgtagctccctgaatggatgaaatactctcttgagtaaatttctgtaaagctgaattttactaaaagtaccttatttgcagtctcaatttagaaatgtttcacaatttgtgttctttcctcttgttcttttctttcccaaccactacttctcatttatgtcagctccattattgtaaaactgattttcttattgcatcatacaaatatagtccacattatatagtcctatctctatgcctgtgagatgttgagacaaactttaatatagagaattttagcgtgcagcatggaattatagaggataaattgaatgattcattgtgtgttgtggtccaggggatgcttctatgcttcagatttaaagggacatatgaattgggcgtgaaagaaatgagtgaaggataatgtctgggacataggagtactagaagatgacagagttatagttggctggcaggaagttgtggaaggctttgtaggtcatgcaaaaacatttggattttatcctttaagtgataagaagtaacagatcaaatgtgttaggataataatccctatgatggtattgttagggaaaatgtagcatagagacagataaactaactaggaaacagttttgttgagtttctggtgagaaaacctgggagagaagggactgggcaagctgaatatggaacacttggaaatgttaacacctcggagcagagaagtaaaggaagaaaaggaaacactatattatacctattttgtcccagaaactaaggcagccacttaaattaaagacaagagaggtgaaaagtaccaaaggggatgatactgcagaaggaagtcccaagaaatgcaggaatgtccttaaagataatgtccttaaaagattgagaagtaaattggatgaggacaagttgatttagcctttaattcaatccctaccctagctaaaagagtatttcctccatcagtaatatcctcttaattccattcgccaggtgtttatcatgcaccacaatgtaattaaagagtttctgactgtgagatacatagattctagtaacagagacagacatgcagataaatgttccagatgtttacagttaagtgtactgtaaaagcatagacattgttttgagaggggtgttcacaattatcgcatcctcttctattaaactccagttccttttgcatgttgtaaatcacgtgtgatgattgcacttgcaccatctctgctatgcaatttggtattttattatgaattctctacattaacatatgtattgctatcatgtttattcaccttttcttgtagctacctgaatctgtgttcttcatagatgggaatgtctagcttagtcttactacattcatttgatggagttactatattcatttgatcaagtgtgccacttacagttctcgtctgttacatttttagcaatgtaactttccctttcttagggatgatgcttcagggagttgttttggttttttttgtaaacttttaagttcaggggtacagtgtgtaggtttgttacacaggtaaacttgtatcacaggggtttgttgtacagattatttcctcatccgggtattaagcctagtacccattagttatttctcctgatcctctccctcttcccactcttcaccctccattaggccccagtgtatgttgtttgctatgtattctcatcatttagctcccacttataagtgagaatatacagtatttggttttctgttcctgtgttagtttgctaaggatattggcctccagctccatccatgttgctgcaaaggacgtgatctcattctttgttatggctgcatagtattccatggtgtttatgtaccacattttccttactctgtcattgatgggcatttaggtttgatttaatgtctttggttttgtgaacagtgctgcagtgaatatatgtgtgtctgtgtctttataatataatgatttatattcctttgggtatatacctagtaataggattgctgggttgaatgatatttctgtctttaggtctttgagaaattgccacactgtcttctacagtggttgaactaatttacactcccagtaacagtgtaaaagcattcatttttccccataacccctctagcatctgttatttttttgacttttcagtaatagccattctgactattgtgagtgtgagatgatatctcattgtgggtttattttttttaattactttatacttattcgtaaacagtttaacaactcttttaagaccccagtgttatagcctactgattgaaagagttgactccttcgttcatttctgttcattataaaaaggcattcttagttatatccaagaaaaatgtaattgcattttaaagtagtctgccttgtgataatattttatttagaatagctgtacggacacatgggcccagatattctttctcatttgatttgcactttctggaaaatttagcccagcttggcacctggaatttggaactgtcaattatatgtctaatgacctaccttttttgcctgttttctacatacctcctgccccatttcctcctcctatgctgcagccccacaagtcattttacgccattctgcaagcatacttctatactttggccacaggttgttttatagtttgcaattgtttgaatatggtcagccctttctctaaatcaacaattaagtatgactttgtaacttttactaatctatttaacagtactttttctgatgttcttaactatcattataagctacttagaagaaagaaccatatgcttttaagtcaccactgtatcttttatgtcagagaattccaatattgctgtgtttaaaaactgataaactggctttctgttctatgaaatttccaaataaaagtgtatcataataaactatgcttttctctgacagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggtaattattttgtatcctgcccttgttaaaatggttataatgtcactgtttgccaacaaatatttatgttgtagggtgttattattcagatctttattcatatttagaaatacataaaataaggaatagtcatatttttttaaattatagatataagtagcttttaagctatagtcattatttaaatttggttgcatttaaaactttttaccatctgatatctgtttgacagaatatttctatttataggatttttgcatgtgttttctttttcttcatgtgtatgaattatatctacttagaagtgtgaagttataaaatgaacaattcattaataaataccagactcttaaattctgcagttgaaagccctttggttttttcttttagttgtgtccccagttggaaacaaataacattctaaaatattattattctatggtgttttactaagtcatctgttttaattgactttttaaatttccattttataaagttaatattttcatgtttcatcagaaaactgttggagtagggatgatttcttggttcaaagaagtaaaaataggggaaataagcccaggattcaaattggtggatttgggcaaaaggtccagttctattatataactagttctagcacctcaattttgtcatttaaccttttgaacattcccttaaatggtgtttatgagtccagttgttttccggaagtatggctgtaccacatgaagtcaagacagttagtgtaattggttaccattgtagagttcttacgttcttattataatcacttatcataagacaagaaaaagaagctattttaataaaacaaaatatcacagtctgtatcttaatttacataggaatagacaccagattgtgggattttctttgctctttgatctcctctttacttctttctatatgtgtccactgtttttgatcaatagcaacttctttgcaataatctgatgctgagaaaataaagatttagaaaaatatgatgtgtggcttacatgctgtctctattttctgtatttgtagttttccattaataaaatggttatcttcatagttatgttaaactttacctaaatgatggaaatttaataagcacctaatgaacatttcagtttgatacatgagctttgtttctcaacctacataaacttaagccagtcatcagatcctttgcttaagtttcctaagaaataggacttccatcaatgcaattgcagcctgaagtagtatcatcataaaatattttgaactttaggatactctatcttgttggctttgtttccaccctagctgtgtgggctcatattgattccgatggccattctcatttatttttaagttgttagtatttaaattcctgaagattacatgaggatgagtgtcatcactcttcgtattctacattattagaatgtcccgaattatattttaaacaggttaaagaagatcaagtcaaacaaatggacatagaaaatagctttattaccaagtggaaagacacccaagtgagtagtaatagttagatctctaaataattaaacaaaacaaaaacttccattgtaagtaaagacatttgctgtgtgtattttcaagttcctattttaagcaaagtaaaagtaatgagtgaaaaaaaaaactaattggttgtgtaattcagcaacctgatacatatatgcaaaatatgttaatgtaaatttttaaaaatagaaaatcagttttaatttacctttcaaggttttctttataaaatcaacttttgtgtataaaaccatgactgaaaatgctaatggatttcaaaggaagcatttaaaaccaaagaaatacttagagtaagttgaaaattcagacagcctagtgattctttctattgttattttgaaactataaattatttcttatatgcttttgctttgcatgctttcatatgattgtattaatggaatgcatctaatttgatctttgtaacacattctaatttttgtcctaagttgacttttctatatcctgtcctgttttcctcagtcacattatactggatttttgtgttctggttgcactatgcttgtttggtgaatattcactggaatttcttaaggttgatgattagtcatcttctagtaactaggagttagagtggattcagggtaccaatataaatgatagaaatggatcagatgtgctctgtttacagatacataatgaggcaaatgcttttttgttagtcagacattaaattctcctcagtcctgaaatatccacaactaactagagtcattgaaactgtcattccatataaagaaaatagaggaaggcctagatcagtactaatactatgatattaatgaattattttctccattttgacccagagtaattatgcagcttccaaaggagtcagctttaaccttaaaaaatctaggtcattatcaattatcttaaattctcactttttttgggagcggggaggaagtctttagtcatgaaataaaggattgtgtgaggctgagaggtaaactttaaccacactatctacattgttattaaaaaagtttgagtatccttttgcattttttatcttttatattcatattacaataaagaaagatgttttgaatgctttcagtttagtctgtatatgtaagtaaaaataatagtatttggaaaagataagtaaaagagtctgggaaaatctgtttttttacttaaatttttcctctaatccatttaaaactgtcttctggagtatttttttctgacattcagtctctttgtcttacccctgtttgaatttcttacctattcttcttttttatttcattctatgagttctttgtatttactttttaagttttttttttttttttaactttttaagttttaaaatgtgtccttcctggagagctgtttatgcaaacatagtgaaaagcaaaagtgtcaactgtatcttttacttactgaaatgtatctgtagcattgaaagtcaggaggaaaaactggaaataagcttttctaagcctgtaatgccagaaaaattaaggaactttttcaaagttcatctttaatgttttccccacaaaatttttttccccacaagtttactcattagattttatgctgaggtgaatttaatttgagaatgatttcttggttatgatcttttttatttaaatcaggtgatactgtttctaattggttacataacttaagggaacttctgaaaaaagttactcaaaatatttttcatagattcatttggttctttgttaaccttctatactgttaatctgtatagtgatatgacatcataaggccttttattttcaggcttgcatcttcttcactttgtctgtcttttgggatataataatgacctaaattagtacttaattcttggccaaagataattaaaaacttctttttattgtctgccatattccatgaatgacctcacttttatttttctttctaaatttatgttatttgtagttttaatatagctctgacctagtttatcctcaaagttcaattttcaggcatatcttctctttaaaaacgtagcaagccataatttgccttttaaatattggtatcatgcacacattatagcttgaagcaaaacttcatgtgttttgttttcacccctcattttgtttatcctgttaacgtacatgctgatggctcctacaacttctgttgtcacagccagcatatatctattgtagctggattcattattttaggaaaaatgtaaggtatttgagagtactaagctcctgagtaagagataaaaaagaaaatcattgtggttgttgttgctgattataacatttgtgtaaatgccttgtccttaaccatatgtggaaatgggcacatcatgcttgtgagcaggggaattgagcttgtttcattgttataaaatattcagaaatatgactggggctttatagctgtcttcagtttcaaatatgtgtttttacaatatgtttatctgtgttgtttctacctctgcccttttctaggtttcccaggctggagatttgttaattgaagtatatgtagaaaggaaggaacccgactgtagtattataattcgggtaagttctaaaggtggatgtaaagaggactgttggaagtcacaaatgttagcattattttatatattttgaattttccattattatattttatattacctctccagttcaaacgactgacaacatagactttttatagtgatatcccccaggaattctgtattttgatcgtttggaaagagaacatcttatgtgctttggattacgtgttaagattttcttcaagttctggaaaataccccaagcttaaatacttgttcctccccttcctagcttcctaacgttagacaagttatttgctctgagcctcagtcttctcacctgtaaaattaggaaaaatcacagtattacatcatagcattgatgtgaggattcaataagataatgcatgtaaaacccttagcacattgctcagcatgtaagtgtttaataaataactattactactagtgctgttataattaataataatctctcacccttgttttctatactttagcatccagtcttccaattgatttgaatataagtctgggatatttatttggataactcttttctcccttgagagtactgatcatttgtgatgaattaaaaatagatgtttgacatgctactatatttagtaatttgtctgccttacatatagtaactgatatttcaggtcgctatttggtaagactgctttatttgtatgaacagtagacattctgccatgtaacagaaatttggctttagctacttatcttttttaaagtccaggattaaacagtcacaacattagatatatttggacttaagttaaatatatattgattttaagttttgtgtttctaatgattatgaattgtaactatacaccattaagtacattacttagtacatgaagctgaaatattaatactataattataggttttgtctttatgaggcatttgccttgccactccttggccatgtcatatttcttatactgaatgcataatgctgatcataagagatgtgaggaactagtaaagaccaattagcacaagttcatcactaatgctggagaaggtattcaaagcttgtgacttaaatctatacaaaggctctttaatagcgcattttaattttatcttctaaagtcacaacagaagttataattgagccatgttcttatgttatccggtgtgtttagataaaggactttccagtttcacctatagtaactccaaatgctctttagaaaataacaaaaactatttaaaaccaattacttaggttttaatgcttatgattctgcaaaaccctttagttacatttatctctgctaattattacctcaacccatggaggtagatgaagcaggtgatgttccgagtttataagaatggaaactgggaagtaagaatactaaggccagaaatacaaacctgggtcatcataatctcgactggacgttcagtatactgatctgtatattctgtagagtaataatttcccaagtgtggagtgttaggtgttactaaagaggagcttttggtctctcttgatgcaaggaatagagttctggttttcctgtttcagaccaaggtgcttcctgctgcctgtttcacaagtgggtttctcaataatttattattttttaaagaaagtgctagccttaaaaatattgtttgttcatgcatatcaacagcatcactgaaatgattcaactactccatactgcttggtgttctctgttattcctagatgctataacaagtttttttcttttaagtttatatttctttgggcttttctaaatagaaaatagtggacttcattgtataattatattccaaaaaagcactaaatttcataaaatacaaaaggtagactttgcgagttacctgcagtgaaataggttttttgtcatttatgtatgtgcaatatgcttatgggtaattatggtcaagagaaatggaaacaaatacatttctaaagaacttttagtagagacatccttttactgaaaatgtgcaaatcaagttgcaactgcagtattataatgtttaaaacatcattatgactaaattctaattgaagaaagccattttgcttttggccagcatgcacttaagattggcataagcaaaaacaaaaagaaacaaataaaaaattccaaaagtccctgaagaggtgatgtgcttatacagtggcctcaggctttgggactttcgtagaaccgacccccaggttggcattgcagactctgacatctgccctggaatcctggttccagcatactttggtatcccaccatctgtcacttggcatggcagggcacaccacagactaccaagaccctggagctttttggcatgaccgatagccattgactgtgtataatttagaatctaggctgaataaaccaagtcactctacactcttaattatagaactgttgagtaaaaattttacatgtagatgactgttggattcattgtctggcgaaggtcattccgaatgtaattaggtacattctttccttctgagtggtctaattgctcagtaagagattaaaaaattctcttatgtctatattgtaatctctttttgtacttatgtacattttatggaaaagatctgaacatgctgttttctgtatgggattagggaagctggttttaaccatgctcaaaataaattcaagatatcattaaatggtggatggggaatattattgacctagcataaggctacttctgtgtctaacacgttttttgaaaaaatattacttctcttacagatatctcctgtgatggaagcagaagaattaactaatgatatattagcgataaaaaatattattcctacaaaaggtgatatttgggccacatttgaagtcattgaaaatgaagagctaggtaagtgatttttatgctagggattcttaaattacttatactgtaaaaagtactctttaagacaagactttataaacattttatgtcttaacatcttgttatgattttttttaccttagtgcatgtattaatatatgtttgaggttgcctttttatgattttactcatcaaaataattatattaccttattgactataaaaatacagtgcaagactttaggtaccgcttttgctgcctcagaaaagaagacctttgtttataaggacaagcgatttgatttggcacaatattctgagtggtatgaattactgttatttaacaagaacaaggaatgttgatttaaaatattgtttattatataaaataattttaagagcagcagaagcttcattttttatttttcttttttctatctttagtgaatcacatattttgttgtctttcatctccaagatgcctagggatgaagggagcatttaaagcaccttgactaccccaacagtcaagtgctgaatgagcttaacattttaataacaccatgtggtttcaaagacctccagaaaaaaaaataatacacagaatgtctttgtaccttcaccatctgtctagctgctacctactaaggtcttgggacactttggagtatagctgccaaactgccaaaaggaaaatcttgccacccgcaagcttaggataaaaattaaaattcaatgtttaaaataccccatagtgtgttattaggagtgttgcaataagtgataaaatgaaacgggattgtcagtactttgtctttatgtttttattcctgtattatgattgtgcacaattctttaaaatttaaaatgtttcaatgttatttttaaatatacattgccaagatctaatgactatggtactttgatgtcagttcacagtgtctccctcaatcggtctcaatcctcctcgtgcacagaaatactctggcaaatgactcctatgacctcccaactgtcaagttcccagattcacatctgggttcactttacctaaccttctgtggcatttattgttaatgactattccctttttatttgatgatcttcactctgttttccatactgcctggattctctttatgattttctgttcattttacctcttttgtagattctccttattctgttttctaaacattgggttttccttgctgcaacatcctttgccatcttttctcatgttacctgttttattttttattattattagataatctcttctattttttgtgcttggctaacatgtattaactggtgtttcccaaatatacctttgttcttcctccatctggctcacactcttacctcttttaaaacctagactaaaattttcattgtactttgtctcatttctctttatagtacttattaccttgatttgtacttgtctcttttgatgggagttccttggaaagtaggagcaattctgttttttttttttaaatctctaatgtctagcatagtgcctagtatataggagccataaaatctattgaataagtgaggcatgattttgtatgaccctgtggtacaagggtgacaaagtttttattttttgtctttgtttaattttaaagaatgggtcacttggttaccagctttgttatatttgtgcgtaaagattaactgtcagcattattgccagaaatatctttccacattacaaattggtttacattgttccaccacataaaaccctttatttcctcattgcatatttatccttcacagtctaagtgaaatgtctcttccttcatgatgttcacactgatgtcttataatttgtttaaaaatctataatactgtatactgtatgacttatagaatagcaatgtgtatatacctggttctgccctagactatactttttttagggcatttaccgtgtatttcaggctttatatttttgactacttctcatagtgcagttgatgtggatcaaactccacaaaagccttttcaactgaagtggggcaaaaaagtagatgcattctggacctgagtgatatggattgtggttcctggtatagatgcatccaaatgtgggaggcacatagacagagatctctgcctgtagattaggaaccatgaagagatctcagggccctgtttagtgcttagaaagatgattgtctcctacacgcttctatttctgttgctttttaaaagtttgatagcagaatactgaattgtgggtttaggagtaggcatcccctccctacctccgttgccctctcaaagtttgagtacactaaagtatatctgtgtgccactggagctctgtatctctggctactggccatcctaagaggagcaagcaggtggatgaggatagaaaggaattatatatagctagaagaggggttgcattataccaagaaacattgttttgaaattttatcttgagcaatcaagggatgtttaccctcagaatgactaattataaacttgaatgtgataattagtatatacaatgctaagactgaattggattttttcttatttttacttctaattaaaataaagttgtctttatgccaagatatctaaaaaactaggagtcatcaagttttgatttgtgaatgtgtcaatgtataaacaaagaaatgtgtcatgtacacctagaaagaatacacttagagttaagaattcaaatttggcatggtcttaatgttttgtcaactgtacaagtagaaattgcagtaagggaaaacctcccagaggaataatggtaggagagcaacagaagggcctgtggttatgtgggtttttggaacatgtgtgtaccacatgttgaaggctttatatctagtaacatgcagagaagataaagtgaaatatgagaaggagataaaagtaaaggcataggtagtaagaaggttgtagttgagaagaatgtcagccaggcagttggtgtgtttgctaatgtaaacataaatcctccaagtaatgcagtaaaaaaatgaatgaatgaatatataaatttataaatatgtaagccagaatgctagattttaagtatctgtatattttaaaccaggagttctctatattcagtatttcctttgtataataaatgtttggtaatcttccctttactgtcctgagataacctattgtactcattaaaaattaataccctaattaaaatataaaaataaagggaacatatgcattattagcatgtaaatgctgggaaactcctatatgcctgaagatgatgcaaatagattcttaaacctgtaaatggaatcaccatggatgtggcagctactaattcagattgctataatcatgtacattttttttcacttaaatgatatttcgccattactgtcgttggtgagatggtgcacaacttttcaggaagttctgactaaaacagcagtcatcttttcttctttatatggtagtcagattcgtgggaaaatataaccatttaaaatattttaacatttttgatgttttcattttatattacattggtatgaaatatacattaagctgagttagattctcttccataagagccagtcatccaaaatatgctattattttaatgctttaccttaaatccgaacccatcctctgccaatgtagacccctttaccttctaggtttttcacatcttgaaagaaatttaattgctgaagggcctcatttaaataggcttcactgagagatccaagtttgagaatcagttactttttatgcagtactatcagaaaaagatggtcttatttcttcctcatacctactatgatgtggaagatctgtttattttattaggattctttctagctcttctgactgacacataaactgctgttatcttctgattatgtggacagggcagacgttgtttttcactttgcatatgttacctaagaaaacaaattgcatgtgagaaaaccatcatgggaaggcttacatatgtgtacagaataaaattaactataatagttaagattttgggctttaaagttagataggtttgggatgcacatctctgttcctcaccttaaccagccatgtgatgtgaggcaaggggcaaaacctttgtgatccttaggtttccttacatgtgaaatatgaataataatatctagtgaagcatgttattgtgaagtttgaaagtgataactgatttaaagcatccagtatatataatggctgatacataattgttattccataaatggcaaccgttattgggatcaatagtatctcaaagcttgcaagtagtaggctcaaaagggggaggggggagggatagcattaggtgatatacctaatgtaaatgatgagttaatgggtgcagcacaccaacatggcacatgtatacatatgtaacaaacctgtactttgtgcccatgtaccctagaacttaaagaataatttaaaaatatatttaaagccatacataaagggagtgcttattttataattagtcttaccttcaaatatatctaacttcaattagaagacaacaaacttatgagttagttaacagttgaattataacattgaaaaattgtgggcagttatgatcttttcccaatcttttagaaaattatttgaagaaaagtaatattgacatagcacaaaagattttatctggctttatgatgactcattttgtctgtgagtctttctgttaatatgtttttttgatttatgggccatcaaagaaaataatgcaataatttgtcaaatatttattgagcatttattatatattcaatactatgctgtgaataggggatatataatagtaaacaagatgtatatttgtcttcaggatgtgtggcctagtggattttttctttccttctttattcttgccattattataatgagttagcttgctccaataagcacagaatgcagaattggatttctctttactggataggaagcaaacatctggtaatttacattggaaacagacaatttattttcttatctgaaactaggaattgttgatgacttctgatatgatatgttcatagcaggggaaaccagtattagggaggatgtgatatatttatttaaacttgtgattttattatcagttacattatgatggatcatacaagtatgatgcttttgatatgctctttcctgtttgtctttagcctcattactttaaccgaaaacaaaaagctcaggtggtatgtgctttatgttttggatggtgtgaaagagttgaattgacttttacatggctacaacactaggaaagcagcattgacatcttcatgtcacagcttcttttcttattattttcaattatgctattttcagtgcactgagaaaaagtttgaatttcctttattccagcatatgtttctgttgctacattttattaactgattgacatattttgatcatcaaaaacttttctgtgagactttgattgtaattctaaaacttgttctttttaactctatgctaagaatatatgctgcatttaaaattatgattgcctaaatcaaaatgtgtatggatgaatattcttcagagagatatattgaagatgtcatgtaatttcttgctagttggcctattatgtcaatagttagtctataatattgacacatcatgttttttatattcccactagtagttaaatatagactcttcagtactattttgtaaatgattttagtgttttctatagaagttacattttataattttgtattgattatgaaaatattagctatgaggtatttactagtgttgatccaaaattatgagtttgatcttgttgggataaacaaaggattatgattaatttatgattattatttagtaacggacaatattaagtttgttagtccttttaaaaccatttaattgcatataaaaataagaaggtttccctaaacaaaccagtatgttatctacaaaagaggttagaggatggggatggtggttcatgcctgttcatcccaccactttgggaggcagtggtgggagggtagcctgagctcagaagtttgaggctacagtgagctaggattgcatcactgcactccagcctaggtgacagggtgaaaccctgtctcaaaataataataataataataatgtattgtacaaggggtagaatttattatacaaaaggtagaattctgagatttttatcaaaagtacttctgatttttaaaaatagttcagtaacaggtattcctgcatgattaatttatatagtaaatgttattatgtgcttaataattttctaggtcttaggatatcttttacatagtcatagtgctattactgtataatataagatatgattgtgtataatgttgcctacagatcttttcaaatggattttttaaaatttatgattataaaataaaaaattgttatcctcatatattttccatttgatttggaatttattttttacagagcgtcctcttcactacaaggaaaatgtactggagcaggtgcttcggtggagttcattagctgaacctggctctgcttacctggtggtgaagagattcttaaccgctgacacaattaaacactgcagtggtaggtgtcattacttcacattgcagctatgattgaaaattcaagtggttaaagggtaattaatatggcacaagtaatatttgaaaatgtgaaaaacgagtagctagatacagaatgaactgagatagtacatatataagaaagaagaatatatggacaggaagatattttcccaatgtgttgctctgtggtaatagttggctaatttgattgtaccaagttcaggtttttggaaataatagtttgtttttaaaggttgtttaccatgcttatgcttatgtattttcctcaatttttagactgagggcaagtcatctctgtgaattacatttacattagaaagctttctaggcattaaaggaatgctaattatataggctctgagatagagtgcttgctatatatctcacatttttgtgatgaagttggaaaataaatacttacaaaataaaatacttccagtaagaatgcttcccatccaactggaaggagatagtgctcatgtacggttaattaagtaagttagctagcacagtgaactatataagaccatttctgaacctctatgagatctcagaaaatttttattttgaaacttaattattcttctgttgtgttgttatcaactgaaagatcaaaaaaaagccaggattatatacaatccaactcaataagctaaggattgaaatttatgattacttttatgattaatataaataataaccattattatttcttaattgcataccagcagagctcaacacacaccaaagctcatttaaagttttttttaacttccttgtaagttatattaccttttgaattttacaaatgaagggaagagaaactcagagaacttaagtaatttgccttatattattcagttactaagtattgaattgaagaactgattggtgttcctcctaattttaatcatgtgaaaaaaggtggggaggatggtacagctcttcagtgctgtaaactactcagtatcattgcagattctctagttaatagtcataattcagagctcttaattgtaccaaagcttatcatataaacttctgatttaatacactgtcttttatatcttacatacttttacttacgtgaaagtacttttacaaaatgcaagtagtataacaacttttatgtcattgtgttcttataagcatctaaaaagccaaaacagatactaactctttatactgtagaaatgtagcctttccgagacctttatcctgtttgaaattttttcatgctcttacatatgattctgaccatatactgcctgtgccttcttaatgtttgcaataggatttctctgtactgatgtgaatgcacatgtatgaatgcacatgtcataaagtagtggctttcagctaggaatgatttcccctccctcccctccccgcccacaagacatggaacatacaatgtcttaagacatttctgactgtcacaacttggagattgggtagggaggcagggcttctggtatttagtgggtacagaccaagggtcactgctgatgttgagaaaccctaatttagataatctgtgatatctgttctaattctttatctttctgttgaaatttttatttgtttcttttcttctgatattcctctgcaatatctctaattctccatgttgcaacatgtttaaaacctacacctagacataatacctctgctgttgtgtgaatgctagtaggttggctatatgaataaaaatggataagaattagatcctaaaaggctatgttataagtgaaggttctgtatgtctgagggtgcgggtaacccaaaacaagttcaccattaaatgctattaatcttcggggcatggctgggggtgggtggcaaacaacccaacaaggtgtagattgcgctggtttagagcagtcatatctgggtaaaacctttgttgtgtaagggcaagaagaaatggtacagtgacagctggtacgttggctgtaaccacaaactgggtaggaagatttggtgttttcgtgatgttccacctatcccattacatcttctagatggagatatgagtgtgtccttctgttataaaagcatcaagcctctgtaagatctagacaaagaatcttgtagaaaaaaagctagagaagaactagagaagcaaagcagaagaaagcaagctggaggcttaagtgatgtttcagagatttggatgaaatattctttggtttgtgttgttgttgttgtttgttttgagatggagtcttgctgtgtcacctaggctagagtgccaccggtggcgtgatctcagcttactgcaacctctgcctcccaggttcaagtgattctcctacctcagcctcttatgtagctggtattataggtgctcatcacaatgcctggctattttttgtatttttattggagactggctttcaccatgttagccaggctggtctcgaattgctgacctcaagtgatccacctgccttgacctcccaaggatgaaatattctttggagtaaaatgtcagtaaacttctgtgtcactctcttacccacgtcacatctctaacagggtgggagccataaaacctacctctgtccctgaactatccctactacctcatttaatccaacaaatatgcatcttgttattgtaccaggaactttgcatgaaaaaaatagtgatttaaaggaaaaccatcagcaaatacattaattggatcatttcatatttgtagttatgtagtctggtcaaaaataagagaacctataaaataaatgtctaaagtactcttattttctagcccataaaatttttataagtattgaattagagtttgatttatattcagattgtaaaagcaaaataatctctttcattatggttggttctccatttgtttgaattgaagcttgcccttttaaggaatctgtaatatttttaaaaaatcaatttcttaagtcgtgattttttcttatagttatgacttagagcagcctcaactttattaatacctcttatggggcatactttgtgatagacttctgataattttggtattcagtctcatttatttttgtcttggaaaatgtctcctaagtcaatcacaacgactacctactccagagttattgctccatttcattacctctgctacaccttaaaattgggatctaaaagggaaataacgaaaataaatcaaatatgatttctctgtcattgtgttagcagataaactagaatcatctcagaaatactcaactgttcttcaaagaaaaatgggaataatgttaaagatttattttcctttcttaagaatttcttattctaacctggggccaagtagaaatcatcagaatttgaaaaaaaggtgggggagcagttggttgcaaccacattttttctcagtaacaaatagctaatatgttaacattttgttaaaacatagagttgccctataacatcccttgtaccttacacccccacattagatacctaattgccacaaattttactctgtccctacatttataatttctgtctgtctatctatggcttgcatttcattcgttttaggagtttttttcctgatatgtagaacaaattataaccatatactttgcttgacgttatgttttcaccacttccttttaacgcgagaatgttatataaaaaatttgctaaaattaaggggttttaattttctcaattttctttctttatctgaactatttaaaatgtggacttcacacataagtaagaatatattttagaatctagcacttaatttctgctcattcatttaaggtaaggaggtaacataatttacttttatagagttagataggagtaagtgtgttttttgttgcctctacttaaaaattatttgtgtttttcaaaggcatttgatttcttaggaacattttgtgccattgccattattgtaataaagagctaactaatttgaaaacaaaggtaatagtcctcaatttttttctattccatatattatgactgaactattaagatagggagaatgaaacttcatttacattgctatttagacagtgtcatagcttacctaattaaaccattatttattattattattatatattatactgaacttcaacatatctatcacaagcaaaccataaatgtatagcttctgtaaggctccagaataaataatctcaagttgcgtaagtcttattttaagcactaaagttttttgaaaattatcccaatagaatatgatacatgagaatgaaattttaatgatctaaatgggagagaaatacttatatataaagatataagatgtaactcaaatgcatatttctttgaatttctaagtttagattgctgtatatgacagatgctatggaattaaatttgcattagaatagtgtaattcaaaatgcaactgcttcaagtaaattcagacctggaaagctgagccattcactatctatgaacttaaaaaaaaagacaatttcagcaaatataatacaaatccataaatttacctagctgatataatttacatttcactccccatcatgttttcttaaagccaaagatgtacaagatattaaaagtaagacctaggccacttaaattggaaatttttcttttttttttgaaattgatgatagtcactgatatttactatggagtaccaatttcctgacattttctaaaatataattctgtggtgagaaaccctattggtaaatttgtattaactctctgtatcatgcagtaatctatagaaaatttaaggtatttaaatgtaagagttttgttaaacattgtctatacccagaaagaacagaaattttaaatgtatgacaactgttgaaatattagagtacaaacagcatgaagtaatagactactctaggtcaggatgtttatgaagagctttcaatcacagaaaagtagttcaactgggtaattgtagacatctcttctttcactgaatgtgtcttattcaaggaaatatcatttcttagtttttcttgtgcatgctatccttctttaacaaggctatattttactcttactcactaaaagtacatgttgaataaactttaaaaatatataaatatatgaaacagtttataactgagcaagtactgaccaaattttagaggactgccaactcacttttgtctaggtagttagggaatgctttccagagtatatatcatcagatcattaccatgaaagctggattgtagttcttggtattttggtttggataactcctgggatattaagatagggagactagaagagcttgctggttgggagtgatggatggagccacagaattcagttttggacgtgctgagctttaagagtctgacgtgtgtttgaggatatatgtctagaagggaactaaatacctaaacctaagagctcattgtgtggaaagtggttttagccttggcagaatactaagtcatgcaattttagtgttagagtaagaatatcagagatacaacacaagcatttaaagaacagatggagcaaaagaggccttgtgaaggaacaatcagaaaagtttcaagaaagaaagagagcaatgccacgtaaattgtcaaaggagtaatttttaggaaaaaagagtgcttaacagtgtaaaatgatacatgaaaccaagaaaggcacctggacacgtattgttattgtggttgatagtgatggtggtcatggtaatcatgactattacttagaagtatcccaggataggagacagaatttcatgttagatattaagagacctgaattcatattctagcatgttgctttctaatcttgtcacataattgtgagccacaattttcacatttgtcaataagatgatataacctgtcttccctactttgcaaagttgcatgagaatcacatgaaagaaaatatatctgaatcactgatttcagtgatcagaaaacatatctgatcactgaaaactccagtgctatctctgcatttattaacagtatgctgaaaattatacattcattgaatataaactaaatatatcacactaaattatattttagaaatgtttattataattcaatgtaataatgaaaacagtataggaaaacaattttctgaattctgcaatttgctgcattagtagtaaaatagcaaaaaaaaaaaaatctctggtacttttgtattaaatcctgttccaatagtaactatatttataatttaactatttataaataatttaatgatagaaggatgtcaacaggctacttgttctgttaaccactgctacttcaatacagtcttccttcagtatccatggggaggtgggttacaggacactaccacgtctcccccctgccacctgcttgtcgtggataccaaaatctgcagatgctcaagtcccttatatcaaatggcagagtatctgcatgtaatctacgcacatccttcccatactttcaatcatctgtttatttataatacctaatgcaatgtaaatgctatgcaaatagctatgctatgtttttttctgtttgtattttaaattgttatttttggtttttcaaacattttttgatgtgctattggttgaattgacagatgcggcatccatggatacagagggccaaccgtataaataacataaaggagaatagattggagtgaagggggcatacttggcttatcctaagaaatagattactttcttgaagtgtcacagtgtgtctatatctgttagccttaaaaagatgctcccccattagtgttctaaaaataaatcttcaagtgttaattaaaaaaagaaagtaagaaagaaagaagtaacatactttcaagcagtgattatgcccagtttggtgtcttctcatgtaaatttcaccaaagtgcattttgagtgaatatcatacagtgaatgaaatatatgagtaattctccctcatcaaaattataaaaaaaatacatctatacaatcaattctgaagaaaagaaaatatgcataattttgaatttggaaggactttttagatgttatcctgcaaatattgcaaaattacttgatcttggcataatttcaagggagttgcttctcatggaaactgcccatttgtgcccttcatcacttagagtacatgggacaggtagaacttggaacaaataattttttaagataaggcacagctctgaagaaatagtctttgccagcaagagaagaagagagacacatgcagaccacgaaaaatagatcaatttgttgtgtatttccttgtcactgatcagataatatgtgagagataacaatagttcatagttactgtgaatttactatgtgcgctgggctaaatgctttacttacattattttatgtcatcttcctactgtcttagggttacggctacttacaaatggagaaactgggatgtagcggtattacataactctttcaaggctacctgctgataagtggagaaacaggcattatagtcaagatcgctccatatccagcttatatattctgtcctaaaccccttactatcctgaaatcaaggataaatcagatatgaggtttttagactcttagaaactaaatctataagtcatcagacttttgtaagggtagttgtttctgtagtgtttgccttagattctgcaacacagaaaaattatgtcctccctccattaattaaacaaggacttacattcttcttgttctctgccaagctctattctgagcaatttatataccacatccactgggtaagtactgtatgtattctcattttgcagataagagaattgagatttagagattactgtctgcgatctagcagagaatgtggttgtcattcaagcccaggcagtctagcgccagaatgtgctcttagtcaccgtattgtttcagctcttgcctagattgaagaagatttaagtctacattattttaaacaggaaatacaaaatgaatatgtacttaagagaggtgaagctgttacaatgtttgtttgtcacaaaccagggaaggctcagaggagtaaagagtagctcaaataaaagtgaattttctcttcctttatagcttgtatgacaggcgtacgatattgtaatgggagtaactattagattatattttctgtggatttcttgtagtcaggtcaacccagcactgtagataaggcccatgcccttcaagaagtagaaatattttctttcaaaatacagtgttggcaatagcaaatatatggaagtaacccaaatactcatcaacgatagactggataaagaaaatgtggtacatatacaccatggaatactatgcagctataaaaaggaatgagatcatgtccatagcagggacacagatggagctggaagttgttatcctcggcaaactaacacgggaacagaaaaccagacaccgcatgttctcgcttataagtgggagccgaatgatgagaacatatggacacatggggtgggggaacaacacacaccagggcctgtccatggggaggggagggtagggggagggaacacatcaggaagaacagctaatgggtacttacattaatacctaggggttgggttgatctgtgcagcaaaccaccatggcacatgtttactatgtaacaaatctgcacatcctgcacatgtaccccagaacttaaatgttgataaataaaaaaaagagttaaattatgaagcaaatatgatgtttcatgaattcaagggtgatattacatcttggagtttagtggcatgagagaaaaaaatatggactgaagtagttgggagaatcttcatggatgagttaggtccagaagtaggaatcaaatttgtacagaatcaaagaaaacaggatttctctcaagatcaatcaagtgattaacttgagtcataccacagagacaaggattggttttccaaatagtgtattatgatcaattgaacttaaatattatattttagtttaataatttacagagatgtataggagttgtccatttatttcatgttttaaaagtcaggaagaggagtgtaggcttttggctttaggaaggtaaggctttaatcattagaacagtagggctctggacagggcttttataaaatcatggagactgtgttttcataacaagaatctgcagttgtatgttggagccattagaaaggtaggacatggagttagagaattctgaaatccaaggattagagagaaaaggaagtgtgtagggtgataacaatgggaatgaagtggaattgagtcccaaagagaattgctgaaagaataatgattgattgctagctgcctggacatggagggtaaagcgggggatatatatctgagaaatgccattcctgggtgtatgtttctctctcctcttcccctcaaccccagcctcctccacctatcaattattctgttggaatttggggctggtggtttggagataactatttttgtactaaaaaactgagattttcaaatggcttagaaaaactatttttttttggaggtgcgagcttttcagtttcattgcctggttacatgatatgtctgttctgcttaaataaatttggccattctgctttgtttcctacgtgtgacttttaaagagcttttctaaattaataacaagttgatagctcagtataacttacaatacatgtttgttttgttacccgcagttttaattttaaagacctttcaataaactccaacctatcctttctcatcctagcaactaccaagaataagggagggttttatgattcagtagaggtaacagtatgctgtaatttgattggaatgaaagatcaaaaggtagtaaatgaaatagtacctgttaatgtgcatcctaggatttatctctgggagaatttagtgctttggggagtgcattaaactttcaaacctgttatactcacacgaaaacaatagatggttttccctactagcaagggagctttctgtctagcaagaggtcaagggagtaaaaagtatgagtgaagtaccccaaagttgagagtccaaccagtacctgaacagtttggaagaatgaattactggaagccattcaattcatgaccttcattttgttacatatagagttacacacagtgtaccccaacgtgtgtagctttattttggcctttaattggtggctttctacttattttaacatcttgggaacagacaggaatttggttttgagagcttttagaaagtcttttaaatcataatatttatcatagagcttcatatttcaaagttttttttgctcttccctcatccttagcatatattcctttcaaaactttcatcctgagtcccttaatagggtgcacgctgaggtttgtactcaatatactcaatcacatacaatgattgttaaagtaaatgttactatttaaacgatatttaaaatttaaacaatattttcccctaagtctgttttttatgactatgagttgtttaatacgagacataggattatttcttggtaaaaatggaaaggtttattaatttgagcaaaaatgtaaatgaaaagtactgtcagaaggtgtgaatggattttactgacttaagcaatttaaatatctatatttcacaacttgattataacttgcttttaaaaatacctatttgtaaaccaacaaggcattatagatgcctttcttgactctcttgttctaaaccagctatatgaccaagtccatacaatgtttaacaaattgcttactctacttcttagctataaaaatcctttacaatatttctctgtggaattgaatattaagacattgtaccagaagacaaattttagcagtatatttttcagtaattatttaaaagtcacgaagtacctaaaaagaatctattagtatgacggtgtgatcaataaaatactgtctgaggtcagtatgtgtatcatgaaaactattgggtttgttatatatgtttattcatggttaggatcagtaatgtgattaatcctgggcacttctgcttccaagtggtcattccatgctcatatatttgagttgtaagcaactatttgtatttttaacttttgttctcttatgctaattttaggtgtgaacatttgtgtatttgctgcaatagtaaatgttttccccaaacagattaagggttgttgggtttaagactacttttttcctttttctttttcttttttttttttgagagagtctcactctgccgcccagactggaatgcactggcacaatctagactcacttcaacctccgcctctcaggttcagatgattctcatgcctcagcctcctgagtagctggtactacagtggcacaccaccacgcctggctaattttttgtatttttagtagagatggggtttcaccttgttagccaggctggtctcaagctcttgacctcagatgatccacctgccccatcctcccaaagtgctgggattacagatatgagccaccgtgcctggaaagactaatttttttttctaaagtttttattttataaattttagaaatgatgcatggatatttaaagttctatcaccttaatatcagaaaggtattaaactgatagacctgatacagtgttctgccatacatcttgtgtgtgcgttatcctgtgtaaggcccacaacaatccttccggataggtgtcattactcttgttttacaggaaaagcagaagctgacagcataatgaccatatcatggctatttggcttgaggtttctctttctttttattgttcttcggttctcaagtaagcagttgaatatgtatctggatttcaggggaaagttttagactggagatatactgacaaatttgtgcatgataaaaaacaaatacaaatttgatgttctcacaaaatgtttttgtgttacaaaaattagttgaaatgatttctacgtgtggcacattgtcagttttgcccatgaaatacaattgctgttaaaggagctacccttttttatgcacacagagccttttattcataagctacaacaaattacagtacacaggagcacaaagtgtattgtgctttttggttttgctttgtatttatttctgctagtcttcaatccccttttctatcacttactaatttttatgtctttgggcaggtcattataattctctgaatcttattttctggcttgtaaaaccagatcaaaaattatctaacttgaatgtcacagaataggaatcccagaaacacatttagccatttagaacatgctaaaaataaaatgtaaaaataaggagaaaaagatgaatcattataacaatttaagtggaaaatttagggcatgcattcaaactatagaacaacatctatcgctggtggctctgcctcctcttcttccaccctgcaaggactgggccatgggcggaaaattgtggggcaaaggaggggagcttttctgacataagccagagttttcctgggaaggaaagaatatctcagtgtctgatgcccctgtcaatacaaattaatccaaaaatagatgaatctgacatgtctttatacatcacacatcatcaaaaatggattttaatgacaaacattttgttagatatttttgatcttttaatacctgtgatagcaccttcccagtctagctaggtggacctgactttgaattctgatgacagcactctttaactgtgtgccttggataagtttcataattatatcaaacctgtttctacatctataaaattatattaattgtgattaatttacctaaagtgtggttctgagcctttaatgaggcattcatggaaagggctagcacagtgcttgcctcgtgctccacatacactagaggtgattctatgagttgttcacttaaagggtgctcagattattaccattgtgttaacacttcatgccttcacatattctttctttctgaaatatcctttgccttttccctttctgttgtgttcctgggaattctataattttatttgtccctctaccacagtgccaaacacaatgcttgatagtaagaaaaagtacatttttgatggaagaatgaataaagaaactactgaactaaaggcaaagagattgaacaggttcttggtggagaggagtttcccctaaggctattcttgagaagtgagagtcaacaagcttttttccgtaaaaggcctagagttaatgttttaggttttgtaagccataaggtctctgaaacaactactcagctctgtccctgtatcatgttcgcagccacagatagtacataatgtgaggctgcattccaataaaactttatttttataggactaatgaatttcatgtaattttcatgtgtcatcaaacttttgagaaatttttttcaaccatttaaaaatgtaaaaattattcttagctcatgggccatataaaaataagcagagggttggatttggcctgcagccataatttgccaatctctgagctacaaaaataacgtgtaaaccaaactggagggaattctggcttattagtcaatgtccattagacccatcataatagtgggaaaaggatattatggaaatgtgagggggcttctctagtgatatgttaggtttaaacttggactcaattattgtaaaattcctcagtttcttctctgaggtagcaatgtctagaaaagaacatgcatttagaattggggttttaccaaatatcttatgttctgacttacaggtgagagctaaaccttgggtacacacagacatgaatacggaaacagtagacactggggactccaaacggaaggaggaggataagggctgaaaaaacgttctgtcaggtgttatgtttgctgtctgggtgacttgatcaatggaaccccaaacctcagcgttacacaccgttgtaacaaacctgcacatgtacccctgaatccaaaatacaatttttttttaagttgagttttaatctccttcaattagctctgcagccttgggaaatctgcttaacctttctaagccttagtattatcgtgtgtaaaatgaacataataatcacaatttttttagtgttgttattagagagtgtatataatgtgtggatgtctaataggtaatcaataaattgtagcaattattgcatgtttagatttagtttttcaagtatgttatttctcaaatcaattctgttttctcctgttatttctttttttaaaaaaaataacttttaagttcaggggtacatgtgcaggtttgttacatagataaacttgggtcatgggggtgtgttgtgcagattatttcatcacccagatattaagcctagtacctatcagttacttttcctgattctctccttccccccaccctccgccttccaataggccccagtgtgtgttgttcccctctatgtgtccacgtgttctcatcatttagctcctacttataagtgagcacaggtggcacttggtttttggttcctgccttagtttgctaaggataatggcctccagctccatcatgtccctgcaaaggacatgatcttattcctttttatggccacataatactccatgatgtaaatgtaccgtattttctttattcagtctatcattgatgggtaaatgttctaccttagcagttttgcctttcttacccttgcctgtttcacatttataaaaatttctttaatgccttaaaaatttgtggatttgagtcagaattcttaaaggtgtttccttttttatctgcgcatttgcattgtttataccagtggggttcaaaagaaatataatacaagccacatatgtaattataaattgtatagtagccacattagaaaaaagtaaaaagaaacaggtaaaattaccagtatgttttatttaatatcacatatccaatatccaaaatacatttcaatatgtaattaatattttaaaaattgtgatatattcttttttattattttatttgagacagagtttctctctgttacccaggctggagtgcaatggcacagtctcagctcactgcaacctctgcctcctgggttcaagctattctcctgcctcaacctcctccagtggctcggactacaggcatgtgccaccacacctggctgatttttgtatttttagtagagacgggtttccccatgttggccaggctggtcttgaactcctgacctcagataatccgcccgcctcggcctcccaaagtgctaggattacaggtgtgagccactgcgcccagccgatatatattttttcatataaagtctttaaaatttagtagaaactttatacttatagcacctctcaacctatactaaccacattttgtgtgatttctagcctgtggctacttgaacagtccaggcaggcccatacatgataaatagctatacttcagacacatggtattcccggaagttcaccttagactttagcggtagtaaacaagttcttattttttctatatgacaatatagaaatgttttgtattgtatttcaaataagtaaaaacgtacccaactcacaaaagtaatgctgtactttacagaccggagtacactgggaagcatcaaagaaggaatcttgaaaatcaaagaagaaccatccaaaatactatctggaaataagtttcaagaccggtattttgttttacgagatgggtttctctttctttacaaggatgtgaaggtatagtatttgaacatgcgtacatttttatttgtgtgggtattaacatttgtattttatgctactgtcagccatctctcttggaagtcactgcctgtagtatataaaatgcatggtaagctgatgatttgcttcagcctatggtataagatattaatgcactcagtaacacagtgaataattttataaggcctttttaggcacctcagattttgaggggcagtaaatgacttaagccctgaagaaaagtctaatatgtattataaatcaacatctcagtcaataaaattaatagagaatgtgtgataccctaaaataaaaggcttcagattagctactggaaattaataaaaggtgcaataaaatgaccaaacccaaaagttaaaataaatcttattagtatctttcctatatggttgaatgaattgacttatttttaatttcatatgtattaatgtaatcttattgatatattccgtctaatttatttccctaaaagatcttattaaataattgtggagtggataagagaattagagatataaaagagggagtagataaatgatgtagctataaaaatattgaacttaacatcagaaaatctcatctctgtgaagagctggttacatgaataagtaacttaacctctcaacctcagtatccaaatctgtaatttaagatagtatgagttctgcatgtcaggttgttttaatgcttaaaaaataatatatgattttttttatattctctgggtgcaggttacaccagtatgttcactttattaaaattcacggagctaatatgtatgatttgtgtactttttatatgtgtattatatatacactgcaatttttaaaaagcattaggataaaaaaagtaaaacaaatgtgcacaggccccacctccagggatttggtttttataagactgcgacaggttaacagcatttttctttaatttgttgaaatttttttttggtttttaagttcaggagtgcaagtgaaaatttgttagataggtaaacttgagtcatggggattggttttacacattatttcatcacttaggtattaagcctagtgcttattagttgttttttctaatcctctacgctccaccaaccaaaaggccccagtgggtgttgttcccctctatgtgtccgtgtgttctcatcatttagctcccacttgtaagtaagaacatgcgttatttgtttttctattccatgctagtttgccaacgataatggcctccagttctatccatgttcttgcaaaggacatgatctcattcttttttatggatgcatactgttccatgatcgtggtggataagccttttggtgtgctggtgaattcaatttgccactattttgttgaggatttttgcactgatgtttcatcaaggatattggactgaggttttcttttttgttgtatctctgtcaggttttggtatcaggatgatgctgacttcatagaatgagttaggaaggagtccctcctcaattttttggaatagtttcagtaggaatggtaccagatcttatttgtacatgtggtagaattcagctgtgaatccctccgaatcctgggatttttgtggttggtaggctttttattactgcttcaatttcagaactggttattggtctgttcagggattcagtttcttcctggtttagtctgggaggctgtatgtgtccaggaatatacccatttcttctagtttttctagtttatatgcatagaggtattcataatattctttgatacttgtttatatttctatggggtcagtagtaatatcccccttattgtttctgattgtgtttatcaaatattctctcttctttattagtcaagctagtggtctaataatatatgtaaaaattctttttataaatataatgtaataataatagcatgctcatccaaagataccactaagaatatgaataggcaagtcccagattgagaaaaatgtattaataggtgtactaatagtcccagattgagaaaatgtgttaattaacatatatcagaaaaagacttatatcaggagtataaagagctcttctaaatcaacaataagaaaagcagttcaataaaaattatggcaaggatagaacagacattacatgaaggaagatgtagaaatgtccaataacccattgattcaaaagtgttcaatatcattaataatcgggaaattaaaactagaaccacaagacactattttacactcattggtatgactaaaatcttaacagtgataacacccaatgttaaaaaatgatgtagagtaattagaactcccacataaattgttggtggaagggtaaaatcacacaatcactctgtaaaactgtttgtcagtttttaaatgaagttactaacataatctaccccatgatccagtggctctactcaagcagtacaactacttgtactcacttgtacaagaatgttcataagcagatttattcataaaagctgataactggaagcattccaaatgtccaccaataggaaaatattctattcatataatggaatactactcagcaacaaaaatgaatattaaaacaagccacagcattggtgagtttttaaaacctttgaaaccaaagaaacttgacacaaaatagtatcatataagtctgtgcataagaagtctaagaacaggcagaaccattctatggtgatagaagtcagaaagtgtttgcttaggttggggacagagtttgctgcagaattgccaaggaaaagggtcagtggggtactttctagatagaaatgttctttctcctgttttggatggtggtcacatgggggtatgcagcaacaactctctgagattcaagtagtaccaaggcaattactttaaatgtagaatggaagtcagcaggacctggaaaatactttttaaatattgaattataaaattcacttgggtaaacattgcttgcacacttataagtgaatgatgcttcactgtgttctgttgtggagatgcacaaagaaagaccagactttaacatctgttaatatgttacaaagaaagaattgttaggcagctttccaaagctgtggctgtcttgttctgtggcttctgttcagcactccgtgtgctttaattactttctctgtgtattcctccagcaggggagcctccatgtgggcatgaataaatcatagtagcattgtattctgtgtatacattccaatgtttgctttcctcaaggacagtggaatgtccaggcaggagactaataaaacagcctgaattctgcagcccttatcacagattcatattatatactgcatttgaacccccacttgatatccagaagggagtctgtgtgggtatcaagtggttactatcatttattatcattcttcaattttacccatagaggaatagtagatttcgtagaattatggggttatgtgatggaacacatcagattttaaggttcacaaactttacgtttatgcttgtgaaaatacaggctagacttcacagcttattattctagtcagctagaactgaatctgatagaattgtgtttggttttgtgcagtggaccgcccaccttgattttcaaaagactgatttctttaatcacggtccttgcatatacataatatgttggttaaggatcacttttgcagttggcgtgtttagaaatcaacctgaactttttcatcctgtcaagaaactgacacttttcattgtgtagcaacagaaggttgctaaaaacaaatatagtagttggtggtagtagtaatgacagtgcagtaataatagcagcaactaacattcaagtgggtactctatgcgaagcagagttccgtacattttatttggattatctcattttatctatacagttaccccacgaaattggtactcttattattcccactatgcagatgaagaaagactctcaaagacattacataacttgtccaaaatcacatacacagtaagcgatggagtcagaattcatttccaggcattagactccaaaggctctatgcagaaacttacaaaggaaatttaacatttgtattaccttagtgtttttgctgaaagaattttatgtgtagagagtaagtttacttttattaaatagtatcaaacatttttaaataaggaaatgcaaacagttcagtttttatagtgttttctctcaagctgatgtacactttaatatctgccacagggaaggctgttcatgcagtgacttttacagatgcattgtttttgtaagtgagatgaagggtctcatatcccttaacagagtaagttttgctttaagaatttgtatctttttgaaaggatcatcttgctcaatctgagctaacttatataacctggtaggcagtgatagtctcaagaacttctctgaaaacagtgttctttaaggatactgaacacattttttaataacagtgacctcaagttgtggaattattgtctgattattaagcatttgaaagttatatttgcatatctgtcagaatagattaatgcaactgatactttaatttttacattttgaaaagcagatgagagattcatgcttttcctttaaactcaaactatgattattttcagcacatgacttcattttgttgttttttcatgttactgatctgtccctattaatattgatggtgaagccattggcgatgttaactttttaaatgattttatagtaaattatcaacagtaaaatatcctaacctttttgagtaaagacttagcatttgttttagtggttgccattaatatatgcatgcttgtatatattttttaaatgatttagttaaaagggaggaaaaattacaaattgagaagtgtatttaaagcgactttgtgttaattagagataatttatgaatgctcattaaaaacaaattggggtaatacacagggaaagatatcttttgttctgcaagttttccctgaacagaaaatgttaattgctttcagacttaatttacataaaaggggagaggtttcagagaatattaccattatactgttaatggtgtgaagaaagcaaatgggtaaaggggatcattaaaagttgcctatactttaataagcaaactctttttatgtgccaggaatagttgtttaagcacactcatttaattggctaacttaaaaacttcactttgaaatggagtggctgaagcaacacatttcagacttcataatagtctagtatattgaactttttggagaaattctctgtaagttacacataccaaaagagaaagttgtaataagccaacagtaaagcgatcttgccaaatgacatttccttttatagaactttccattaagatctatatagctcttctttatgaatattcagtttcaaaactgaaatggaaaagaatgtgtttctacaattgctgatctcctctcaaattatatcatttgtgtttctttggacatgctgtggtataaagtaatgagcctgcatgccaggagtgacttgggcagtcaattccctcagactctcaatctacttattaccaaaagtttttcaaaatgtaggcagtcatgaaatcatcaatgtcctgtgtaaatgaagactgtctggttcaggcatagtgcttctcattctccaatatgcaagtcctatcttccccatactgctagagttgcagccaaccctgctgcctcggttgggactgtgtctgagggaatagcaatctaaattattaaaaggaacacaaaccttggttgtaatttgatttaacctctgacacaggtggctaggagtcacctatactgcatacattcctgatagctctcttctccttgaatatatcctactgtgggcacttactaccttacaaagctacctcatactagacagttcaaattgttaaaatgttcttccttaaaattcagcaaattagcaggctatagaatcaatatccaaagatcagtccccagctggatttaaaagacaaaatgcataaactacttgaaaacagccttaagaagtggaagcttatgagaagaaaactatagacttctctgataggagtaaaattgatgttaaatctgctagtattgatttataggtttaatgcaattattttcaagtttgcaaaggaaattacttttataacttttcaaaaatatttgacaattcacctcaaaggataaatagataagaataatttgaagacattttgggagataagtaaaatggatttgagttattttgccatccaactattaagatatacagtaaaactaaaatacttaaatattataatccttgtataaaagtgaacaaagagcaatggtgcagtgccataaatttaggtaaaaaatgttatgttagaatttaattttaatatgtcacaaaaagtgcatgtctaaagggatgtttgctccataaattggggtagaataattgtcaacaaaaaaatttctgtctaacttatcatttatactgtatatataaaaaaatgtattccagattgacaaaagatttaaatcctaaaaaaagcaacccttaaagctgcaagaccatggaactgaatatttatcagctatgggggaacactttaaatttaagcaaacgttaagaaaccaacccccaaaagaccagtatatttgacttattaacaataaggtaaacaatgagctaggttaaggcaaagagcaatttggatagaatatttaatttaaaaagacaaggcaatttcatattaaatacataaagaactagtacaaacaaataaagacatggataaactgttcaccgcatcaaaactgccgatggctagcaaatacataaatacacgctcacacttaacatttgtattaccttagtgtttttgatagggtaaataaatgtaccctatccgtgtagataagatttttttctgaatcatattcttagcctatgactcagtggttaaattcctagaaatctagctataaggggaaaaattcaaaatatggtttttttaaaacatattatctactatgataataatagtgaacttactgataatagtgattaggaataaattcaccatgtaaattccaggcctttggtcaccacagcattatttctgatcatcttcctggttacttttcccctgtatttctgttatatcctcctaacctatttgctttatgaaactaatttttaattttatgagcatattttcctcgcttttctaatttgactgctgagtattgcgagaggtgtaaagaaaatataattgctctagggcaactgtaaatttttaatagtctattttaattaggataattttcattaatttggatttttgagatacctcaatatgtgttcatatatattcacgagtctgttttccataattccgaaatccaaacagtatagaaaatcccagctcatttggtggcaaaatctgacccaaaacaacacgaagatatatatagcctttatcttgaaaatatgaatatctttgaatacaaggtactaccccagtcaacattggtgatggggagttacaaaacatatggcatatgcattgtattatatttttaaaatatgaaaaatcacttctgatgtgatttggtcagggtcctctagagggacagaactaataggatagatgtatatatgaagggatattgactcctacagtcacaaggtgaggtcccacaataggccgtctgcaagctgaggagcaaggaagccagtagtggctcagtccgagttccaaaacctcaaaagtaaggaagccaacagtgcagccttcaatctgtgactgaaggccgagagcccctggtaaactgctggtgtaagtccaagagtacaaaagctgaaggacttgggagtctgatgttcaagggcaggaagcatccagcacagagaaagatgaaggccggaagacttagcaagtctgctcttccatcttctcctgcctgctttattctagccacactagcagctgattagatggtgcccacccagtccactgactcaaatgtcaatttcctttggcaacactcacagacacacccaggaacaataccttgcatccttcaatttaatcaagtttgcactcagtattaaccacgacatgatgcacatctgacctcaagtgtttttgaatcaagaattatagagccatgtgcatgtctgtatatacatgtgtacaagtatataacatgaatatatccaacattattaatatgtattgattgtattgtaaatcctaagagtcttcattgtaaatccaaagagtcttcatttactaaactcatgaaatgtttgttttatgaaacactgagaaactaaacaattctaaacccaatcattaatgctcaaagaaaatgtaaggaaatgtgtaaatccatttaattacaaattatttttttaccttacagagtagtaaacatgacaagatgttttctctcagttccatgaagttttatcgtggagtgaaaaagaaaatgaagcctccaacaaggtaaagtttgaaagggaagtgctgaaaggaaaaacttatgggaaaaatatgtctatttaaggatttagggatcagtggcattagtctaactttttataaagtaagttttaggctattttttttaagttgcttcccctgtcacagggttcttatggcagatcaaggaacttgtatgagtagataaggagggacgatgttcccactgagactgagaccaagctccttggtgattgcaatctctctgtgtaaagtaagaaatcccgggaggctctgtctactgggaagtacatggcttcctctgcatctcattccctgagctgtcacatcacaacctgagggcatctcaggcaagtctacaacacaggaaagcaaatgctgccctccagcttcctgatgcttggcttctacaatgttttggttctggctctgtaattttccctttttactatgctgactttggtactgaaaacccatcatagcatgtaagcgctagaggaggtgggtgcctcctacagattgcgtgcctctttaacacttcatgtaccccagcatttgatttacaccacaatttcttatcacaggttactttgattagctaataaatgtttgcactaatacttagtatcatgaacatcatttatatgtgcttgcttctgagattttgctgctgaaaatttcttcacttttgccttcatactcagtttctaagcctagagcatatacctgtgttttaataggcatgttctttaatttcccccagtaaccgtacatctctctatattatcttatttcagtcattttcgtagacatttggccttattcagttaagagtatcttctcagagacatctcctctctgccccatatcatcacaagcctccttccttctatataaatgtgtagccagatcccttagcatttagcattcacctctagctaagtccaacacattgaatcaccacttgtggaagtctatgcattcccaccattaaatctcatctccttaacatctaatcctgttttctgtcttgtaaaatgtattatttttaatttatgtgtgtttttttttctatgtgatgcagctggggattgaccgcatattctgagaaacatcactggtaagttaacagctgacaacttttggacataatatattggtgacaatttcaggaaaagaataatttcagtaattgcagatagaactacagacggaaagtgttttgcctaagtgaaattagggttgtttgtaaagactttgagcctaagaagaggaaaacagatttgtatcagggttcaagtcccatgtatcctatttggcaatgcctctgaagtgaaactacgcctgatttcttccatagttattatgagtgtggaattcagcttttatgagataagtaggtgatagttttaaaacagaataagaactagctaaaatcagatttaagaaaaacatatatcccgctctcaaccctatttctatatatgtactttttgccatatactgttaccagtatccatcagtatttctagagattgtactagatgtttccttctcttcacctccctgtgtctaatcggtcactgagccacacgagatctgcctcttccttgtgcccctcctccacctacacctctctaccctgagggcctggccttcattgatctgcctggattattccaggagtcctaagtgctcttcaggcctcttctttgcttttgttttgtcgtacattctccacctctccactgaggagtattttctatgctgtaccatgtttctctcctgctttaaaacttctgtgaattctttcacctataggatcaagcacagaattgttgcgtggcatgcaaggctatatatgactccaccaacttcatctcccacagtttttctttttcacttaatgacaaaacaatcatctatctttattcaccacgcattccttgctgtttcagatctgcatgtgtgatgtacatggtccctctactaaacctttgttcatacttttcacttctccttcctgtcatactttcattctccccctgatgactcaaccaactcaactgtcaatgttctttgaaatcatagctcaaatgccccaaagccttatctaatagctctcacctctgatcattatttcttctttgcacctacagtattttataaacaagggtacggaattaaaatgatttgtggcaggaatggtttgtggcctggacatggtaatagggaaagacaatgttttcatgaggtgctgatgaagaaaacacagattttttagaaatttcattttcaacatttttcaggtaaattattttgataatacaggaatgtaaagaatacaattactttgaaaagcccattagatctttccaatatcaattataaaattttcctcttataaagaacaaccctctcctcatccccaagtctgtggtttctatgtttgcactcagttttatttttgctttttctcactgtgttgtaatttatttgtctatatgcttagctcccctaatagactacaggagccttcaggacaaggtctctgttttagttagtctttcaataaaaggttacttaatcactgttattggatatgcagtggtttttcatgtagtttcattttttatgaatctgtgggtattagtgtttacaattacaatgatggagactatgtctcagccttttaaaaagaaagatctgctcttatgaggatgtgcacatatttttcttctcaggctcagaattttagtggaatacagtgttttaccatcaggtacttgaaaaggcaaaatgaaataaatctttctgcctttccgaaaaatattggtcatcattttgcagcacttaccaaaggcttcagttgtattttgtttaaaccaatatatttacactataacttcgtattgtacatttagcagaagaccaaaacaacttgtactgaaatgttccacttttgtgattgcattacgtcattaatcaggagagacccagagatttttgatcaccaaatcactcagcagatacactagagaacagtcaattgtctttttgaatgacatagtttataaacctcgttttgcaggcacctgtgttgtgatagttcacgaactcagacggagtggatgaccagtatctttattgcccaggtacgagatttgtttgaactatccagtagagtataataactttgtttacaggaaatgttagtgtgatggtgatttctaaagaatttttaataagcattttaaatgtatgtacaattggcataaactttgattctctcattcttagtttttaaaatagtatattaaagttcaaatttattcattaccttttgaaagagagtttattccattaaagcgtcttttctgccagccccacagcctccttggcttaggtgaggtgtgttgctttaaaatggtcgtgtaagaaagagggacttttctaagctgtcatcctaccacaatcccacatagaccttcatttagaaaagtgttctatttcccttcttgttctcccactctctccacccctgcctttccagaaacaaggacaggaacctacttttctttaataactattgtgtgctagatacttcataagaataactcatgtattccttgcagcaaaccatacaagatgtttttggttttataaaacaaatgtttggttgtttgctcaggaccatatattagtagtttaaacccagggatgtctgaggccaatgcttatactcagttccgtatttgttttcctccctagagcaggacttacccttttgaggaacagttatatagtcccattaattggactggtttgtttcccaaccttgtctagctaaattcccaataatgcttctcatggagcattgaaattcactggtaacgattaagttgccattctttattactgaggaggtattttcctgtttcccttataagaaataagttagctcactccaaaatctagttcttatttgttctgaaaatagttttctctgttcatttaatgtattaactttttcagtggttaataaacacagctcttctcagcctgtctctctaccattactacctggaaaaacatgtgcacaagagactggctgctaactttttagaggcttttcttcttctttttgtaacttattaaaattcagatattcaactttttttttttttttttttttttgagacagagtcttgctctgttgcccaggctggagtgcagtggcatgatctcagcccactgcaatctctgcctcctgggttcaagtgattctcctgtctcagcctcctgagtatctgggattacaggcgtgcaccaccgtgcccagctaatttttgtatttttagtagagatggagtttcaccatgttgggcaggttggtctcgaacttctgacgtcaggtgatccgcccaccttggcctcccaaagtgctaggattacaggcatgagccactgtgctaggccacatcgagttctactttaggaaaaacaaaagactggatttgaagtcttttggtaaagttgggactatagagtctaaagctgttacagtgtcatttgtggcacaactaaactgatgtttttgtttttataattggagtcagtagactctgcagttgaaatttaaacaatgaatgcaggaagcaaagcctactctcactacaaggttatttcttactgtctcatgttttaatcctagtcctcgtctcaaagatttagcctaattatctttcctctgttctttttacttcttggtattattcaggtcctcccttaagataaacacagaagccttcttggatttaaggatttatggttcatctctgtagggaaacagcaaaatagcaaatatttatatatatgttaaaagcgtagacatacacacaaacacgtatgcgaattaacagtaaacaccccctataatgagctccttttggtattcagagtacttttgtaatctccatcctttccacacccctgcctcagaagtcatctagacttcagcttaaatatcccattctcagagaaacttttcctgaccttcagatgacttagaccttcaggctatcacccttagcatcccgtacttctccactgtgacactaattagtaaagaaaaaaatgtaattagctatttcatgtctgcctctcttactaaaatgtaaactccatgaaaagaaggactcttcatcatatttgacttgtatgtcaagtacatgtttagttagtatttctaaaataggaaatagggtaagaaaatcagtaatcagataaaatttcaaatggatatccatgtgataaaataggagaatcataaaatatggcaggtaaggagagcatgtgactgacataaggaaggcactaattgaggaaggttctcaggaaatggctttctgagtaggtgacaggtgacctgagaccagtctgaaatgagaggggtatcatgcaggcttccaggaaggatcattcaggaatggggccagcagggtatgtcctgagacatcatcactgtcttgttttattctataaacatcatgaaggtaagatattagagatgaggaaggcttgtgacaaattatgtagttcctgcttaatagtttgaaacaagggaaggatataatctaattttaattgaaaaaaattattttgttcacttcattgagtctgcagtgtagagggtcaaagatgcaagtgggatgaacagctataggaaagaagatgtcaactcagactagggtggtaatgaatatggtaagacaaattaagattcaggaatattttgaaggtagagccaataaggcttttggaattattgcgaagtgactacgttgtctgtggtatataccctagagttccttgtcacatgccaggaaaatttaggacacagacacacacgagaagtttaggagcaggaggtttaataggtagaagagaagagaaagagaaacagcttcctctataacaggaagaggtctccaagcagaaagtaccagctagtgcagaatgcgcagttttatagtccagtttgaggaggttgtgtctgatttacgaagggctcacagattgtttcgatcagatatggcgtttacatagtgtatgggtaagtctggtcacccccaccctaatcttcttatgcaaatgggctttccagttgattgacaccatcttgtcctctccttacaatgcatttggctggcagagaagggaagatggagccaccattttgaaaatgtctagtccttagttcctgccagcattcacccctgcaagctcctagattgcaggctgctttttgttagaagatggcttgggactgcttttcattaaaaagaaaagccttaccaaggactcccatgcccttgctatctgcttagtaattccttcttaactcctgtgtcaattggctattgcaatttgagaggaagagtagaaatcagaaaaaattctagttttttggcaactgtcagatgtaagtgggatcatcagagatgtagaaggaaatggagagttctattttggccacataaaatttgagatgcctattagatacacagatatgtatgctgggcagcaggttggatgtgtggatcaaaaactcaggcacaggtttggggctaaaatgtaaatttgggggaagtcagcacttagattatattcaaagctataggattagatgagatgcctgggggagaaggtttgaggtggagagggaagcatggaggtggagagggaagcatggaggagggttggggagagagagagaatggaggaataagccctgggacatttcaaaatttaaagcgtaggcagaagaaaaaaaaacagcaaaagcagtgataagaagtaagaaaggaggaaaaccaggtgatgggtacagaaaattctgtcaagtaatttcttatgtaattaaatgaggttgtgactagatagaggtgaaggtaggtttgggggttttgatttatctttaagatgggggagtgtgtacttgcatacattatatgaagacaatccaatcaggaagaagaaatggacagaagaggagagatgttattaaaccagcagaggccctgaacagacatgaaatgatatgatctagtgcatggttattcattattaaaaatcatcatacagcagagactgtggcacatttcttctcaaattattgaccacctaaatttatgacccattgagctgagcaattatagatatgactggataaaagttatttgcaatcagcaaatactgattgcaagaagtaaactcacttagatgactatagatgcaaggagattggtacatttcatgatgggagtattttcttaaatgatcagtaataattgttggattgaatcagtgagatcaccacatgtgacgcaggcagggtttttgaagtgtaagggcagaggcaaaggagagaagtaatcttcagagagtgaggaaaccagttgtcccatggtagaacttcaaggcagtgctgaatggtttcttaaaatttaaggttaaatttaaagtgtgatggatctacagagtaatttgtttttgtcctccatcaactggcaggcactcatgaaataagctgaattgtgtttaattaggtttggggctttgccaggcaagtatgatagagaacgaaggagcaagaaaataaataagtaatcagataaaatttgaacttgaagatatttacaaggaagtgagtttactgattgaccatgaaatgaaagccaggcaatgagggaagtggtaaaaaatgttgtgagaagagtggtggtggattggaggtctcaaggagtgaaaagaatagttaaaatgaatgaaactaaatttagttagctggaaagataggcaaaggttagaaaatggaaggcagaaatggagatgtttaggtgtggtctttggttataaaatgaaagtttgatcctcacctatatgatccgtgctgtatgacttttgaagtcatttacaaataactacaaatgttaaatcagaacacatcacttggatgtaaagtagaaaaaaatgcctcttagttcaattcaaggagagttagctggtattcacagttgtatattatttcagaaaaagagaaatatggatttgggaaccgcatttgctcttagattcttcaaaatatattttagcgtatgcactacacatcagtgatttgaaagtgtaagggtaattcacaaaattgcctaattccctctcagtcagttttctcccaggtttatgttttgggaacatcacaattatataatatgctttttttaaccatgtttggtactgtgtcataaaaataatgtgaagctataactttccaattgaaatactgtataacctaccattatagatttgcggaactaaggtaaatgcttcactaacattcaagggtagatacgatgcacattaaaggatctgcactgtaagatcattgaggaataaatgaaaattatatgtacattgataaacatacagcttggcagtttgccccttagttaaattagctgttattatatggtaggtagacagtaaatatttgtttaaatgagttctttgccataaagcaacacattaaaataagagctgcaacctaagaacaataatctgttgcttaagaactgagagaaataaagagtaggcatttagctatatagtttactaaatggttttcatttcattacaatatctgtaaacttttcattttatactcggtattctgtgtttacgtcatagattgttgtttgaaaatcaatatactttttccaaattctggaaagttaatctaccctggggagtacaaaattctttaaagaattttttatatgtatatatcagagatgaatcactccagagcttatatttttacctgtgaacatttatccccatccaaattaacctttctccagtcatatgtataattatttagaaggcaagaatatatagtcaatgatttgagaacaaatgtgccccactctccgttgtacaatgattttcagtaaagatgttgaaatgtctgagtaaaaagattatatttctttggaattcaattagataaaatagtaacatttttcaagaggtcataaagttaggctaatttttctgatagtcatgccttaggttgatttgggatatataagatgaaattatttttacactgaaatcatatttggtgtaaatgtatagttacttagattacagtgcctagcaatgtagacaagtgtactatttttcttccacaaagagatttgccagttgcctcaaatacttttccccttttggtttgataagtagtatagaaggcatgtatttgaaacttagaaattgagctgagacctcaaagctcagttcagttaagagtttcatgtcctggagcgatgctgccaccagagtcaacatcataatcacaaatggaattctcatggaaatcagatcatttgatgtggatatgtgggaaagaaaccaagtggctttatgacatagtataccacataataaaatcacacaccaacagcaagaaattgtgtttccacagcatgaatatgatatatggccaccagctggaaaggaacgaaaacgttcaataaccaaaaatcccaaaattggaggtttgcctctgattcctatacagcatgaggggaatgcaaccttggcccggaaaaatattgaggtaggttaggattttgtttgttttatattcaattatagaatatattttcctgtgtcataatgtgattaggtcattaattacttcattggcttcaaaagcacaataataatcactttgtaaagcatggtaataatcacatacagcaagaaaacagtatgaataaccttataccttttattttaatatcattgaccacccaatcacatatgcacaatactacttattttcttacctctaaagtagccaatttaaaatatgcgtatagaaattctggtggtaaaatcacaacttcaaattcgttttacaagcttacttaaaacaccttcagagtaagcccatagcagaatatgtctggagccctggtaactaaactttctagtaatataatcacattccagtgctttgggaactgatggggtctctcagttaatttaaggacctacaagatgacccctgagaatcaagaaagaagatttggcatctttcatgaaagctactgtttgttttccttctcaccttgagggttgggagatcataagcggcatcaatcttgacatgaagtttggcctcttcagcaaagaacataggctgtttactctcaaaactcattagccattttgggaccaacacatatttcagtgtcttaattgagtctctgaaagcaaaaagaaaagcagttagaaggtgttcttatatcttccttgagcctaaatttggaattaagctgttcaaatcttttgctctccaaacagaaataacttttgaaagacgaaagccattttaacctagtgatcagatttttaagctttttgtgcatatcctttcttgaacatttatcccactgtaatattccttctctaaaagagaaaagcttcaaaaataatggtcctttgtttactgcttagtcattctgccctgatgtaatcaaagtaaggaatatgtctccaagaaatcatgaccttgtcatttcttccattctgtacctagtttttttttttgttttttttggggttttttttttgtttttttttaggtaataaaccgctctgcagagttccttatctaatcaagtatcttaaaattctaagagttacatttcccaggaacccaggacagggaacacaggctgaacagatgaaactaacatagggagagatacgccctacagtgactgtagaaccttttgacattgccttcagatcaattatcggcaaagcaaaataaattattgggatcaaaatacattaaccagtatctaatatagatgatgattgactgtataataatttcttagccttatcccaaatccacaatttcagagacaatttttaacatatttaagataggaaaactgaagaactgaaactataaagtgtttacaagcttttaaaagaattacatgcattttcaattactggaaaatttctgagtctttaaaataaaccaagctctttgtaagattagtaaatataaggtagtttggtgatttgataaatttggcaaagacattttttaaatgtttaattttggaaaaacataatgaaacttactttataaggcaataatagaaatttttttaaaaaaattcatataaaccatgaaaatatctgccataatattagattcatataaaaattttaaaaaatatatttacaaaataactaaccatttttgaccctttgttttaaaaatgaaaagtgagttaaaatattaagtatttcaagaacaaaaaaccaaacaccgcatattctcactcataggtgggaattgaacaatgagatcacatggacacaggaaggggaatatcacactctggggactgtgttggggtggggggagcggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaagaaaaaaaattaaaaaaaaactcaaaaaaaaattaagtattatatattaataaaaatcagtcataacaatgaatatattcaagaagaattatttttcaaagaagttgttggcagattgataaattttgtggctaagcctggctttcattcagtcctattgaaagtcatatgagaataccttatccaggtagggaaggcttcatggtggaagtgacttctcaagttaattggggaaattagtagtgagccagctgaatatgccaagttgttggccgaggaaatcacacatgaagaggcaaacagaatgctgaagaatgcacaaactagatactacctgtggtcctcctactgagtccctgtaaaatcatggatatcttactttaacgccatcgttctaagctgctttatctgtaagcatgtgggattaataaaagcccccaccttatagtgctgttgtgattaagtgacattatacatgaaactttattagaataatgactagcatatctttaacatatattgagacaaaatattaaggaactgggaagatgatatggaataattcattagtttttttcaaaattgctattttaacagcaatatctgtaaaacaaaaataacgagcaaagaatgatgatgcagtgaagcagaaaatagtgacatagaatcccacccataagcccctctctttgttgttagtatcctgagcacagtttgatgtggtagaaagcagcacattgatttcagaaaggccaagctggggtcccctcccaagctctcacttatgcaaacttgggcaaatttttttctttgagtttctatttctgcatcttaagataaagacaatttactttaaactatgaataatacagagtttaaagcgtttaaagtgttgtgatgattaaatttattgatatgattatgtattttacaacatgaagattaagtaatacagtgagtttggtaatgaaagccaattaagagagtttctagtatactctgtacatattggtcatattactttttggtgtcctaagacctctgtaaccattggcttgcctctggatttaatggaaaatatgaaggcccaggctaaagccatgtgaatgatttgctgtgagaacccatccattataccattctctagctatgataagtaaaacctgctctgtctgccactgggagagacagactctgtttcagattattatttccgttcaaacaactggttttccctcagcaccctgtgacatgaactggcattgcctatagcaagccatctcttgctcttccactttcagactttatctctctctctttttaaattatgaatgcctaatcttttaaggacagtacagtgtataaactatgactttctttccccattgtctatgcacttggctttctttcttcatagcattcaaggcaatttggcacaccatattattcatgcaaaattcttcctcactctcccatccctaactcttgacagttcacttctatcacatctccccaccttcatttaaggttacataatttaggctaatattatagatgtattagtctattccctcattgctataaagaaatgtctgagactgggtaatttatgaagaaaagatgtttaattagcccacggtttcacaggaagcatggtggcatctgcttggcttctcgggaagccttaggaagcttacaattatagcagaacgcaaaggggaagcaggcacatcttacatggctggagcagaagcaagagagagaggggggaaaggtgctacacacttttaaaggaccagatctcaacataactcactcaggagaacagcacagaggggatggtactaaaaccactcatgaaaaccccacccccacgattcagtcacctcctatcaggcctcatctccaacactggactgcatttgaacatgagatttgggtggggatatagatgcaaaccatatcagtagtgtacttgaaatttcagcattatgtatgttattacttggcccttaaattctgtgtctaagagagtcccaaagtttttatgctgatggttgaaagacgatgagaactgtcactctgatatataaaacctctctatatttatccttaatttttcccaagtaatagatgccgagtgaaactttttaacaagattaaagtttgtttataaaccctgtcttgttttttttttacttcatttgcgataaaatacatatatcatggaattttctactttatttaaaaatacatacaattcagtggcattggttgtatttacattgttcaaccatcactatttttcttagtattttaacatattctaatgaaactttggaattaagctagatattaaacatttcttcctataaatttcagagtaggaaaaatgtatatagcttaagatgtataatcagaatcttaccagaaaattccaaatttcaaaattatttgtacattatattcatgaaaatatttttattccacttgaattttctgttataaatttatgtttggatctactgagattaagaaaaatagaacagtgttgtatactggaaactgtttaaacttttcttcatttactcattcaaaaatatttattgatcatttcctatgtgtgtacaaggctcacacttcagtgaactaattaaacaaaaggaaaaaaaaaatagaaaccttgctagacatatctaagcaggagtgagttagaagaggcaagtatgaagtgagattcaatttgaataactaacccaaaagacaccttcgaagtggtatgttgaatgcatgttaaaatgaatttccatggattgcattttacagatgttcctcaacttatgatggggttacataccaataaactcaccataaggtgaacatacataaaataaaaaaggcgttaaatacacctaacctatggaatgttgtagcttagcctagcctagcttaaacgtgctcagaacatttatattagcctacagcggggcagaatcatctggcaacacagcacgccatatcagtttttcaccctcatgagtgcatggctgactggaagctgcagctcattgccactgcccatcatcacgagagagtgtcctaccgcgcatcactaaccggggaaaagatcgaaattcagaatttgaagtatgctttctacttcatgcatatttgtttttcaccactgtaaagtcaaaaaatcgtattgaggcattgtaagccagggactgtctgtagttgattttgtagctctaagattagtatataaattcagacatgccacttgtatcgaagtaaagttaggacctaagtcatagaaatgagatcttttataggaagcatcaacttttatgtggattgcactttctaaacctaaattgtgccaaatcttgcttccctgtgagacatttaattttatttttagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggtgtggtctcttccctgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctacttgaatgtgactttattattttcagaagttgaaggttgttattgtgaaatagatcaaatagattagctttcttttctttttaaaaaaatttgaatttaatatatacttcaaactggctgtattgtttttccaaacaggtcactgtaagtagctttatttatttaaagacccacttgctgagaaccaggcacaattacaggctctgtggcctgtattgacgagaagctgctgaccagccacatccctacaagatgcatagtaccacccctggtttataggcatctctgccagccttgccacaccatgagaaggccaagggactggcacaagtgtctggcacctcagcagtgccacttggtcattcatgagcagtccctcatgttcaggaacagtgcctgtcacccaggccacttcagctgcatccactgtaggaaggagctgactggtgaggcccatgagctgaagggtgaactctactgcctgccctgcattgacaagatgctgtccccatttctagggactgcagccagcccatcaaaggccacatagtgaatacactgggcaaagagtggtggcatgcagagctcttttccctgagtgtgagaagccattcctggggccctggcactatgagaagaagggcctggcctactttgagatccactacagccagctctttgggacatctgctgtagctgcagccatgaggtcaagggtgacatggtgttggccctcaacaaggcctgatgtgtgtgaactgcttctcccgctccacctgcaagagcaggctcactctgaagatcaagtttgtggagtttgacatgaagcccgtgtgtaagaacttcccactggaactgaagaagaggctgaagaagtcattggagctcacgtctcgctaggcctagcccaagtctggggacctcaactctgaaggctctcttgcctggcccttctctccctcccttccttctcccagaggacctctgccttctccctctccagctcactgccttctcacagccacctcccacttctattgtctgttcttggactcctcatctccctttacctgcttcttgtcctccccttgtctcctttctcatcatctccaccctttctattctcttatctctgccttccccaatgtcttttctctcctttatggtggcttctctctttccttctgtgcagaggcagtgacccaagaggtggggagcctgtgaaaggcctgggcccatgccctgtgactgcatctacctgggtccatggacttcagcctgcagaactccagggatagcaaatcagggtctggggtcaccagagctcctatcctgacctgtccctccccacagggaaccaggttgcacatattcctgtgggaccctccacctcagagtacacccacagccagagcagcccacctgagctgcaggaccagggccacccttcaatctctcaccattcatttaaccaagtagtatccctgtgcccaaactgggccagcaagtcctgccaccccattcactacctgcagggacaggagcccacttccatcaagaggactttctgaaatccaaccttggcccctgcctctggctaggccacttggttctcccctcccccagcccagaacctgtgttgagactttgggtgtggctgggaataggaggtggtagggtcagaggtggcttatttccacctctaaggaggagaattcctccacaaccagtgcagacctgaggttgggactcaggcttgcataatgaaggcttagtcacaggaaaaaaaaaaaaagaaagaaaaaaacaaaaaagcaaagcactcaaagtgctcaaaggcactctcaattttatttctgtagccctaaaattaattattagacatggtttttaaatatttgatttctaaagaaatcattacctgatgattcatcaaagtgtcactgagaactcaaaatcaaacaaaaataattgaagcaaaaatatgacttatgaacgtaactatattagctgctgaattgcataatttttaattcaaaaatataatgcaaaagcaattttgtaaatgcattaaatgtatttgaacaggttgtagcatgcagatatttgcatctttttaaagttttaataatcactttaggaagaagattaaaactttcaccatcttaacaaaatttgcatgaagacttacatattcttccttactcaaatgaacttgtaaccaaccccaaactcattttgcttgcctcacaacagccagtaagttaaggaggtggaacaaggaacaaggaaggcaactttattttggaaagccagcaaaccaagaagatggccaactagtgacctaaagtaccattttaagtcggtacaaatttcaagctgtttttatgtttagggtagcaggaagaggaaagggttgggatcaagatgtgcgccacaaccgcagaaatttggatactagtcagagtttgaggcagctggagctgcttcgtccatggtcaggtcacaatgcttctgcaaatctcttttttttttttttctttttttaaattttaagttctagggtacatgtgcacaacgtgcaagtttgttacataggtatacgtgtgtcatgttggtttgctgcacccattaacttgtcatttacattaggtatttctcctaatgctatccctcccccaaccccccacctcctgacaggccccagtgtgtgatgttcccagccctgtgttcaagtgttctcattgttcaattcccacctgtgagtgagaacatgcggtgtttgcttctgcaaatctttaacaaaacatagctgtttacatacttttcctttaatcacagagttagttaagaaaactacatgactgttttctttgaattttttctcagtgctctaaaattagcctgtgagcaggaataggtaaagacccctttaacaaaaaatggagttagttatgttagtttttctactgtttcactgttaccaattagttaaggcagaattagttgtaaaatgtgaccatttttctgtcatgtgtacaatcatcacatttaatttctaatgatcaggaaatgcaaagcacagaaatgaatcaggtaattaaagtttatgtttttaagttgtataattattttaacattttttatttaaaatattacaaattacattgtattaccccttttctgccacagccactatatgttgaatataaaagttttgataattgagatacctctgcagatttaaccctttttatgagttaaagttcagagcccaaatgtcctcatctgagaagtaggaatgttaacttgttgacttttttcaacaactgttttatacacacacacacacacacacacacacacacacactctcacacaaattacgagccaggtatatgaaatagatacatatatagcagcatagtagagatacaataaatgttagttattaatgtattagtcctcctagctctcatttgatcttagttgaccctaatggttttcaaaaccgcttctagcaggcagatcaagacggtgtaatagaaggctcttccaactgtccttcactaaaggacaccaacctaataactatctacacagaaaacaaacttcatatgaaccaaaactcagatgagcactcacagtacctggttttaacttcttatcactgaaggaggcactgaaggggtagaaaatacggtcttgaatcaacaccattcctccccaaccccctagcagcagcaacatggtgcattgaggaaactttttaggacaacgggctgggcaaaaatttcttgagtaatatccccataagcacaggcaaccaaagcaaaaatggacaaatgggatcacatcaggttaaaaacttctgcatagcaaagagaacaaccagcaaagtgaagagacaatccacagaatggcaaaaaatatttgcaaactatccaactgtcaagggattaataaccagaataaataacaagctcaacaattgtacaggaaaaaatctaataatttgattaaaagttggcaaagatttgaatatacccttcttaaaagaagacatacaaatgggaaacaggaagatgaaaagatgctcaacataagttggcagaaaaatgcaaatcaaaactacaatcagaaatcatctcacctaagttaaaattgtttatacccccaaaacagtcaatcataaatgctggtgagattgtggcgaaaagggaaacttcttggtgggaatgtaagtacaattactatggagaacaatgggaggttcctcaagaaactaaaagtagaactaccatatgatccaacaatcccactgctgtatatataccccaaagaaaggaaataagtatatctaagagatagcagcactcccatgtttgttgcagcagtagccaaaatatggaagcaacataagtgtccatcaacagacgaatcgataaagaaaatgtggtacttatacacaatggcgtgcgattcatccataaaaagaatgagattctgttatttgcaacatctgtggaactggaggtcaatatgctaagtgaaccacctgttatttatttgtgggatctaaaaatcaaaacaattgaattcattgagatgtgcagaaggatggcagccagaggctgggaagggtagtgagagggtggtgggatgagataagaatggttaatggatacaaaagaataaaaggaatcaataagacctagcatttgatagcacaacagggtgcctatagtcagtttaattgtacattttaaaataactaaaagagtataactggattgtttaacacaaaagtacttgaggggatggataacccatttttcatgaagtgattagtaaacattgcttccctatattaaaacatctcatataccccataagtgtatacacctactatgtacccataaaaattaaatttttttttaattaaaaaactgcttctagcaatgttttcttcatcctttaaaacatatgttatgcactaataaagcagattaccacaagttatgggctgaactgtcttctcccaaaaatcatatgttgaaatcctaattcccagtaccctagaatgtgactatatttggaggtagggccttcacagaggtggttgagttaaaatgaagttattaggacaggccctaatccattctgactggtgtcctaagaggaaattaggacatacaaagagacactggggatgcccagccacagaggaaaggccacgtgaggaaacaaggagagtgtctgcaaagtgaagagaaagaccttataagaaaacaaacctgctgacatcttgatcttggacttccagcccttaaaactatgagaaaataaatttctgttgtttaagccacccaggcgttttgttatggtaaccttagcaaagtaatacatcacgtttttgtgttaatttgttaatattgatatatgatgagcagaataccctctggtacttgaaataattagtccttgtgctcttgttgctccaaatctcagaataactttctggcatcacatcaaagttacaataaccatatgattaatggaggaaaagaaagacatgttgagatgtaactgcttagaaatcagctagctaaataacatgaacactaaaataatatagaataaaattcaaaattgtgactcagcaaaatgactgttggggtctgcttgtaaagactcgagttctcatatcaaggccactcttccagcaacgatgccctatctttcataacatctgataaagaatgttgctgaacctttcaaagaaagaccaagagagcttctcagttaaacgactgagtaatcaaccaatacactagactacagagacacacaaactcacttcaatcaacccagctgacccaaaccatgattttacagcctgttgactggcttaacaacaaccttcataagatagaagtagcatttatatctcactggggaggatctcatcttcccctctactattgcctcatttgtctgctcctgtttgcagcaagactcttcattacatttgtctaacttgctgccttctctttttaacctctcattctttctttgaaccttctttattcagccttttgtttcccattactcttcgaaaactgctcctggcaaggtcagaacaaccttattcatgactgtaatgaccagttttcagtcatcatattgacctatcaccatctacagcattttacacagttaagcaccctcctttgtgtaataattctactagtattggtctctaggatcctactgtcttgtggttttcctatttcctcacaagtcagtcttctcagttcctttactgggtagcctaagtcctagaggaatacatcaagtcttgtaactttgcatatagtatatcttctgcactacccatatgtttaacttcagtctgaatctactcactgagttccagactgtagtttacatttccacttgaatgtacaactagcatctcaaatatatctaaagctttttacttgctcctcagcctttccttgtccgggactcaggtgcagagatattaagcagcattattcagctaatgattggcaaagctggcattcaaacccaggaggtctagctcaagaggccacacttttacactctgccgttgattatatcttttctgaattatggcaaaagattctcaacttgtctccctaattgcatgctactatgtggaaggaagcaaaagacagagtgaacttctaaaataaaagattatgtctcttctcctaatagctatttcagtaaagttaaaatggaatgtctttatcaatgtcatgttgcatttatgaatatacatatttaaaatatatttaaatataaatacaagttggaaatgattgttccaatgcaccacctgctattttttaaacactctgcctcactcactttgctataagcatactgttcctcagcatcactaggcatgaaaaggccttagaacttttcacttaactgtttcttctgttggccaacactctttccagacatacacatggatcactctgttaactacatgttgaccaccttgaatgtctccttgccaggcagacaatctctgatcatgccatatgaagtggcatcatcatctttctgctatcccctttatcttcttacttcattgggcttatcaccacctgataattgacatatttattagtatatattttaatgatctacctccagtagaatataacactgcaaatgcaaagtcttagattaaccactgtattcctagaatctaaaatagtgcttgtgccttatctcatattcactactgaaacatatattgaatgaatgaatcatggcataatgaagtagcttgaagaagaacaatgatttcactgaaagctagaaacaatgggaaacaaaataaaaaataaaaacaaaaacaaactcggctgttgctggaatgaggaataggggtggccagattctgaagaagtaggaacattaaagatgtgggctaatattttatagctgctatttttctgcataaatttaaagaatctgtacacaggacaaaaagttgaaaatctagtctttgctcaggttgagatgattttttaagatagaatgaacagcagagcttttgcagtcttgttcaggaaacaacattggagactcaaggcactaaaatcctagcaagaatggaggaatagaaaactaactatagctagttttccttttaagacatttgttgaattgtgatgccacgtataacagtaagctaataagcttagcagaaaatccctaatagtgcggtggagttgtttgtagtctcatgatactaagcatacaaaaattcaattgtatttactatcatgcagagagacccttgtgagcatacaagctctcatttggaagcctcgggaagccatatggttggagcaggtatgaattggaatcttgacagaacatcatcaaaactgcccacaacctcaattcagctcagtcccattggatcaggatcatcagcctcctctttgccaaaagatggaaaggtaaatcctctatggaacttctctatttttttttttttcaatttctggcatttaaaaatgaagaaaaaggaaaaaaattcaagacaattgaccctttgaccaaaatgctaagatgaaaatatagacaatagaaagaaatccccaaatgatcaagctgttagaattaccaaagaaggactaaataacagcaatgattgatattaatattaacaagaaaatagacaaaaaatacagaaaatattggataattctgtcagagaattggaattttaaaaaatcaaataaaaattttagaagttaaaaacatagtaactaaagttaaaaacaaatgggttttatagcataattgacatgcaccaacggttagtgaattggagacaggttagtaaaaaaaatcaaatatatccaaaatgaacacacagaaaaaaatatgtagataaaagaagtatgtgagacactgttaaaatgtcaaacatatatataatgtgttatc

SEQ ID NO: 29 - DNA, 2776 bp, Homo sapiens
agccatatttttcagctgttgtttaatttgtgagtgaaatgaatatgcaaactgaacatactgcttaattggcctttacaagggagatcgataacacagaaacgttaattgtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagcaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgagatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaaggcacctgtgttgtgatagttcacgaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggt

SEQ ID NO: 30 - protein, 749 aa, Homo sapiens
HRNVNCFSFTAETEKEKQDWIEAVQQSIAETLSDYEVAEKIWFNESNRSCADCKAPDPDWASINLCVVICKKCAVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEAISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTRHLCCDSSRTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 31 - DNA, 98606 bp, Mus musculus
  misc_feature (1)...(98606): n = A,T,C or G
tagtgacccgagtttgatccctgggacagcatgaagctgggaggagtgacctgattccacaacgttgtgctctgaccaactctgacacatgctatagcacctacctcttccaacgcacacacactcatgctcacttaagaacaaaagaggcctttgtcgtacccctcaaacacgccagccaggtaataacacccctttgcttatcccagactcagtccaacttcatcgccttgctattgttttgggtaccaaggctaacttgagggagaattcttcctcctcaacaaggcagggcaaagatgacaagatctcaagaatcacaaccaagcctcaaaattacttactagtttggaaagcagtatttggggatctgatcaccagcaaagccagctttaatcacaccggatccctggggagagaggacaaagacaagtgagagcagccactatatggttccatttccatgaagagagaaagcctatatttgtgcatataacagacatgcagacaggaacattgggaataatgaatacacactcaggaagagaagggcctagaagcagcaagcgggactttcactgcatcctcagtgaactgttcaagttcgctgtagttttctcattgactgtatgaaacaaactttactctgagtattacatataacgttgatacaaataatatgaatacatatgatgctgatagggtcagggagatggctcatcagatcaaagcacttgccatgcatgtctgctgaagggagactttctctctggtctccacgtatgtgctgtggtatgtatacacctgcactctctacacacatatacaataataataaataaaatgaaatttaaaatatgaataaagggaagagaaaaaaacagaaaggatgagagattgcaattacctagaagtcacacgcttcatacacattaggagagctgcattctttcccatcctactggcacaggaggcttttgacctgcattcccaccttaggctgcagcactccctgtccccaggtcttaggacacatcccactacaagtatcttgcactgattctgacaaaggcatgctctcaggctcgtattgaagggacagaagcactacatgccatagagttttttacaagccagtgttttttactcctttgtcttctgacaatgaagaacagggaggccttgatgacttgtctgaggacagaagacgagatgcaaattcctgctcaatatttgtcccgttggttgagtgcagtaccaggaaagaaccatttttctaacaagcatctctcataccttccaggacccaaccaaatgtaaacagactctaggcacagataccaactgtgtgcagggaagatgtcaagacctgatcttgcttggaaatacacttcattcttctttgcttctgcttctgctgcttcttctcctcctcctcctcctccttcattttttttttaaagattttttttttttttttatatgagtacagtcagatcccattacagatgggttggggagccaccatgtggttgctgggaattgaactcaggacctctggaagagcagtcagtgctcttaaccactaagtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtgagaagtggaggaagggcaggggaaagcaatgtgaaggggacagcaggggacagccaaccctctatcggcagaagagagcgaacaggagatactgtataaactcactggcagcagattaggaaggtacagttgtgaaatgaactcaaagcctaagaaagaaggggaattcttctcctgcaaaccccggggcctggacgggtgggtgggaacagcaccgtgtgcaagatcttcaggaacctgttcaagtttcttaataattgttcattgtcttcatcagggtgtggaatgccaaaagactagatggctctcctggcaggggatcaagacatgagaaacgaaggtgcaatctttacctcaggcccagatttaaatttatttactcgagacaggatttcatacatcccaggatggcctcaaacctgttctgtagcagaaagtgaccctgagtttctgatttctctgcctctacttctttaatgctgggattgtaggcatgtgctaccatacatacgctcagatctgaatatttttaagaattgattttccaagttgtctgctttttagtttactagcacaaaaccaagagtctgggtaacaagacaggttatgatgttagactcagctattcatagtgacacatgcctgtaagcaatcccaattgaaggctgatgcaggaagagccacagtttaagcaagccacatagcaagaccctgtctcaaaaaaaccaagcgagaggctagagatgcggctcagcagttaagagcactgactggtcttgcagaggatccaagttggatttccagcgtccacactgtggctcacaatggccagtactccagttttaaggggatctgatgccctcttcaggcctcctcatgcactgcatgcatgtgatgaaaagacattcaaaaatactcaaaaccaaagccaagtgaagcgatgccagcttcatgtactggcctctggttttctagttagagtataagagtccagctgaaatcctgagctttcttgaacggtaaccccagccctcactattacctgcaccatgacaacacatggatctcactgccctgttagaatttgtgcttcctatttttctctacttcattccaagttcctcaagatcagagacttcacatagcagtatcggtcatttgccacacactcaagagactagctggtgtgagttaagtttatgagcaaaagattggcagaaagttgccaggcatggtggcaaatgtctttaatcccagcactcaggagccaaggcaggccagttttgagtttaaggccagcctggtctacaaaggaagtttcaagatagccagggatatccctgtcttagaaaggaaaaagaaagaaagaaagaaagaaagaaaggaagaaagaaagaagttggcagacagcaggatatactggtgcacacctttaatctcagcactcagagggaagaggcatgtggatctctgagttcatggtctgtctggtctacaaagtgagagcatgtctcaaaaaacaacagaaaaatttaaaagttaaaaaaaaaagatggtggaggaaacctaaattctgagcctgagcgagcacgaggaacgccagtgagcagccccaggcagaggtggtgcagggaagacagagcagctcagggaggggtgctttcagaggaaccagacccagcttgtccccatggccctagcaggcctgccaagacaaggcatggaccaaccatcagacaggaggtggtgagatgaggtactgtgttgttctgcaagctgcccctcggagcacacaggactgactgtgtgtgcgccagacaatgcactgccacccagttacacacttcagcaaaggaaagaacaaacactctgtggtggtttcctgaaaacggagtctcatgcaatgtttgatctatgcagactaaagtcagctcccccactgaccgttctcctgatgcacgcagcaagcagctgcaggctgcggcttgggaaaatttattcttttttttttttgtgtgtgtgttattattggggaaacatttcttttttttaaatttattttatttttattatatgtaagtgcactgtagctgtcttcagacactccagaagagggagtcagatctcattaaggatggttgtgagccaccatgtggttgctgggatttgaactcaggacctacggaagagcagttgggtgctcttacccactgagccatctcaccagcccggaaaaatgtattcttaaggacttcaggttgtgtgatgtgccaagaaaaaggctcatggtcttccatctaacaagtaaagactagattctgagagaggtggggccacgggttctaggacagaggttgttaattggttcattttggtctaagcctttggtttggttccaaaaatattttaaagacaaaaaacttattgagataaaatttacgtgtcacatatatcatttactaattcaaggtacagtacaattcaatgtttttagtagagtcagaattgtatataaccagtgtagccatatagccaaggttggccacacacttgtaattaatagaagaacttttttttaatcactcaaaaattggccctgcgcccccaaacagtgcttctgtatcagctgtatccatccctctagcaccatgcaacccccactctacctgggtttgtcaatcacagcatactttatattagctggcaatgcttacaaatgcgagagtgcaggtgaaaccgtctttctacttttctggaaaaattggaacagcccggcatggtggtacacagatgtaatctcagcttgtaggggacaggaaggcaggacctttagctgagtgttgtctacatgagtctgcagggagccagagccacacagtgagagtcttttttaagaaaagagtcaaggactggagagatggctcatctattaaggcacttgttgcttatccacaggacacaggttcccgaggatcaactcagaagatctcaactattaattccagccccagggcatccgatgccctctcctggctttctcaggcactgcatgtatgtggtgcatgtatataaatctcagaaaagaaaacagaaacaaggggctgaagagacggtccatcaggccgttcagagtacttgctgttcttgtacttgctgttcttctggagggctggagtcaggttcctagcatcctcactgagaggctcgcaaccaccactccagctccagggatccaaggcaggggagctggtgggaggggcagactgcttctgcactgctaatgccaacgcaaaactgataactctttaaaagaaaaaaaaaaaaaaaaacttttttgtttgttttttttttttgttttttgttttttggggtttttttgttttgttttttttttttttcaagacagggtttctctgtgtagccctggctatcctggaattcactctgtagaccaggctggccttgaactcagaaatccacctgcctctgtctccgaagtgttgggattaaaggcatgtgcccagcaagcctttcttttaattatgtgtatatgtgtatgtcctgtgtgggagtctgtgtatgtgagtgcaagtgctctcagactgaagaggatgtctgagcctctggagcttcagtgacaggtcacaacctgtctatgtgggtgccaggaaccaagctttggtcctctggaagggtaccgagcactcttaaccgctgagccatttctgcagactgagatagattttttttttttttttcccgagacagggtttctctgtgtagccctggctgtcctggaactcactctgtagaccaggctggccttgaactcagaaatccgcttgcccctgcctcccgagtgctgggattaaaggcatgtgccaccacgcccggctcgagatagatttttctatacattttttttctttcaacaactaaggaaaaggtagagctaacacataggaactggctaaagacttaagtagttggtttgtctagatattaacattgagaacaaaatattacaaagaccccgtctcaaacaaacaaaagaaaaaagtgttaatcactcatttacaatgttacatagctgagtcccctatcttttttttttttttttctgagtcccctatcttgattgggtcctttacccctgccccaacactggacatctttgttatcatgacagagatcactagttgtctattcacccacttagccaataaggttttattttgtacatagtcgtaccaggccttaggtaccgtgtaaagagaggtgggtagagagagcagtggagggctggagagatggctcattagttaagagcactagttgtagccctttgggaggagcagggtttggatcccttctgtaccgtatccatgttggatgacccatatctgcccgcagctctagctctaaggaactgaatgacctcttctggtctctaaaggcatgaacacacatgcttttgtacgtgtgtgcacacacaaacaaaagacagacagagagaatgagagagagagagagagagagagagagagagagagagagagagaggaggagaggagaaggggggagaagcggagcatatgagggccttgggtactgtgttgagtgggtagagggactaataaagaatgaaggatctcacttccttacccacaagggttaaaaagtctactgaggctagtgaggaagacaaaaaaccaaagcaaaccaaaccaaaccaaaccaaaccaaaccaaaaccaaaacaaacccccaaagtaacacatttaattaaccttgctcccaccccctgcttccaacaatgccacatcttagaggctggcttcaaacaatgaccttgcatttctgactttcctgcctccacctctctagtgctgggattccagacccggaccactatacctgattatacaccaaaagtttatgctgtgctgaggagggagcccaggatttcacgcatgtcagacaagcaataccatctgggctatacaccccagcctcagcctcccttttaaaaattcacaacaaataaaaccgccttccttgaagaacttggaaccagattcctgtgtgagtcttggatcttttttgtgagtcttggatccttaactcctaaagtgggtggtttgaaaaacctccccaatcctcctgttcctgcataaacaggagaaagcaacctctatccacctacgacacaaagaaaaggacctagtggcatgtccaggtcccagagggccggaacatcacagtgactctgaaaaggtcagcctaggtcagagggaactggtagtttgcctcaggggagggacccagaaagtaggaagattctaaccagtgtgggagggaccaaacctttgagtgaaactcagaaattaagacaaatgtccctcctcataaaagcaatacttaagttctttctatttgtctttatcgatgcatgtgtgggagcggtgcttagcaaaggattgccatttagataaggcgatgaagttgtggggcaccattgctgtatgaccttggtcacctccaccttccgtgttcgtactgtgaaaagaggggcaaacttcctccttaaccattcactttttgggaggcttcgacttgcatgttggtgcaaagcgtcctggaaacgctagcgcacctgacaaccactgtgtctgataatccccctgcctctcacctgggcactgcaaacatcaaagcatctcgcctgctttgtcacccccctttcttctttaccttgactaactataatttataatcacaaaaataactgaaatcccatggccatttctggtaccggtttgtccggccccacccagatacagttcactaaattgcccctccagctcacacccaaggaaactgtcctttttcaccggtggaccagccatcgccttccgcaccctgagttgccgagccaatccctacagctctactgcacggcaccgccccttacagaagggaaacactatggcgaccggaagagcgacaagcgccggagccaatgactgcggagtgctgttctaatccggcaaggcccaaaggcgggaccaataggctaagatagacagcaagagtagccaattgagtgatggaaaaccagagcgaaggcgggtgtcgggctctaagagaacggttaaggccccctgagccaagggtccacggacccttcccgggctacagctctttcctttgtctaccctcaaattctccattacacggatgttggctggccgccctgccttcaaactatggatgtgaggaggacgcgggcggcggcagctgaacccgcctgacaggccgagccagtgacaaagagctggcggcctaggctgaaaccgcggaaacaatccttcctggaggagaacacagtccctttaaagataggaaagatgctactcacgttgtcgatcacaacaggctggttggcgatcacatcgtaggactccatggcagaggaatctttccctccgaggaaggaactgccagcccggtccgcagcaaacgccactgacacgcatgcgcagtctagtcgccggtactgggcatccagggagccgcccgacctcgcctcggaggaactacaatccccagcattctttgccccagggcttgcgctccaaaccgggtcccagcccgatcggatttaggagattggacagtgtatttcctacacatggtggggtctgtagtgtttgtagattaaagagccacagtgttgatgattatcttgcatgactggatttgagatcccttcgaaggggtttccagtacactcttaaattttggagtctgaagtacttgtgagtagttgggtttggatttgtcagtacttcaggggcggttgaattttacagagtagttctatctctcagccattccttcacttgggcaatacaaaccattaataaacatctgtcgctcagtggtagaatgcttgcccaacacatatcccagcagcaccgggagtggtgctggaagcctttaatcccacctctttcgaggctagtctggtttacagagttccaggacagcgaggggctatagagaaaaaccctgtcccgaaaaacaaaaaaatgaaacaaaaagcaaaacaagacaaaacccatgaagcaaaagccaatggaggttataaaaaaatacctgtacgttggatgccacaaaaccacgggcctaaaatatcatctaaaggtttagaaattgttttattatttttcttgaccttgatggatgacaacatccaggcgaagagaaagaataggtaaattttttttaaaacagccaggcattttccccaggcacatttcgagttaccctttttgtcaatagttccaagaaatattagagttgtaacattaataataatgacatactgtctaatgaattagttgtcaagcttatcttaaaattgtgtattagtaaaacaatattaagcgcttcttagtagttgtgtagagctttcataggaccctggcgcctcaaggtaccaagtctctgttctaaactgggttcctcctaacactagggggaggccaagatccttgggacgctcccaacccaggggcagggaggcggagtctattgtcaagtcacgccttccccacttgtgactggcaaagacactagccaataggtgtcaggaaagggcacgctgacgccccgccccttggagctccccgcggtcccacagcatcctctggccgacgtcttgaaggctccggcttgggcggacggagcctcgtgcgcaggcgcggagttagacctcgccgtagcccccatcgcctcggggagtctcatccacagtgggtccgctggcccataggggcgctttccctcctctaccctcccgggttctccgcgcgccctacgcgccccaatggcggagctgcggcctagcgtcgcccccggtcccgccgcgcccccggcctctggccctagtgcccctccggcctttgcttcactctttcccccgggactgcacgccatctacggagagtgtcgccgcctctaccctgaccagccgaacccgctccaggttaccgctatcgtcaagtactggtatgctctgggcctcgggaggacggggtccggccgggaaagcttcgaacacccgggacgaagtaatttgcagaagggggaggaagaaaacggtttaagtactggggaaccaggagcttcctggtgctgtggaaggagttaggacagaagttgggaatggggacaaagggttaatggatcccttgagtagtgaggggttaacccggattaggacaaccgagaactgggggtgtatacagaagcggaggggggactgtaagagcgaactgtaaacgtggagaaaggagggggcgcctgtggtgggtcattagtgggcttgggggagccagggggcggctggggtgggatgggggggggagtgaaggcggggcctggaagagcatttgagagggctttggagggcacaagaccgcgtagtctagggcggtccgggaaccaggacgcccctgtgggttaggagggagcaagatgagggcattgtgcctttgatgagggaagagttgaggagaggccttctttcagtcttctttcgggaccttcccgagcgcaggagcttctgtcattcagtgcgaagctgttgctcttgaagtttgacagagcagctcttccagataaactttttgcttactctgcacagttctctttctctctgcagagcttgcttctggctttgcagctgctttagctttaggacgttagttaagaacaggtttcgggagagccaagcattagctcgggattgaaggggatcatagctcgccaccaggtgcgtgacagagacctgagtgggcaggaggaatgaagaagcgcattctgtcttgtcttcgtgatttcagccgaagtttaaagatgccctgtaaaagatcagtttccaaatgggctggctgtctttgggggtagaaatggcactttctcgtctcctattcttttttgcatcctgtttcttcagtcagccttcagacaaaacaggtgttatgagacaagtccttgtggtctttctgaaccaaaaatagattcagaggtggccacattcaggcaggcagtcgttgtattgtatgatcctgaaaagttccttgccttggggtattggcaaatggtggtcctgaagtgagggatgcctttgcaggttacacaccctttaaagctgaatctttttcctatgtggcatcctcttattgcctctggagatgggagatgggctgtagagagctgaggttaccccccccccccgtgtgtcactgggataataatgcaaaggaaactgacagccaggagggtctggggaccagcctgtccgggtagccaggagccatgctggcaaggcatctgtgcagggcagcctagttcctggctgactagtgttttgaagattgcttctgagtgggtagtggctcttgctaacttaatcacccatttcaatggcacctctgtattagttgtgatgaacttgtcccatgtcatgagaaaaacggggctgaccttgccatactgtttgctctgatcttgtttaagtgtgagggaaagtccctgtgcagaatagggggcacctggttttatgtcacctacatggtcatcaagacagagttgcctgttagaggtatggaagcaaagaccaagggtagttatactattttctttctgttataagctttcagtgaggctgtatccccagaagtagaccagaatgtggtaacaaatgaaaaggcatgtacaacactttgtgaagtaagaaatgctacctagatgcaggaatctaagaggaaccagcttaggaactggttctttctaagactcaaagggagttgcagaattgagatactgaagtttattcctatccctcatgtgtaggatcttaccagccccttcagttctcacagcagtatgactgactaaactgcttgggtctggttatgggctttctttgggggtttgaggggtagcattttagctagtggtccctgaccaccaggaaaactctggctgtttgatagttgagatagccgagcaagacagaatcaaagtagggaggcagagcctggtgtcttgtcctgcaactaactaccctatagagagaaagaaagaaagtgttctgggaattaaggtaagggatcccctgggcccttggaccgcatctcttcctaagtgtaaaatctgattttttcccccatccatctgactgagtatatggctaactttgcttgattcatagccattctgtgacacttcttaaagcctcttctcgatgtgccctctcttgggaggctgtctgcgggagctgcagtgtgccagcagtcgggcaaaggacagaaagcacagtgcgactgcttgttgctggacggacctaggccacatcaagggctgtgggagattggcagcagaagttgggggagaatatggaatctttcttttttagggttctacagccttaatggggtccctttctttcctctatccatcccaaaaccatttctaaatccagctggttatgggtttagtcaaatgatttggtgaaatcacagttaaagacatagagatttgtccctttacctaactcccttgggcagatcctaagctattttagtgactttctttcttatgacttctataaataacttagcctcccccctcccccaagaataaggattttaacaaaggctagtaacatcctggcaaagaggatgaaaccagacttactggttttaaaatagggtttgaattgcatggtcctggcacacttgctgggatctcttgtactatgtcttttatttggtcgttagctttccctcagtagtttagcccacttgcagagtgcactcctgtccatgttccaggggcaggcaaaggccaactccactctgtggtctgtggagtggtccacgtgaggcggctcaaatgccgagtttatgggctcgctgcacactttcttctgctgaggggtttcatttagtgtgctttacaagtctgctgttttcctgtccattccgagggaacgcaggttttagttgttgctgtttgttttggttttcttaaacactaattgctaaaagagcttttgttgaattcaatcttcaactacttctctgctggatttatggggaaatttaatgtgatccttaggagcctcaaatcgtgagatgtcccagctcttcctttgagcccagtgcctcccggcttactctttagaatgtaggtgctcatggggctcagcctggctctcgctgcagtgctctgtgcagagttgattgagccaatgtttggccttcgtcacttgcagcgactaagttttgatctgtggcgtataggccacgatctgtgcagactggcagctttatgtatatccagacgaaacaatgatagaaggcacagtacagttttttagaaactagctgtctaagagtcaggtgcagagtggaacctgaactttcaggaatgatatccactgggcatgctctggacagtcattcaacaggagctactgattgactgatgtcccttaccttgaagcctggcatgttgacatagagagattcactccatttggagtcagaacttgaaacaggcaaaagcaaaacgggcaaccaccacgtctgttttctttctaaaagaggccctgcctgttggagggaagagaagggagcatcttgcacacgtggagccagccacacagcctcggctgcttttcccttggctcatctctacagagaccttttgtgcctccctttaggtatctcactctagcttcccctagcacggggctctcgggcttgtagaacagagcctcttagttgctttttcctggtttccaggcttatgttgacaccttgtgttttgtcttttgcaggttgggtggtccggaccccttggactatgttagcatgtacaggaacatggggagtccttctgccaacatccctgagcactggcactacatcagctttggcctgagtgatctctatggtgacaacagagtccatgagtgagtgtctgccatctgcctttccttaaccctaagcctatttctgaagttgtattgagtgtgtgtgatgatgttggttctgtgggagtgacactttccagtgtcacctctctggttccaccttctgcctgtgctggacagcctggaactcgagatgtaggccaagctggtgttgaatttgtggtggaggggcggcttatggaattgcttatgctggtcttgaactctccatcctcccgagtgacagggttgcagatgtgtgctgccagacttgtattcatcgtgcttgggttgcccacttcacatgtttagccccagtctgctattctctgccctgtgcctcttacccctctgtactggctagttttgtgtcagcttgacacagcacagagaaaggagcttcagctgaggaagtgcctccgtgagatccaactgtaaggcattttctcaattagtgatcaagggggaaaggccccttgtgggtgggaccatctctgggctggtagtcttggttctataagagagcaggctgagcaagccaggggaagcaagccagtaaagaatatccctccatggcctctgcatcagctcctgcttcctgacctgcttgagttccagtcctgacttccttggtgatgaacaacagtatggaagtgtaagccaaataaaccctttcctccccaatttgcttcttggtcatgatgtttgtgcaggaatagaaacttgactaagacaccctctcagggatagaaagatggcttagccatggctcaagtggttaagagcactggctgctcttccagaggacccaggttcaattcctagcacccacagggcagctcacaactgtcttttttttttttttttaagatttatttattatatgtaagtacactgtagctgtcttcagacactccagaagagggcattagatttcgttacggatggttgtgagccactatgtggttgctgggatttgaactcgggaccttcggaagaacagtcggtgctcttaaccactgagccatctcaccagcccccacaactgtcttttaactctagttccagaagatccagtgtcctcttctgacctctgtaggcagtagacataagcaataggcacacagacatgcattcagccaagacacccagacacataaaataatagaaaattaaaatttttcttactccctaatttctctttataatcaactaatatatgttttaattccaacacacattttgatatcaagtagaatataattaactttgtatttaatcctccaaaattacaattagaataattataaaagctaacaacattttttaatcgctgattatgcaccaggtactcttgtagccatttatatatgtgtgacagtaatgaatttaattttctgcataacactttgaatctactaggtgataatatttgccccacttagtaatgtgaaaacataaagagcctctataacacaatatcttttctgagcagtatgagggccaagattgattgattgattgggtgattgattcagagacaggatttccatgtagacaggctggctccgtaggtcagactccttcaggatcaaatccaggtcctcaggcatagtaggtaaatgctgtgtcatggagctatagcttcagataaatagcctatagtctagggtttttaaaggcaagttcttagtatgtagtcctgacacgcctggaatcactatgtgaaaatatttattaacacagcaacatggaagctatgaagaactacaacaaactgggaagaaaactatgatcgctttcattaacatacaaccatctccaaagacagtctctaccgagtcaggacaagaggagccttgcgacttttttgtttgtgattttgagacaggtttctctgtgtagccctctctcttctggagctcactccgtagaccaagctagcctcaaattcacagagatccacctgggattaaaggcctgtgacactgtcacctggctgagccttgctactttttcaactggcctaggctaagtaccacctcccagatagaagggtagtgtaagaggtctccctcgttatcttgttgtttgttgctgtcttatcgatgaggaaactgagttacttaagccttgaatctaggctataaaggaactgggattttcttagactgagtccagagtttgcactcttaggtcactgcaccataccataccaaccctttgcccacaggcccaggctagctctctctgtctgttgttagtgtccgaggccaggcctcctgtctttcctagcacatggggtgtagtgtctactgtctgccttcagtccttccaaatggccagcagaagccttgggggcagactcagtctcgcctgagtgggagctttgccctacagtatttacagtggagaaagtaaagtctgtgccatgtgttctctttgggttttggagacaggctctcgctctgtggctaaggctggcctagagctcactgtagtcaaggctgagctaggtcggctggagctgaagttcccagcggttgtgagccacctgatgctgggagagcaggaagtgcactaaacaactcaatgccagcgcaatggttttgtaggtaaaggcccttgctccaaggctgatgacgacctgagtttattccccagaacccagtggggcagagaaccagccccacggttgatctctcatctccatactcttgacacagtgcgtatattcatcctcatatactgtcttagtcagggttacaatgcaatgagaccccatgaccaagagcacttgggaggacagggttcatttggcttatatatcctgaatcctagtttctgagggaagccaacgcaggaacttaaaaccaggcaggaactgatgcagaggccatggaggagtgcttgctcctcctgacttgttctgcctgctctcttctagcacctggctccaccaggccaaggtagtaccacccacaaaatgctgggccctcctgggttaattaataattaagaaagtgtccaacatgtagtggcacatacttttatttccagcatcccaggaggccagcctggtctatatagttagttccaggacagccagagctatataaagagacnnnnnnnnnnnnnnnnnnnnnnnnnnnnnnnnnnnnnnnnnngctagaagaggcagttggatccctagagctggcattacaggtagttgtgagccatctgatgtgagtggtgggaactggactgagctcttcttggcggcaagcattcctaagcactgaactatctctccaggtcccctccccaccacgaggaatccttgttccctcttaagtgtggaccctgaagttcagcaatgtttgtagcccaggtggtaaagtaaaatccagtctggtggccccaagtctgttcctgtccatggtgtttgtgttcctaccgtgtctcctcctagctctttctttctttctttctttctttctttctttctttctttctttctttctcacagcttgttgaggatagagtcaggcatttccttttcctcagggacaggtggaggaggagccctgcttggtaatcctaaatgacgtacaactgattgtacggccattttcacccatggtttctccctgccccacactcactagagggaacagaatgaaaacagttgtttgcaccaaactgcttgccgctccagtgcgaggagcttagtgtggctccccagcatccacagaaaaagttgggcatggtggtgcacacctataatcttagcatggggcaggtggagacaagaagcctggagctcactgctggctagacttactgaatagtgagctctaggtccagtgagaaagtctgtttcaaaaaataactaaaaagggagatgccacatatgtgcacacctatgtgacatgtgcatacactataccacacacatgtacaaattaacaaaacataaatttgggcattacgtgtctttatttatatatgcacacacatattgatatttggatgctgagaactgtacttagccccctgtcccatgctgggtacacgccctacattgagagtctaaaaacataaaaattacattgtgggatctcatggggttttgacaaatatataaatcgtgtagcacttacatggcttcacttcacatatttattaatcttttatggtcaagacatcccatgtcctttcctttagctctctgagaagtgcagtgcggtcttgtgatttctaggcactcgcatacagttgcaccccagtgtctcttagtttccattgctcagcttcaccccattttgctcttctgctctctctccagcccctgcttaaccacaggcccactcccatttctgtgagcacaccaaaagggccttttcttttgtttgccttatttttgctcttaactctttttctttcccgtgtatggtgttttgccagcatgtatgtctgtgcgccactggtttgtctggcctggaggccagaagagggcaggcatcagagtctggagaaccttagttacagatggttgtgagccaccatgtgggtgctgggactcgaacctgcatcctttggaagaacagccagtgttcctaactggctgaggcctctgtctagcccttgtctcagttttttgaaatggggactcatgtaccccaggcttgctttgaactcattgtgttgctgaggatagccttgaacttctgaccctcctgcctgtcctaccctgccgctggggttgcagctgtctgctaccatagctaggcttacgcggtgttgggcctagagaaccctggctttgtgcacgctaggcagacattaccaaatgagctacacgcctaccaaaaggttttgaagaggctatttctgaagttgaaagatgacatagattctagcttggagcagcaccaggggcgagcataaagattttctagaaaggctacctacaaatgccgtcagtggaagagattaccctttcccagtctccacacctgggagctgtcagacatctgggcctcagctgccaagcgctagttggaagcctgcagctctggccttttcctttgtggccaggcacgtacggatagagtggagagatgtgtgaggctgtggaagagggagcttcagtgtctttctctgaggatttctgctgctcctgagacctctagaagccctcactgggcaagttcctgaggccagaggaaggccttcaaggcgacctagctagagagtcttcatgaaccaaggcagacttcctggtgtgattctgggaggcagtcatctgtagaattactggactggttccagagactggcttcatgtggaattgccccacatgttggccctacccatagggccacacttcaccaccaggggagagctaggctgtgccctacagatgctgactggctgacagacgtggcatattcaagtggagttgaggtggttctggccctcctggaggctggagttgccgctggccggcctcctgtagctgccttgactgaggcagcagagaaccttctttcctttcctgttcttcttcactggactctgcgccacaggagttatttattgaaacactggccacagattaacttggccccttgttatttagtgtggactcaatctcctgcagtttagaaaggttaaactttctcaaagcttgccttaaaggaactctgtaacctgcccctttctgtgccagggtctccagtagaaaccctgccttggctgtgtgtacacgtcttggccttcactcccagtggatctgagcttgcctccctccctggagtgccccacaggaccacagttgatggtccccaggagagtgcagctgacatagctgcctgtgggaagggagcgcctcgctggctcagcagaaggcaggccactgaagcctggtcccttggctttattgcagaggtgtttagtttcaggctgactgtgaaattgggacagcctctgctaagcctggggattcagactctgagaagagtggagggctgagcaggggagaggtcaaggaggggtctgggctttttttttttaattatatttatttatttggggatgtcacaggcactgtgccccagtacacatgttagaggacaacttcatgacttggttccttctccaccacatggattcccaggacccaactcaggtagtcaggcttgagagcaagcacctctgcttgctgagcctccccagtagctccgtggacctcttactgttttgtatcgctgtagtgctgggaatcagacccagggctttgagtagactaggcaagctctctagaaaccaggctcctagacctctgagatttttggttctgagaattcccttttccctgtccaccagaaaagcagtgtgcgcttgagtctgaatgcatgtgtgtacacttgcttgtttgcctgtggttctctttctcctaaggtggtcattttccacctcggttttttgagacaagatcttactgtcttagttagagttactgttgctgtgatgaaacacacatgaccacaagcatcttggggaggaaagggtttgctctgcttacgctcttataacacagtcaaaggaagtcagggcaggaacctggaggcaggagctgatgcagaagccatggcagagtgctgcttgctggcttactccttagggcttgctcaagggtggtttctactcacaataagctgaaccctcccacattgataactaagagaaggtcccacaggcctgcctttcccagatcctatggagatgttttctgagttgaggttcctcctctcagatgactataacttgtgtaaagttgacataacaactagccagggcactcatggaacctggggctgctgtctcggctgcactggctagccattaactctcaagccttcttattgcttccccactccccacactggcctacaagctatatcactgtgttcaacttctccatgggtgatgaggatactatcgcaagctctcatggttgcatagcaaccactttacccactgtgctgtctcccaacttatcatttatctatctatctatctatctatctatctatccatccatccatgtatgtatgtatatgtgtgtgtgtgtgtgtgtgtgtgtgtgtgtatatatatatatatatatatatatatatatatatatataaataaatatttttttttcctgagataggatttcatgttatctagattggccatgaaaactgtatacccaaggattgtgtagaatgcctaatcctcctgcttctacctcccaggtgccagaattacaggcattccctgaaccatgcctcgtttatgggatgctggggaccaaacccagggcttcatggatgctaggctaacacttgaccaactgagttacattttcagctctgcaccatgtttgtgcagtgcatgggtagtcaaacccttgtttgtacatggtagacaagtgttttaccgaccacatccgttctgaggctgcctttagcacagtgaatgcctgccttcatgctccctgtgttgtctgagtttggcagcaccttccttgtctgacattcctattctgaaatgctgattctgacccttgactcctaaatccttcctgcattctgactctgaactatctccataagctgcatattctgtttcagttatcttagttttgatctgtgaccctgagatagggccagagtgatcttgacttttctgacctgagtcctgatggataatctcccttcaaataactgcacctaattgacctgcctctcagacctagagacctgctggcgtgcagcacacacaccagcaaagcaatattgaaccatctttaaaattcacaacatcagccgttaagaggacttgctgttcttacgaggaccacctaggttcacttcccattatttacatggcagttcacaacatctgtaactccagtttcaggagatccaacaccattttccccctctgcaggtgctaaacatgcacacaagcaaaacatacaagcaaaacatccatactcataactaaaaataaacaaatccagaccagcaactgaaagggaagggtatcagctcaggaccccaagaccaagttctctacacaaaggagatttatttaccccagagagacaaagggagtaaagagaagaagacaggagaggagaggatgaagaaggggaagggaacaaagaagagagatatttgttgggggtactaagaggggcggggctggcacaaaggactgtctctggatagagaggagataggctgcccaaataaggaagtagaccttggtggctagctttaggaatgtaatctaacatttttttagcaagacagaggggatggggagaagacagcctgccagagccctgctggccatgttcgagtaggctagcgtcccttcaaccaggtctggcccattcctccaaccccaacacttgggaggctgacacaggaggattctagtttgaaaccaacctgtgttacacagtgagttctagggtagcctaagttatatatgtgccccagcctcactacgccccaaagacatgttgatactcagaagatctttttcttctgtttttatattcattcagttacaacacgtacacacagacacacactcacatgcatgcacacatgtgcacacacatacgtggatgctttactttgagatttatttttattgtttttatttatgtgtgtgtgtgtgtgtgtgtgtatgtnnnnnnnnnnnnnnnnnnnnaaatgtccaatgtgtgtgttcacggagactagaatgaggatgtaggatccttctggaaatggagttagagatggttgtgatctgtccctatgggactgggaatcaaacctgggtcctctggaagagcagccagtgctctgtactcctctccactcggcctcctgaagagcattgtagtggctgagctgctgccctcttctcaggtagcactgacattgtttacattgtagcccaggcctcagcttgctgtgtagctgtggctgtctgtgaattccagatcttcctgccttcctgcccatgactgatggagttaaggatttgaacctctatgcctgactgttactgttgttgttattatttacttttgttttaagacaaggtcttggttatatatcccagtgtgatggttgttcttggttgccaaggtgactacatctgcaattaactaaaacccaagcagtgggtacacctgtgagggaattttcctaattaaatcatttgtaatgcgaagcctagcattagtctgggtctagtgaggtgggagcccatataaagcccatggcgagggaagccctgcttcctctcactctcactgagtctattctgtcactggactgtgatggagaagatggagacccttcttatcatcttcttttttcatgctttatattccttatttttaaaaaatgtttattttatgtgcatttgtgttttgcctgcatgtatatctgtgtgagggtgttgggatcctttggaactgaggttacagacagctgtaaactacatgtgggtactgggaattgaacccaggtcttttggaagagcagtcaatgctcttaactgttgagccatctctccagccaccagagcttgcttctttatgattctagtgtatactgaagatcagctgagacatctagcttcttggactgaatagctactggattcttggactttctgttgatagacagacattgatggactagctggactacagcacacacgcacacgcacacgcacatacactcattctgttggttctgttcttctagagaactgtgactagtatacccaggccatccttgacctttagaaatcctcctgcatcagcatcctagtgctagtattatacatatggtctactggttcctagaatctttaaataaaattataaatatattttcatgcctggttgtagcaatcttgacgatattgatcatgttatttttcactttaaaaggtcagtataggctggatgtggtggcatgtgtctgtaatcccagcacttgggaagtagagacacaaggattacaaatttgtaaccagcaagaacctatgtttaaatcaaaaatttataaatgtgtttgtttgcatgtgtgtgtgttcatgtgtgggtagtggccacagaggccaaaagatggaggtggaactacaccacctgagtgactcgggcactagaaactgagctctgatcctctgtaagagcgtcaagtgctcctaactgctgagctttctctcaggatccttgtacccaggatacacaaaacattcacagacatgtgcacaaatgccagagtgggtacgtccagctgctgaaataaataggctacattttaggccaggcttgttagactttccataatacatagaaagtcaagcaatgggatactttggcttagaatatgtgatgtttgggcttagaaaaaaggatgacacactgtcctttctgacactggtctaccagttgttgggttggcaggcccaactggcttgtacccagcgtgaattttgagatgtctttggagggtcaggcatttcttcactgtatagagcatcatggctggacaggttctgggcctgaggtttgtgataatgaacaacacagccagtcctgctcttcacttcctgtcttttggctaaagtctctttgtagaaggtggacttgataccacttcagagccttacgtcctcatggcgcctggctgtctcttcttgtagagttcatgccttaggccttgtagagaaggaatccagaggcttagaaatgtggtcagcctagatttgaggcaaggccagttggccatttgacagtgaggactgggttcattatggcttcctagaaagtggagcaggctgggctccaggcttccagtgtaaccctcgaagggccttcttttcctactcctgttgtttaggggtcacagacctcacctcagaaagaccactcaactcgggctgctcctgatttccagaactggctttcatgggatacccagtgctgctgggagccctgccttccagtgtgtgaggtcagagcttgggtcatggctgtgagatgtaagagcttctggagaaagggtctgcctctacgttcaggtctcatccagctggctggctccaccccgtgctgcctgcagataggactcctgagcacctctgaaggcttggctggtagacagaaatgctcagtgagaattgacaggcgacattccgacgtgccggacccagtctccttcctgctccagcctttccaagctcaggctgcagatgccgggtcccaccctgtctggacagttttcattcttgtaaccaggggctttacatagaggaaagaccagccggaaggcagcagctgagcctttggccttagagatttctagaaatgttggtgttatgggccagttagttttgtgctaggtctttgaccagggacagaatgcataacatgtcatatggttatgtcacagctcagaaccatcctgatgaacttgagtaaagccatggccactcgcagcccgcagggtccagcacctctgtctcctcctctgccgctcttgccctttctcactctgctccgtggtctctcttctatctcaaggcctttgcactgcctgcacaaacctggagagctctgtctataatagtctcacccctgacctccgcatccttaggtcttactcaagtagccatcagtaaggtcttctctaactgcctctctttccttcttccctcccttcctccctccctctttttctttttttcttttgagattgggtctcactctgtagctcaggctagccttgacctcacatatatatgtatactttatgtgttgatgtttccctgatgactccagtgtgtgctaagtgagccagctggagacggtgttcgctccacggatctggttcttgcagaagggctcttagctccacagagaaggatagtgtgcctcaacacgaaggctgagctctgagctcaggtgaggacgtttcttctgttcaggcccccactctggagatcagaatccgtccagggccacatcaagcctttctctgggagtcgtgtgtgatgtggatagagcctaactcagcttgagtgaaggactgagcactgcactcagtattggggcgctcttcatcctgttcctcagattcccagggctcactattgctcagtgctggagtgccctggagtctaaggcaggctttctgatcccctgagtcttcaatgcttagaggaaaacaaaggagaatgtattgatagttttacagagtccagatgccaggttgaaaattgagtgagggatcaagcagtaagagaacctgagattcaggtgaatagagagggagagggttcatttcacaaggaccagtattagtttgtatgaagttttgaattggtttgtatgaggttttagtgccaagactgtcatgttgtacaactctagggacactgatcatactgttctgcactgggtacttcctggaggtacggtgcttagagccctgatcggatccagctatgtgaaagtcgaagcaggagggaccttgaggccttctaggtacagaaggaaggccagtctgcaggcagtgtgagaaatgttattgttagccctggagagatggctcagtggttaagatctcttgggtctggttcctaccatccaatggcagctcagaaaacctcctggacctccagttcaagaggctctaacaccttcttctggcctccttgagtactaggtgtgtacctggtaaacatacatacattcaggcaaaacagccctgtattcataactccagttcccaaggaaccagtgccttctgctgaccccctccagtaccagatacacacatggtgtgtttatatacatgcacacagaaaatattaaagtctacaaaaataattaaagtaaaattaagattcattttggaaagggattggcagcgcattcatgggtgatggggaacacagggccagctctgccctagtgtgagggtctcttaaccaaggtgactgatgactgcaagaggggccccagggtagcatcagaaaggtatttggacccagctttgacagtaagaggaaagaaagctggtgacactttgatgtttgttgtttaatgtcaaggtctggtcacctctgaaaccgtgggagtgtcatccccacgcagatgctcaaccttgacacgatgtacctaccccgtgcacacacaaggtacagccttgcccctggggagctgagatgctgagaagattggcttgaattacctgcttcaggtgtctcaaggcacctggctgcgcagagccgttagagataatgcgtggatgaaatgcccctgggcagaccttctggctcttgggtcagcaagccttgagctatacacctgtgtgagagaggcacgcctgccaaattggactgtgacttgccatcattggcccagcttgccttctttataaaaaggttttgtaaggttgttagcttaagtcagaatgaggaatgtagctgttagagttctgttagctttcttttttctttctttacttatttgtttgtttatttatttgagacagagtttctctgtgtagagctagctgtctggaactctgtagaccaggctggcccagaactcagagatctgcctgcttctgcctcccaagtactgggcctaaaggcgtgcatgcacaaccgcacctgacttcatgctagagttcttaatagcttgcccagctggcttgggatttccctgggtctgactgcctgcctgtcctcgggaggtggcttggaatagaagtgacaggctctagcagatcttcccatggggactggaagggggggtgactgagcccccagggctctccaggaaggctctgctgctcctggcctttatttttcttaagttccttgtcttggctgggaagcccagggcagagttaagctgctaaagtgcaggagggtttgtctgcctggagtcttagcccaacctgtgctgggaggaatgctatgggaatgtggtccttggcttctggcagcatctcaggaaagggagatcccagtgaggcagatggatgccgtgaatcggactggacagggcgtagcagaaagtgagaatgtgaaactcagtgttagcggggctcagttcttgagcgagcatgcgctctgcggtcccacctcagttctttcgcccaccttgctaggcactgagcccaggacggtctgcagaggatgatgggttttctgttttcctccctgactcctctttgccacccaacacccctttttaatttttgtttttgatctcacgtagcccaggctggccttgaatttgctgaagataacctcgaagctcctgatcttcccgccttcacttccctaaacactagaattataaattcatggtgtcataccagcttccatctctctttttataaaggttatagagagtggtttactataactcagagttttaaagaagtcttaattctggaagaatattgccatataaacatagctcaaaatttttagtgttttttttaaaataagttttactccccagtataatactattgttaccaaatactgtttccaaatggctaatgatgttatcagtaattctgagtaattcaaaatgagaatgtcccctctgcttctggttatttagtaattatttaaagaattccaccactgtgttgatgtcactcagaagacagtaggaatcaagacgtctcaggaaatcagacacaacaagtagaaactggccagcagttcttgaagtactgtgtctacaaagcctgagtcccttacacactggaggtgtgagacggtggggaaagggggcttccagctggctctaaaaagataggtgtcctcctgcctgaggcgaaaagtctgtcactgtgtgtgcagaatgtccttacggagtgtggatgaggaacctggggcatggcgttggcgggaggatcaggagaaggtggtggagctggagctggagctgggagcagcaagcagctgggagctgggagcagctgggagcagcaagcaactgggagctggtagcagctgggagccggagccagagctagctcattagccgtcgcggcctgtgattgtgctgtttttctcccttatctagcctcacactgggatactggagttgtgtggctttaaagtccaccctgcagcatccctgggccaaggaagtggacagtgagactatcaggcggtgttctcactctccagcttctttctagctactggaagacttgccattctgccttagacattaggtttgtgctgttgttgttgttgttttgttttgttgtttttttgagacagggtttctctgtatagccctggctgtcctggaactcactttgtagaccagactggcctcgaactcaaatctgcctgcctctgcctcccgagtgctgggattaaaagcgtgcgccaccacgcctggctgtatttttaatctcttatcacatttatgtatttatctatttagtgtgtgtgtgagtggccatctctcttgagatgtgtcctcctgcatcagccacttggtagctaacagtgaggtgacacattgcatccaaccacaggtagttttgataatttttgttagcttttgcaccatggtttttgttgttgttttattttgttttgttccccaagccgggtttttttctgagtagtccaggctgtcctggaactctctctgtagaccaggctgacctggaatttagggatctgcctgtctcttcccccacctaccccacacaagtgctgggattaaagtggtctgcaccacctggccttgcttcatggtggttttttgtttgttttaatgcccattcatttatggtaaaatattcataatacggagttaccattgccagaatgtttaggtatggtttagggaaattaagttttacagtagtgtgtggccattactactttcagtttctggaactttttaattttcccagttgaaactagaccctctcaaaatgatagtttctcattcttcatgtctcccaacatctagaaaccaagggtctgccttctgtctgacgctaactactccagttgcccgtctgagtcgatgcatgtggggctgctcccatgggtcaggcttactacatttagcgtgacgtcttcaagattcacccatgttgtgtgggtgagaagctgtgtgcatgcttgtgtttgagacagtttcgttcaacacaggttggctgcaaagatcacaatgtgtcttcagtttccacctccctagtgctggggatttaggaaaatgcgccgcaccctactctccccctttgaaggacagataccagctgactggtgtctgcacttccccacctcctcttccccacctcctcagccggccgtaggctctagggttgcctgtgccgtgtgtgtgtgtgtgtgtgtgtgtgtgtgtgtgtgtgtgtgaccctttagcactgtggtgaatgatgctgctgtcaacaagggtgttcaagaccctatattcaggtttttgtgtagcttcctagaggtaggattactggctcattgcagtaattctctctcattttttggaaacagccatcatgttttctatagcagctgcattgccaccagccatgcatagaagttccaacttcatggccatttgatggggtatgctggggcaccatttacatttgacctgatggtaatggtgagtttctggtgtggggtttgcgtgtaacctggccctcctcaggtggaggtgcagagagccctttgctctcagtgctcacaggcacggctgcttcctgctagctctggccttcagtcttgggggcgtcctgatgaagcaccaagccttatataagcccctagttagagagcagtgggaggtgtcttctaattttttgttttgttttataaatacgactgaatatgtttatgccagaggcttttttccaagattgttcccttctggtgagttcccagaactcatagttgctgtgtgaataagagctgcgcttagcttttcttgctaggctcaggtgttgttcgaagcatttggctctgtgtattatgtgtgaattaagtagcttcctagaagttttttgtttttttgttttcctagacaaagtctcactgtactgtggatttgataagatgcttcccttccaaaactattcctcaggcgctctatccttaggacttgtcgtgagggtgctctgagccacggcctcaagagtgcagagcacatgttcctaattgcctgaccatctctccagcccacctcttttttttttaatacttaaaaaaattatgtgtatttctttatgtaaatgcactttgtgcatgcctgacacctgcaaagatcagaagagttcctctggaactggagttttgggtgctggggactgaatctgggtcctctgaaagaataagaactgctcttaaccgccaagccatctctccaaccctgagtaccggtttttaacttctctgacagagaggaatctgacactcatcaccctcaatacattaacacaggggtagtgtcagaattactaacctttactaatataacaataagccagctccctagagggtaatgtttgttttctgctctttctgtctttcccctgaagatacatggccgacaaattgtatccaaagcttactttgttgccttctcttcacggcggctatgggctcatttaacacagtgagagtcactaatggtttcctttgaatatgtgaagatacacgagtggctacagttagaactacagaaaaagttaaaacaaactactctctcgactgttagaactacagaaaaagttaaaacactggcctctagcccttcccatctgattcacacgctcttgtcttgtaggcatcttgtctccttcccaggttatccttcctgtgtggcttccacataaatgaatagtggtgtttgctttttttcccacgtaaacaatgttgcttcagttcggttttgtttagattttttttttttaaattataagctctttatagagtcaacctcattatcaacatcagcatcacgttgagtgtcttgtgtatcaagactcaaactgggttctgagctgcaaagaggattcacttttctgcctctctttcatgcctttgttcaccagtcagacaaagcacaagcactgttatttttaatttttaaattagacattttcattgatatttcttaatgtgtgagtattttgcctgcatgaatgcgtatgtgtgcctagtgccctcagaggttgggaaaagcacaacagatctggaaatgaagttacagatggttgtgaaccaccacgtggctgctgggaattgaactcaggttctatggaagagcagcctgtgctcttaactagctgagccatctctccagcccactattaaaaaaaagaaagaaggactcttgggtgctctcagagactgacccactaaccaaagaacacactcgggctggacctaggcctccctcacatacgtagcagatgcattgcttggtcttcatgtgggtcctgagcaagtggactgagggatgtccctaaagctgttgccatctgtgtgaatacattcccctaactgggctgccttatctggcctcagtgggagagggtgcacctagccatgcagagacttggtgtaccagggtgggagggagaggggggaggggctccaccctctcagaggaaaatgggagaggggctgaggggagggactgtgaggggaggatggggaggggcagtgattgggatgtaaagagaatttttaaaaatatataatttattcttcaacagtttcatacgtgtaaacaatgtctcctgatcgtttccacctccagcccctttcctccatcccccaggagttcccagcataaccctgtccctttcatgtcctatccttttaaggtttttgttttttttaagcatctactgagtccagttagtcctgactgttggtgtgctggctggtcttgatggtttgttgtgcatgtgagnnnnnnnnnnnnnnnnnnnnnnnnnnnnnnnnnnnnnnnnnnnnngtggtggtggtggtggtggtggtggttttgggttcttttggtttttgagacagttgtctcaagcagctccctaggctggcctccagcttcctaagatcagaatgaccttcagggactggcagactggctccatggttgagagagctcactgcctttgcagagcacttgcatctgctacctaaccccctccagctagctgtctgtactttcagctccaggggagctaatgcctcctctcacctccgtgggcacctgcgcccgtgtgtgtacagacatttaattaaaattaaaagtaaagccgggcgtggtggcgcacgcctttaatcccagcacttgggaggcagaggcaggcggatttctgagttcgaggccagcctggtctacaaagtgagctccaggacagccagggctatacagagaaaccttgtctcgaaaaaccaaaaaaaaaaaaaaaaaaaatcttaaggggcagggctgctcagtggttcaggtgtgttgttcttccagaagattccgattggttcccagcacccatgcttgtgtggttttcagttacctgtaactgtctcaagggagagctgacacctccctcttccgtggtcatttgcactcgggtacatacctgcacacagacttacacgtatacatatccataactaaagaaaatctttaacaaaaggctgaccttgagctcctgagtccctgctttctacactcttccttacagctgcaggtaaccctgacccgcttcacataaaggggcttttagggagtttgtagtagtttgaaggtacatcttttggaggtagtaaacatgtatgtggtttcgttaagcattgctaaattcccctccttaatacttgtactgattgtgctcccgccagccctgtgagaactctgctttcctagccccttaccaacaacgtgcatcctgtccttgttctgcttgctggtctgatgggtgggcgcagtggctaacccgctctcacttacatctctctcattgggagtgaggttgagcattttatcatatgcctgtgaggcatacaccctcagacactggctaatggggtctgttgtaacaaatgtattgccaggtctgctgtggttttatgaacatcatacagtgtacgtacgcaaacctgtatggtataacctgacagcatatggcacagcctcacactccttgactacaagcctatatagcatgttaatataccagacaccgtgtatggttcttactactgtgatagttgtgtatcaaaacctaggaaaaggttgccaggcatggtggggcacacctttaatcccagcacttgggagatgaaggcaagcggattttgtgagtccagggtaagcctggtctagacagtgagtttcaaaccatccgagtatgtttactgtgaccctgtctgacaataaataaataagatctaatgaaagtgtggcataagatgtttttcagcagggctggtaggaagcttagtgataagaggccatttgagagcccttacagcttgggtccacatgaaaggagagaactgcccctgcagattgctctttgatagccccattgtaccccatgtggtccctgccaccctcacacacatgcgttcatacatagtaaagacattttacccacaaaaagtgaaaaaacatgcctgtataggactacacttgcgcatccaggactagaggttgctctggctgagtctggtgagtgtctgtgaggccccgggacactgtgctgcactactgtagacttcataaacactgacatataacttccaaaattcaataatttccttctttaataattaattagcattaaattactcttttttactttctaagcttatttttttgtatgtatgtagtgtgggtacatgagtgtgtatgagttggtgaggggcatgtatgtgagagtgtgagtgtgaacgtctctttgctctcagatttcatcctagaagacatgaacgacagctgttcccttggagtgactccattctctgatcagacataccctctttggcagagcagcctttgtgtgaagtggtccagaccaaaccaagcccctgcggggaactctaaacactgaatggtcttgttgcttggctcttattgcctggacagcctgctttgaaaaagaaatctgacaggcccaggtcatgtgtttatcctaaggctagccattccaggcttgtgtttcggagtgtcgaggttgtgtccagccagcctcgtgggtggtaatcaaacacaggtggagaccatctggctggtctgtccctcctcagccaagtaagagctggcctgcccaccacagagctggcttagaaaccaccctatgtggaaacagatggtctgcacgtgtgtgtgtgcatgaatgcagtcatacatgtgtgtgcacacagctctccagggaagtgatgtggtgtgggtgcaaatggctcagtgacttctctctctgccccatgggttctctctgctgtgcagtatggtctctaacgcatatgtccctgtaagcctgttcaagtttttgtggttagaagtcatgtattttccttggcccaagatgaaagccctggaagaatagtctaatgcacgttacaaagctgtctctgattggcggctgcttgaggtcttccttttgccctagtgacccctctccctgtgtagagttttgcttagttgttgatttttgagacagggtagtgtagcccactgagttctctctacttctccagtgctaagatgaaaggttgtgcaccaccatgccccagctttttttacagagtcacaaagtcaatctcttataactctggattttcacactcttccaaacctggggtctcccaagccgggggtctcccaagcctagggtctcagtgtacatagctgtttcctcagactctgcgtagatgagattccaacatggcaattcatcaaggaaacaaatagtgtaaatagtgtcattttaagcgacttgtagccttgtctccaaaaatccatatgtgtagcctccaagtagattctgcttcccacatggtagccaaagaaataagaaaaccacacacacttcctctgactgtgatgatttctaaggatgcctcttcagtcagaaaggcagcttctctccccgatggttcaagggagctggatctacctgcgcctcccaagcacacagagccaaagctggggcttatgtcagtttctaaggctcgggagtttccttctacccagtctcccatcccagcctctggaatgacctaggaaggatgctgcagggagttctagggctgaacagcaattttgtcttcagtttgcaagaggtaggaggaaggtgtcagctgtcattttagcttatgatgtgtttgtaagctggggagtttacatgtgtataatcattgtggttcatgtttgtacaagatataattactcaaaattacatgatgaacatatttcagttcttaacccttctcatcctggcaagctttatgaagctcttggggacacctctctcacctgagtaggtgtggcactctactaaccaggttctgctctaggatgacattgctgccctgtctagcagtaatctgtttcagggactttcctgagactcggggctcctgagtgcttcctaacaagagaggcaggcattcctgtctcattcttacaatcaccctgaggggtgtagccacaggagctgtaccctccccccccccacatcttgttgctgctctgcttggggtccagtgactgaggggtgctcatgacgggtatcgaggggtgctccatgaccctgggatgggagggccttctcagtatttcactctgccttgggatctgattcaagtgctcacaagtgctcatttaggaagccagtctgtgcagctaagagtcctggggcactggagtcctggtatccccagaggtaggatggaagaaggctatgtcttcacagagcacacagctatgttgttggatcacaggatatgtatccttagcaaattcagtgggtgcatactaatggtttgaataagtgaggaacatacgggagattttagtagtggttcctctattatataaaaagaatatctggaagctataactcaaaaaaaatcaaaacaaaaaaaaaaaaacaaaacaaaacagtagtgtaagagtttggctgggagccggacagtgatggcgcacacctttaatcccagcacttgggaggcagaggcaggcggatttctgagttcgaggccagcctggtctatggagtgagttccaggaaagccagggaaaccctgtctcaaaaaaaacaaaaaacaaaaaacaaacaaacaaagagtttggctgggctgacgtcatacatgtacaccctcagctcactagagggtaaagagggctttggagagacttcctcatcctgggatttccattgcgtttggtttgcatttgcatgtggggacaccgcacaaagactttgtggaactttgtcctatggtagttaaactgaaaatgtttattcctttcaggtttacaggaacagacggaccaagtggatttggctttgagttgacgtttcgtctgaagagagaaactggggagtctgccccaccaacatggccagcagagctgatgcagggcctagcccgatatgtcttccagtcaggtaataggccaggggtttgtgtgcttgtcctgtgactgtcagcttgctgggccttgggaacttgcaggtgtgttttgatgtctacagagcccttttgtgagtggaaaattatgtggaccttagcagacagagtttctgtcagtgtcctgataccctgaggctttgttgctgtctgtcatcgctaacctgttcgctgttcccagtggcctggttgtctctgtgtgtgtttccaggcctcaagcacacagactgatcttggttcagtctggaagaatagtagactggagcttgtaccctgccctcacggggcggaggggatgctaaaataagaacttagaattagactattcaaatgccctccaagagattgtcctttgcccccactgcccgctggggactgccgcagtggatcctgggtaaggcctttgtgctgggatgttgttctttctttcttaggtcactctggaggcttcggagcttctcagtgttctactgtggctaatgtccggggagttcagagtactcatgtggcnnnnnnnnnnnnnnnnnnnnnnnnnnnnnnnnnnnnnnnnnnnnnnnnnnnnntgccgagatttatagggaatatgcaaacctaggtgtgttgggggggaggtgggggagagagttttgacagggattggattgaacctgggccttatacataaagactctgacactgacccatatccagccggtgtatttttaattttgagcagtgtcttattaagaccatgttgtccatgttgaccttgaactcactctttagcctgattacaggcttgtgccaccaggtctaactttgaaaatagatttttctttgatgtagattttgatatgctattggaatggggctctaaagatgaggcaacttcttgcttgtagaaacaggtactccagccactgtttgttaatatattcactagtgtgcctgcttaggtagacagagatcagagaaatataaaatagatgttataaaatttcagtcatttctaatatgaagtcattttgaagttataatgcacatcagtggaaaatcggattttatttgcaaatactcatttacatacagaataaatttcactagtgactgctttatattgcactccctctgccccccaggcccttttcttttgacacagagtcttaatatataacccaagctgttcaaatcctctttaacttgattaaaatgcacacttttaattctaacacttaggagacagaggcaggaggaactctgagttcgagaccagcctggtctacaacgtgagttccagcacaaccagggctacacagagaaaccctgtcttggaaagaaaaaaaaaatcttggggggtggggcggggattagcctaagaaagaaaagcctcagctgacgtcaccatggtccccaaagggtgaagcacagcgtggctgcttaacagagttctgtgtgtgtgcacgcgctgcagagccaagtgtgagaatcagctgaacagcactgctcctggatccaagcgtgcgttccagccaaatgtggccgcactgtaggacattctacagtacagccgcctggattcttgtacctagtcggactgtctaagatttacagacacatggtgggtctcagccaacgtttgatccttgatggctgtttgtggacaactggggaaatgtgctgtggactacatgtcaggtgctagcgtcctgccgctatgatgttagttcctcgtgtggctgtcatactgtcattatacagggtaatccttttgttcttgggagacaaaggctgaagtgtctatagataaaatgatactgagtgattcagcaagaaagtaagacgtgttgagagaaagaaagcaaggacaacatctcattaatgagttaaggggacagtatctgatattcattttattccttctaactctcctataggattggaaatatttgtgctaaaatttgtggctcctctttttttttttttttttttttattgttttagagctttattgtagaaagacagagagaaagagagaaggtagaaagagggagactggccatggccacgtggagagagggggaagggagggagagaaggagagctagagatgagaaaggtgagagcttaagagcaagtttgtggctcttaagcatgtgttggtacgtgtgtgctctaagtcccttctgcagcagcggctcctcttccagtatctccagtgtaactgtggttagttatgcctgcagatggcagtgggcgcttcagaacaacagggtgactacacccttacctgtaatacccagcattttagtttctagattttcatgataccattgtactatttaagtaatggataaattgggttgtgtagatcacagctgtaatactggtatcaaggagacagaggctgggagtctctgacttgaaggactatatggtgagactctgcagcaaaacaaaacaaaataaaacagaaaaaaagtccaatcaaataaatagttaaacaagtctactttaagttctttttttggaacttgacagagaataatagtaagttactgaaccataggattgtgtagaggaggaagatccagtggtccctgattttaggctacagcctaaatggaggtgaggataatggctgaattgtcagtttaccttgtgtgccccatgcaagggtagacacctggttttgttttattttgtgcttacagacaagatctctctatgtaaaccaggctgacattgtacttgatattctcctgctgtagtttcctgagtgctaggccactatgatcaggttaagtactttttttttctttttatgctggggatggaacacaggtttctatcagccttacagttgcagaagacaagattgaagttagtaacccattcaagatcacagatctcacagtgtgaaggcaggaggtgagcccacataatgaagtatactttaccccagtgttgtagtgataggagctgtgcagacatctggtctacctgatgccacaggctgtacaatgagaaattttaaaaccatccgtgtggtatagatgctgcttgtacacatgactactcgctcagtgttaactaacactgatgctcaataggcgacagtctggagttcttggaagatggagcatggttttaaaaaaaaagcgtttataaaatctccaaaatcctctttcatatagcttttatgttttaaaacttttatgtgtgtcttcagttccacacacgtgtgtgggtgcacatgtgtgtggtgcacatgtgtgtgagataggagagcagccttggctgtagcttcccaggggctatctgccatatatgtgaagacttgctattattgtatgcatatgtataactgcctacatgtatgtgcaccacgtgtgtgcctgatgccgtcaaaggccagaaggcatcagatttcgtagaactagagtgatactgtaggtgctagaaaccaaatctaagtcctatgcaagaacagccaagtgctcgtaactgctgagccatttctacaacccacactttattttttgagtcaatgtcttcttgttggcttgtggcttacagatgcttcctcagcctgcaagccaaaaatctgcctgctcctcccccaagtgataggatcacagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacaggagtttgagccagaacagctgagttgaaccagccagaggtcagaaagagcaagggtgagcttatttagcagtaaatctcagaggctgaaacaattctaggcctagaaggctagatgcttagacctaagttagcagactgaggcagttacttcaaggaacaaaagaaaattttacatagagtgatgaattctcataaactgaataggcccacataaccaacacccaaatggagaaataagcaagttctccagaaaccttgggtggctgtgggctcatcactgttctgcctgtcggccccacacttgcaccctttccttcctttggtcatttgccattatttttacttggtcttacctggtcttcaagactgtatggatcggagagaaagggatggggaggagggagggagagagggaggaaggagaaagactatgaagaaaaaaaagaaaggaaggaaggaaagaaagagaaaggggaaggaaggaaggaaggaaggaagagagagagagaaaggaaggaaggaaagaaggaaaggggagaaaggaaagaaagactgtatggatcaagcagtttgtgaagttgtgtgtcacggtttgattgcttgctggtttgtttggtagtgtcttgccctgtggtagaaaaccagcagtggtaatgcaggtacagctacttgttgtgtagattacgttatatacatctaaaaccaagcttgggtcagtggttggtctggcagactttttgattcatttttgttttgtttttgttttttgagacacaggctctcactacatgcttatgcctcctaggtgctgggatcaaaggtgtgtaccatcatgcctggctgttccttgattttatgtagttgatttaggtacttgccttgtgtcttagggtgtattagtttacacttccacattgctgttcatcaccaaaggaagtcaggacaggaactcacacaaccaggaacttggaggcaggagatgatgcagaggccatggagggtgctgcttactggcttgcttcccctgccttgctcagcttgcttttttttttttttttaaaagatttatttattatatgtaagtacactgtagctgtcttcagacactccagaagagggtgtcagatctcgttacagatggttgtaagccaccatgtggttgctgggatttgaactctggaccttcagaagagcagtcgggtgctcttacccactaagccatctcaccagccctcagcttgctttcttaaagaacccaggaccactagcccagggatgacaccacccacaatgggctgagccctccccccttgatcactaattgagaaaatgccttacagctggatctcatggaggcatttcctcaagggaggctcctttctctgtgataactccagcagtgtcaagttgacacacaaaacccgccagtacaccttggaagccatgttctaaacatactaactctgtgtagttggggggagggcatatagtaaatgacaaggtgcagatctctgtagtatgattgattgtcctttagattggatttaggcttctcaggctctcagagtggattatgctcaactgatgatagatcccctcttcgtggcttgtagctgtcactaacccctgtgtggttacactccatcagggtcagtataattgtatatatagaacatatatattctttgcttgatgtgtgcataagtacaccctccatgtgtaaatgctctcgcctttctcttctgtccactctaagcccattagcttcagttgtatgtgaggacatattgagcgttgtagtcacaaatgagtgttaagacccgcttttccagttccaaacactaggccagtggtgagcaggggaaagaggataaactctggtgggcgctgagtggccgggggggggggggtgtagcagtgtccacatggagccactagaccacagaccacaacagagagtccctgaagttctgaccagccccctggagggtttgctgagaggtaggaagctaaggtggggcttcgggcgttggtcttgttccacacctccagccctgctcccaggctctcagattgcagaccagcaggcggctgactgctttccttctggcacttgtatgtctgcccttcagagcctgcgttccagtcggcctctgcttgtgtcacttgaccaccgctgttgcagccctagcttagggacagccctgggtctcccgcagatccccctcacccttacttgccaccacagagagtggggaggggcccttaagcaaagggtaactattggcagagaaagagtgggtgtggctctggctagcagaaccagttgttcaccaggcggtagagacaagagggactagaacctcccaagctgtctggcaagagagcaaattgttaaaaagcaaggccagccacacattggtctcctctgctcatgcccagttcccttcctgcttctgtctgtccgtctgtctgtttttggtttttgagatagggtttctctgtgtaatcctggctgtcctaaaactagctctgtagaccaggctaacccctgaactcagagatcctcctgcctctgcctcctgagtgctggatttaaaggtgtttgccaccactgcctggcaccgtcctgctttctctctgttatatctgctgtttctctcgctgctgtgactaatacctgacaggagcagcttgagcgaggagtgggtcgtttggctgaagggtacacagagatgtaaactacaaggaagatgtagcaggaacatgtgacgtcttcttgttcacaggaaacgtaggctagaaccagaggctggcttaacctaaaaggcttgttcctagcgtcccactgctgccggctggggactaagtggtcaacacagatgccccatgggaactctttaccaaaatcatagcaccatgatgtatggagcctccagctatcagaagcccaagcataatcaacttctttgcattataggtggaccagcctaaggtattttgctatagcaacacatagagaacagaataaggcgtcaggggtcaaaggaactttgcatactgctcaggacctgggacagtacaaaagtatcatgaggaaagaaaacgttccagctgtgggacaggcagctgcggatttacctgcagatttagaacccagtctagccccggcagagtcctctggaaggctttaactttttggtcagcttattctttctcatgagatagctatggacagcgcctcttccccatgctctgggtttcattaggaggaagccctgccagctctggctctgcaggccttgattctgagctctgctttagagtccactggagagggcatctgcgctcagttctgcccttggccagtcttaaccacaagttccaggccagtttgacttgagtttttaggagaagcacggtcccaacccttgcaatgaacacagagaaaggcccagtgcccttgcctggctgctctttaatggtaacctcatgacagttcagactgaaatagggagacagggtgattgcagcagggacctttcctgagccttcagatggaggcaaccgaccagttgaactgtctgtggtgctgacagactggcagcacagaattggttcgttttgtttttggttttgtttttttgagacagggtttctctgtgtagccctggctgtcctggaactcactctgtacaccaggctggcctcgaactcagaaaatctgcctgcctctgcctcccgagtgctgggattaaaggcgtgtgccaccacacccagctcagaattggttcttaaacatttctcttttttttctgtttataaaagaaattgtagcagccagggcatgacaggctcatacttgcacttcagaggggaaggcagagaatcgggagtttgagagcatccttagctacatagtgagttcaacgccagactccgctacatgagaccctacctaaaaagtaaaaacaaacacataaattaactaaataatagttcattgtaaaactcaaatagacatgccttcagaattctctaggctcaggcacttcatgcatgtgcctccaagaacatctgatgagccagcccagctttgcaggagggaggggctggtggaaaagagcatttttctcttttgcgttattctacttgtgcgcctgatgcacaatgggggtctactgatgctggggaagccgaaatgaaagaagcaggaccctgtcccaagatggagacaatgctggaagaagctaaggcgaactggattctgtaggtcactgagggagaagcaaagggctccggaaacgtgaaagcggtggcagcgtttagatctcagggtcggcaaaggacagactggaggcaagagggaagagaaaaacatttctggcagagagaaacagcatgtgtgagccctggaggagggaaagagccttcctcagccagctaagggagaggaaaggccaggctgcccgggtggctggaggtgcagcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatctctctctctctctctctctctctctctctctctctgtgtgtgtgtgtgtgtgtgtttcactacgttgtttgtatgatgagcatggaggccagaagagggtgtcagatcctccagagttggagttacatatggtaactgtgagctgccatgtaagtgccgggaactgagcctaggccctgtggaggagcagcaagtgctctttgaaccgggaaccaccggtctccccagcctttacctacgtttcgagtggttctttgccagaggatgctgaggttgtgcaaggtcagagcccggtcatcactcacagatctcatgttctgccgtcctagtccttgggagccttagctcaggaaatcctttccccaaattctagccactgaggcttgcagccttctctttctccagctcttgtggtctttgtccaatccacctcccaaggggagtcgggctctgagtcctcctgccttccccacccctaacaaacacacaggtgaactccaagcccgcccaggtaaggccttactctgccacagatcctccctaaggcgccacacgactgtggcattgctatctgtgcctcggtgactttctgcgaggagatgctccgtctcatccagagctggagcccgctgcttcccagcttggataagctgcccttgctgccccagccagctaaccaaagccaaacggagctgtctacttctattagcatcatctttcttcctcctggtctttttgattttcctgacattttctttccctttggctgatttatcctcttctctggttgctatggatctgtaaaatatttcccctttcatctgttagtaatactgaccaactgcaagtcaaaacactttctccgcatttcccaagactttagattaatagctgaaagattgcattcctgccgtagaaggaaaacgggtcagtccgtagaaatgagtgggtgctccaaaatctaagtggcttagcctgcgctaataaagctaagcatttaaagacgactgagagcagaggttgcagttagagcccaccggctgtattctgatgcccacctgctttacatgggaaactgcgccgggatgcttgtgcccactgcctgccatgttcacgctacaacagcagaagtaaatggttgaggggtgggtgcagctcagtggtacacctcgtgtttcacatgtgagggcctgggctcaatcctcaaactctagaaaagcaaaataaacaaacattacaatgtcctatgaaatccacaaagacttagtatctagccactctcaaaagcctaacttttcacttggaaaatgtctcccacctctacacttgagtattgttcagagtctgaggttgcagaagctctgagaatggaattgccttagctgccttcagtatcccagccagagatcccttgtagcctagtgctgccctcgggggctggggggcgtggcacacatctcctgctgagctgctatgggactggggcaaattcttttggcttcctgggtctgtatcctgcctgcaggcctccttgagcctcttggagctttaaaacaaagcggctatttaacagacactcagctgagatagttcacccctaggcttggtctctcatctcttctccccctgtgaagtcttaattgcttagctttcaagctgaatgtgactcctttgtttatgtcacctgcgttttagggatgctccctgcagggggcgctgcaggccgccggcaagaagacagcacagctgaagagttggggtgatgggacagactctaaccactcagaaggcttatttatttatttaaattgtttttttgtttggctggttggttttgatgaccatgcccacgggtttagtgaaaactgtggaacagttttgcaggggaccaggcttcctgggttccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttgttaacgtctgactcagctggagcactttagtttcccaaacataactttatccttgttttgctacagctacaacacccaggtgatactggaaacatgaaaagtgagtcagaggacagtggggagaagagggcagccgggagagcaggattctctgtgcaaccctgcctgtcctcacagaggtctacctttagttccaggtgctggggttaaaggcatgtacatgttgttataatcgctattaataactcttttagttcttaatgggaccaggccagcccttcaggaatcaagacaaaatcctatagatatatttattcagctttagcacaactattggacagttacttaccccaaaactagttttctacccttgcctggctgtttcccagatgcgctctcccagtaccagagcccgctgggtcctctctcctcatcagtctgccctcatggtgcagtcctcccgcacgtgcaggagaatcctgcactggacagtccatcctgtccagtggagacctcctgctctctacctttccccttctctcattttccttctctctccttgtggtccctacctgcaacctccagactggtaaccaaagccccacccacctttattctctccagtaatgggctatagccacttttatttaaccaatcagagaaaactgatgagcaaatttatacatcatttggtatactgagaatctgcttctcaggactgcaaccagatcctgggggccagtatttagtatttgaatacatagcagcgccagaccaacccccaacatacgccaccatgcccggccacgtttttaaaaaagaaaatgtccagagcaagcggggcatactggagtgagcagaggtcctaaaattcgattcctaacaaccacataaaggctcacaaccatctgtacagctacactgtactcatatacattaagtaagtaaataaatctttaaaaaagaaaatgtgatctgggcagtggtagcacatagcactggggtagtagaggcaggcagatctccgagttgaggccatcctggtctagagagtgagttctaggacagccagagctacacagagaaacctgctctctctgctgtcctctgactcacttttcacacacacacacacacacacacacacacacacacacacacatacgtaaatatttttttaaaaaacggacagcagagagaactgaatctacaggagaagagcctctcctctgatctctctgcctgtgtagcctcgcaggctaactttaattcaaatgaaaagcaagcattgtgtagcacctagcctgaggcagcctctgtctgattgtcaccctctaagcatgtctctggacagaaactagttggacagttttactaggtgctgtatgagacaaacacacattttatacccattgtcatttttgtgaaatctttgatggtttttatttttgagacagtgtatcactgtgtagctaaggctggtctgaccccagactgacctcaaactcatagaagtccccatgcctcagcctccaaagtcctgggattacagctatgcaccacgctgtccagattgcagtcttgggagtgggtaagttcagctcggtagccatgtttgtaacagcagtgtatcgtgttcctgtgcatggatgtactatggcagactcccccgatgaaggttttcttcagctcaccctcatacccccagttcaaataatgttcaaggatcctgtatgtgcaacttgcagccatgtctccttagctgaggacaaattcctaaagtgggttgcaagatcatgcagtctgcacatttgtagtttggggcctatgcccagctgccctcaaagaaggaccgcaaagtctcggtgttgctcactgggactgtggctgcaccctcccctgccagaagcaccaaggaagatgctagatcactttaaaagtccacagaagtcacaggactttcaagtcttaggacttcaaagctgcctcgatttcagtatcatcaagaatgtactccaaggctagagacttaaagacttaaacagagcctggacctcagcaaaccctgcttcctgcctttagccttagcaaggagtctggtcaaagcaccaaaatactatcactagtaaccattactgcctcttccttcagtcaagtcaaatagacttgcttatgtatcttctctttcctttatctggaacagcagtacagaaactagggtctggactttacctctgcaccttcattcgcgtgctgtctctgaccaacaccccctcctaggtgccactctctttttttattttaaacttatttatatcagacactgcctccttcctgccccccccacacacacagaggacctccccatcccccatccccttctcctctgagagggtgggcaccctcctttatatcctcccaccctggtgcatctctgccagggtaggtgcatcctctctcactgaggccagacaaggcagcccttttggggagctgataccacagtcaggctccagtccagttgttggggggcctaggcgccagtttctacatagcagattagtggtggatgcagagggctgctttcagaccaacaccgccactgctgtgcagtgggtgaggaatgctagaggtgaggaaaccaggtgcgtttctggcagtgctgagctttgattctgaccacagcaggtgctcaaagctctttgccggcttgccacatggcaaaggagttgctgcttcccttatgctttctttttcctgggaaaaagggaatctaactagaaaactcttagctatttatcagggcccagaaatgtttcctaatgtgacaggccttaggaggcagtgagtggactcatcgtctcagaaactgccctggtaaagcttgggcagtgtcctgtgagttaagcagtttgtatatggacttgactgatttgggtacttaaatgaacgaataacccaaaggctattttattttctgggtttttatttatcttgctttattctgacaggtctctgtgtagccaaggctgacctgaaaccctctatgtagcccaggatgtacctgaactcatgatcctattgtttcagcttcttgactgttggaattagaagtgtctgctaccacactcagcataacacagccttttttttttttttttaacatttatttattattatatctaagtacaccgtagctgtcttcagacacaccagaagagggcatcagatctcattacggatggttgtgagccaccatgtggttgctgggatttgaactcaggatgtttggaacagcagtcagtgctcttaaccactgagccatctctccagccccaacacagccttattttttgcttttaggttttctttgaaagtatgcatgggggtaggtaaaggcacgcatgtgtgttggatcctcttagaggatgtaactcctgaggttataggcagatgtggacctccagatgtaggtgctacaaactgaacctaggtcctttggaagagtggccagtgcttttaaccactgagctatcatctctccagccctaggacttgtattttaagtgcataggctaaacatctggtagatgaaatcagcagatttttcctagcagtagccacaggaaagctgagctcttttagcagcgggagaatgagtgtcctctctggcttgcgggaggtcagggacccacagtcttgtttctcctagctctggagacttattcggggcacaggcctacatagctgcagtgtactgagcttccttgactgtgaacagggttttctgtgtagtcaatcctctctccgtgactgtgactttcagcaaggggaaggaagctagagagggagacgtttttgttgctttgggtttttttgttgttgttgttgttgtttttttttttgttttgttttgttttgttttttgtgataagggtcttctgtgtaaacttgactggatcagaactcgttatgtagagcaagctggccttgaactcaaaagatccacctgtctctctctgccttccaagtgtgtcgattaaaggtgtgggccaccatgttccgattaagagaaaggtatttgaaaatttcctgggggcacagctctgtaactttcatggttagatttctgatcttttccaactcctattgatgtaaaaataaaaacaaaaccaaacaaacaaacaaactagaaaaagggcctcaataatcccgctgcatctgcctcccgagtgctgggggcacaggcttgctgctcccttcatttcccctcctgagtctgtgatatgtgcgtggtcattcctccttttgcagtcttaaacctcatttagccaaattaataccaggaaccccactccaatgaacttttcaagtttcagaattttcaaaaggtgatccagtggggctggaggaggaaattcttcttctaccacttgaccaggtggaagaacttcataactggctcctactgacagcagctcagctataaaggacctggcctgttaactacaaaggatcccactgaccatgcatatagaaagtctatacacacacggcgtgtttgctcattttgttcgtatttcttaaagaatggctctaccctagcccttccctggtagagtctgtttggaagccatgcagtatggctgctgtgtgtacacatgtgcagaaaggcaggggtgcaagtttgtacacagaagctccaaagctctggagtgtcgaatcttttcctctccctaggagagggttaagtgttagaaagagaattaattgcccagaacatattttgattttgttcctgcaagctgtgtgcacatcctccatccagctgctttcttggtttctgagtgagccttactgtaggaaagagctcttggctgtggcttagggattggtgtgtgtgtgtgtgtgtgtgtgtgtgtgtgtgtgtgtgtgtgcgcgtgtgtgtgtgtgcgcgtgcgcacgcgtgcatgggtgcacatgtgtggtggcggtggcaggaagggggttcaggcagagccgtgctcctgctgaagtgctcactcacagctgtatttgatccctttgagggaaagtacaggactggtgttcctcagcaggaagggagtctgctgcccccttttgatgggtaagtgctgtcagagggaggtggaggctgactggacaggggctcttaggacagtggaccatggcatagtacccttaatatcagtgctaggtctaccctgtgcccaaatgaggttagcactgcatgggtgtgttagggctgcagagtagggaaatgcccttgcctaagctttcaaaatctgggtgagcatagggagagatgcagtgggagaagttagggaacccaattaggggtgtgtggacttggcagagccaagaggattggctttgaactttactccccgcactgcctcagccaggcctggtgaaagcagcaacctctggggagtcatgttgctggtcctaacctatacatggctgccccttttggacttcagcacatgtaaggagtgtggtgtgtgtatgtgtgtgagagagagagagagagagagagagagagagtgtgtgtgtgtgtgtaagagaaagcgagtatgtatgagtgtatgtgtgtgagtgtagtgtatgtgtatttgtgtgtgggagtatgtgtgagtgtatgtgtgtgtgtgtgtgtatgtgagactgtgtgtgagtgtgtgtggtgtgtgagtgtatgtgtgtgatgtgtatgtatgtgtgtgagtgtgtgagtgtgtgtgtgtgtgtgtggtatgtgtgatgtgtgtgtatgagtgtgtgaggtatgtaagtgtgtgtatgagtgtgtgtggtgtgtgagtgtgtgtgtatgtatgtgagagtgtatgtgagtgtgtgtggtgggtgagtaagtgtggtgtgtgtgagtgtatgtggtgtgtttgtatgtgtgtggtatgtgaatgtgtgagtgtgtgtgtgagtgtgtgtgtgtgtgtgtgtgtgtgtgtggtgggtgagtgaatgtggtatgtgtgagtgtatgtgtgtgagtgtggtgggtgagtgtgtgtggtatgtttgtatgtgtgtggtatgtgagtgtgtgtggtgtgtttgtatgtgcgtggtatgtgagtgtgtgagtgtgtgtgagtgtgtgtggtgtgtgagtgtatatgtgtgtgtggtatgtgagtgtatggtatgtgtgatgtgtgtgcgtgtgtgtatgagtgtgtgtgtgtggtttgtgagtgtgtgtatgtgtgtgtgtggtgtgtgagtgtatgggtggtgtgtgtgtggtatgtgtgaatgtatgtgtgtgagtgtgtggtgtatgagtgtgtgtgtggtgtgtatgtggtgtgtgagtgtctcccccatgagtgtgtgtgtggtgtgtatgtggtgtgtgagtgtgtgtgtgtgtgtgtgtggtgtgtgtggtatgtgagtgtgtgtggtgtgtgagtgtgccgcagcacacatggaggtcagagaacaacttgggagctgttgctttttcttctaccatgtaggtttactgggcttgctggcccctaagtcttatttcttacttgtcactgactgtccctcgaaggcctgtgatcaccatcctagggtgctcacaacagtcctgggagagaggaacatttgcttcagccacacagccccaaagaacattatctttccctccaactctaagcaccttacttctaaggactgatggggacgcagccttactttttcctcctaggagaccagtgtgactgtactattacataggatgcgggcagcccatcatgtcatagggttaggatgaattagaaacccttggagaatgtattcacttttcttcaatgtttcaacggcagggctaattattttttcaaacaatagctgtttcctgaaacccatttccctagattttactaatctattatatcctggccagtcaggcttcagaacactgtgactaaagctggactctgggtaggtgggatgggaaatgggtaggtagatgggaaaggccaatgtgaggtgcttatgagagtttctacactcattcagcactcggcttgcaagtatgtacacatgcttacatacatacacacaaacatgtatgcacaaacacgtgaagtacacacacacacacacagtagtcactgaggaatgttcacgtggattcatgagccctttcaactagggcaggacactgctggggtactggctttctttcggcattgagagagggctgagctctgctagctgacaatggtctttcatgtaacctgcgggctcacaggaaggaaggaagggattaaaaagccatttcccagcccctactaggaatggccttttacagaccaggcctgaccccagggattcccagtccctcttggtgaggagacttagggaacctgagagggagtgagcgcctctagcccctggccggacagctgggcctccaaccatggctttattagcatttgaaaaacggctctgaagggccagagcttcctggggcagctctgggcctagcgctgagacctgtggtggcttcccacagaatagggccaagagtgcagggcataaagaccaggctggagtcaagaatgagtcctttgtggctttgtccttagcttgaacactgtgaccaaaacctctttcattgttaagaaagactgggttttggccactacaggccatactgttctctggaaagttctgttagtgtgtcctgctctctaaacattgattgcagagtggggcttgctgttgtcttctcttaattcagcaatgctttctgcagtcttggccacacacttgctcagaggagggtgtgtctagactctgactctagagcagcagcaacctgagactctgctgggtctctacttcctaactaaggctgaacacagtgctatgtgatcaagatgtttaagcagtctgggtttgcaaccacttgtttttaaatcggagtcagcaatagttgatgaaagccctagctttaaacttttccaacctggtccagtctaaagccttgccaggtctgtagtggttcctacagctaagacagctgagccctgggacaagcctgtagggtccagccatctgtttcgtaaatcaggagcaacggtgccacctactggactcttcctattactacaggctcagtgactgccccgttttctggcaagtacacattgactgatggggagtatctgtggtatttcagcacgtggcagtggaatactgtgcagaccaggaacccagcttagtggtcgctggggattgaactcagaacctctggaagagcagtcagtgctcttaatcactgaaccatctcctcagccctttgtttgtttgtttaaatacatttgttggggtgggaatgtttggtagaatccatgcctaatgtgtatgccctgtgctccatccccagcactgaagaaaaagtagattgtagtaaaattagatttgtttaggggctgaagagcaggcttagccgttataagcacttgctgcgcttgcagaagttcgctgtgtggtttccagcaccaatatggcgcttacaactataaccccagttccgaggatctaggcatcctcttctgtccttctagggcactgaatacatgtggcacaaatacagtcatgcaaacaaaaagtcagatcaaacattgaaacttttttaaagcttgtttgagtaaaaagtgtgtcatgggaaaaaatagatgatattgatacgtgacacagattaggcagagttcttggtggcactggcgagtgtggggacgtgtccattctcactgatgtgccacatgattggcagtctcgagcaccctttctgcaagtgtgggtaataaaatgctgtcccagcaggatgagctgtttccatggctgcctgctgagccagggagagtaaggcaagcgtgctgcctctacttccccctcatcatcccctcctcttctacctcctcctcttcctctctctcctcctcctcttcctcctctttttcacaatagcttttgatgacttgcataatatataattcatagttggaaaccattacttcagtgaacccagaatgttttcaagatctcccaaagaaacacacatgcagaccttttccatctcctccagctggtccaagtactctgtagcagtagaattagataagaaatacgtgatcttctgtgactagctcttctcatgtagtgtaatagtgtgagtgtgtgtgtgtgagagagagagagagcgcactcatgtgcacacgtgtgtacatgtgccacagtacacacggggattggagagccccttcaggaatcagatcttctaccgtgtgggtcctgaggatcaaactcaggtcctcacgctgtccagcatgggtgctggaccctgaacctgggtttccacaggagcgacatgcatgctcttaaccactgcaccgtctctcatgcctgctcttggtgttggacactgggtctgtcactcatgctagccagcaagcactaggactcctgctctttccgtctctcagggctgagattacaggcactcactgccacacccacctctttccctggattctgagtggttgaacttgtcttcatatttacatagcagtttgagcatctccccagcccaggctgtccacagtctcactgctccgggttttctgtcttttaaactctcaaccactttactgcatacagagcagtgttatctccgtgtggctttgactttaatttcccttttaaatatattgagccgctttttatgagctaattggctgttcgtatcttctttgaagaaacatttattcggatattttgcccgattttaattggattgtttatctcttattaagttgtaagagctctttatatattctgggcacaatatacttatattttatgagggcttatcaggtttttggcttgacaccatctttccattctgtaggttgtctttttaaaaattgtatctgaatataactaacatgacaattctcatctttgagcacagtgtgcacagccatccccaccgttcatcttgggtactttgctcactactacacggaactttacaccacaaacaattgtcaccagcctcagtgtgtaacatgactacacagggtgcttcctcacatgagtgggaccatgaatcacttgtctgtggtttcacttaatatgttttcaaggttcatccatatggtagcacaggttagaacgttcatctttttaaggctaaatagtatttcatttaatgtaaattacacatattgttagtccattagcttattggtgggcatttggatggcttccacttttttgctacagtgagcattagcacacaatctgttcaggccactgctttagttctttcagtacgtaccccaaattggaattgctggatcatgtggtaattctgggttttttaggttttgaggacctgctatactgtttccatagcagctgtaccatttgacatcgccaccagcagggtacaagggctctaatttctccacatcaggcaccaatacttgtcatttctggatttgtttttgttattgtttacaattaccattctaatagatgtaaagtgggcgtgatttgatttgcatttctttttctttcctgatggcgatggctacagcacaaaatggctttaattttgatgaagctcaatctgtctgtccactgttgtttgtgcctttggtgttacatccagggaaccagcgcctaatctgacacatctttgttttcttctaagtgttttgcagttttaactatcacagttaggtctatgatctattttgagtcaatttttgtttatggtataaggaagagttccaattcgagtcctttgaatttggatagcccgttgttccagcaccatttgctggaaagactcccccctcccctcctcttgagtgtcttggctccattgtcaagataaatggccatcagtgtgcagctttatttcagtgctcccaactgtgctttctgatccagtgcctcgcctgtgccagactctactcactttgatactgtagctttatagcttgaaaccaggctggcaaaaatgggctctctgtggagcactagcctcgtgcatgttgaggccctgagtctgattctcaatagtgcactggactgacaggcagcggcctggggaggccgagcccgtcacctctgttttctgtctcttgtcttgtttctgtgtttatcttcagttccaggagatgagcttagaaccttgttcatatttagaaaacatttgtcttgctcttgatggaagaaggaaatgagtctttggtttaccgttgagcataatatctatcagctgcaggtttttagagtcctctcccagaatgagaagcgcccatctaggccaagtttcagtggtttgttttggtttggttttgtctgcgttgaattttgtgacatgtttttccaagtctcagagacactagtgttgtgttgttttgttctgttctgtcttttcatctttattcctacagataggatctcatgtaagccaagcttcctgtaaactatgtgaccctgattctctcttttctttcaatttttattattgcatatgtaatatgatacctgcgtgtgcgtgcgtttgggggaggcatgctgattatagacatggcaggaaaaggagagaggtggggctcaggattattgcaagtgtaatatgatatctgcatgtgtatgcgtgggggggcatgctggttatagacatggcagtgaagagggggagattcaggagtgtgtaagcaggagtatgtaagcaggagtccaggaacttaaggctttctcaggagctccgccctctcctccctgtcactcctctggtcccctggaggagcattctccctcccctcctgaatgaacactgtggaagtgttggcaactccccgagcctgcatctgcctgggaaagatggttgggtaatgttaggtgacacaggaaggaattagagttcagagcaagacaagacagtcaaggcaagtgagggcagaaacttctgggcttgggctgctgtgtgcacgcgtgcctggcatgtgtgacgtgttctgccttgacataggccacagaccttcagcaaaggaggctctgtgcaagcaggtgtgaatgagctctaagatgtggaactgggtgaaatgtgagcattcgggtccttgcatgtgttcaaggaaaagaaacggaggggagctggggatggagctcgctcagctagcttgcccagtgccctgcgctgtgtctccagcatcacaggaaactgggcgtggtcggggctagagaaatagctcagtggttaaaagcactgtctgctcgtccagaggacccagattggattcccagcacccacatcgcagctcacaaatgtctaaaagttcatatccagaggacctggtacctcttctgatatcctcaggacccaaacacctaagtagaacacaaacaaacatgcagtcaaaacagtcatacacattttaaaaaggaatccacaactgggtatggtgacacatgtctgtagcctcaacacttggagatgaaagtaggaggttcagagtttgaggtcatcctcggctgcatagggaattgggggccagcctgggcacctgtggttgcatgtgaactggttaaagccacgcgtgctgagtgttcatgacaagagacaggtttgggggtgacttataccacatgggaatgttccctaagggtttgctgccatagacatgttctgtttgggtttttgttgttggcaggtagcccaggctagcctcaactcagttgtcctcttgccttccctcttgatgctgggattacacgcatgtgctcctcctacttctggtactttatttttaagtaacgggcctttgtgttactgtgctgtcacagaggcacccccccccactccccacccctgaggctgtacagtctgctgaggtgggcaaggaactatcctgacctccatttacctgaagtctccagagatcctcagaaatcctcagtctgcctgtgggagactggcagcggatctccagggctggggttgcatgtttcctttctgtgctgattcaccagcagagaaatcctgggttgtttttccaagaaggcttcccactgttcccagctcccttaccctctgatggtccgctggccccactggaaagcacctcattcttggcttcttgctcatgcccttcccccgtgggtagtggggctggagaagcccagcagacactgcaagtctttggccttcctaggccaagtgagtatgcacaccagcagcctaccctttccagtgaagtcaaacagattgggccatcctggaccatttggtgtttggggagtagctgtagttctttgcttgtattgggagtgggtgcatccggctgctctaggaggcctggggagtgaggagccttccaacctgggctttgaggtctcagggcagtctccaggcctggatccaaatgctgagggtcctcctgtctgtctctccacagagaacaccttctgtagcggggaccatgtgtcttggcacagccctttggataacagtgagtcaagaattcagcacatgctgctgacggaggacccacagatgcagcctgtgcggacaccctttggggtagtgactttcctccaggtgaggtgccatcagaggtctcagacagtttatccttgtgggaaaagtccagaacagaggggaacgtggagggggagaataaagggcaggagactccccttggtcttcttttccctgtggtgggctatctgatttcacactgcagggccagaggcaggacagacttcccagctgaaagccagctccaggcttaagtcctatttccccagtgggcgactctccccagctgcagctcatgcttgcagttctaacgaggtcaaggtgaagaaggttaagctggtgtcctcaagatttacacaaaagtgtcgctattgtgggaacagctacctgaccacccctggccttagggacgacttcccctgacttaaggcataatctgcctgttgtttcttctgtagccaagagctaggtaggctctgtgcctgtctgtgcactcaggaaccccttagctaggcaagcacctcctaagggagccattacattttggggacaccagccttgaaacagaccctacctatgtgtcccctacttaagacacccctgaaaaagcacagatagttggagggatggacattaaaccacagtggcttcttatcctgggccacagattgttggtgtctgcactgaggagttacattcagcccaacagtggaacgggcagggcatcctggaactactacggacagtgcccatgtgagtacatgtccccataaggtggaggcctggaccctgggtcttcagggtggctgtcctccctccatcccacctgtagagttcttgctttgctgtttggggcactcagttctctgtggtccccgaccactaacatttccctttatgatctgggcctgggacagcaaaggctatgtctgccgatcaatgcaggcccccagttaccaccgtctctccttgtccacagtgctggcggtccctggctgataactgacatgcggcggggagaaaccatatttgagatcgatccgcacctgcaagtatgtcttgagtgaggaaaaccttgctagcacactcttccaaataccactggctttcatcctgacagagcggaggagctctgtgtgtgagccagtaggataaggcatggtctgtcgcctgaattctacagctcacataggaaaacagagatttcagcccagaaaagcaagcctgacacatatatgtgtgcatttaaaaagaatggactttattatatgtaagttacatatcaacttaaagttagatcaccaccaacaaagaaaggtaatcataaggaatattgcttctttccctactcctccattttaccacattttcagggagctgccctcccctgtatcagacagcagcacaggctatgctgaccccacagcccattgcaggatgctgattggtctaatgatcctgtcattcttcctaactcactccccagccctgcccaggtaggttggcactctctgatgtgtggaagagtcgttagaccctgccagtctgcagctgacactactgtgactgcttgggacagtgtcagtgtcactttgtggtttagaatagatggttgcttggcacacagctgcattctggaagccccggagcattgctgcatttcttgcacaccatgcaggggtagaagcaccagagcccagctccttctgctcacctcgcagcagaggcaggccatggacatctctgaacttgacatgtttctgtaaggctcccatgggcctgtaaggcaggccatggcagcgactaggcacttcaaattgtacagtggcgtgtagtttgcagacctatggggtctttgctaccaacctgtgagttctggggcacacagcctcttcctttacacatgaggctcctccactttctgggtacctttaaccctgaaatggtctcgatgatgccaggggtatctctgcttcgaacctgctttctgtgtggcttctgcttatgtaagaaccatggaggcttcatcccctaagccttgttctgcagccatgctgggacacagcatggggctctgtaggctcttgtttatctcctatactcagaaaaaaacttggtcccctgaattagtagagcaagcagacccttcccctgagggtctcagggcagctgctggcaagaaaactcaggttctccccaagcagctccagcccctctcctctgctctgccggaaacagctagagctgtgtcctgcctgctgcctgcctgcctcatccaggcagcaaaagcagcagaagagagaagaacgggtggcttatggataggagaccatctgtgaccaaggcatagaacaatgcccttgtctaggagccctggagagggacagactggcacagggacatgggggctctgaggagtttttcacaggaggcttatttggcctgtatggctgtttatggacaaggttgctagcgtcttccagatgacctttgagccaaagcccagcaccacagaattaagttttaccagaaaatccagcgatgttttgagtacaactcttccttgaggccatttggagaaagtttagactgaagcgtgccaatgtctacacaaaggcaaggcctctggggaagtgtgcacccgtcactgcccttcagaccccgattgcagcctaggaaatggaaacgaaccccatccagagccctctgccaaagttagctggcatagaggcacagggagcacttctgctctggggcgatggccccctctagctgttataatgaagaactgcaggtatgggttcccaagtcagggcgggcttctaccctaactcctgtagggggtgaggtggggtatgtatgatcattgttggaggatcaggaagaggggaagccttccacctttccttagagaaataggtcttgtctcctccatcagctctgagggccacagctgtcggggctgaaagatgcacaaaggcctttgtgctggatgttggtgggaaggaagtgtccaaggctcattcctgctgcctcccctaaccctgttcccagaggagtccaggggctggcaggggccgttatgcttgtaacagaacaaggtcaatgagaccctgatctcatagcagctgtccatgctcagcacctacaagggctaatactggaagtggagtggctgggccagggtcagtaaccttggggcacatgagttcactgaaggcactctgactctttggttcttttcaagcaggagagagttgacaaaggcattgagacagacggttctaacctgagcggcgtcagtgccaagtgtgcctgggatgacctcagccggcctccggaggatgaagaggatagccggagcatctgcctcggcacacagcctcggaggctgtctggcaaaggttgagaccttcccttgccttgctcccttccttccaggttccccaggacaagtctctaactaaatagcagcccactctgattattttctgacaaatgaatttttccaatgtgggtgaactatatatgagcattattggcctgtttgtagctatttcctgtgtgcatttcaaacacactagtatactctgtgtgtacactctgccccttggaatctgacctcatgtatgtgagtatgaaccatggaatagttaacagaaaatgtacacagtccacccaaagacactacagcgtatgttcaccaccacagaactgacacagaccccagctctggcctgaaggccatgccaagcctgagaacctctctccttgaaccttcctgggcttttaatgagagggagcgagtgtgaagcccgacactggcctcctctgcagtcccagagtctgtggcaagttagctccctctgcctctgccttctgggtaagctctcggaggaggaggaggatgtggcgtcctgttggatgctcccatgctgctcttggctccagaaggacttgtggggttttttttgttttgtttagttttgttttgctaaggctgtccctggctaatgccaaaggaaaagtggccatttatatacatgtatgtttaaggctttctgtctccttcctttctcagttcttctttttcatttatcaaagaataaaatgcctttggccttgaataaaatacctgacttggtttactttggagacagggtctcatgtagcctaggctgacctctaactttctgtgaagctaaggatgaccttgaattcctgagctgcctcctcctcctcctccgcaacttcaacttctagtgcaaacatctgagcccttttcttttcctgtgtcaggggctcacgtccagttgcttctgacagaggaatgccgtagagaggctggcagtcatgtctatagctgcagtcatcgctgctcttttacttcttgtttacctcgcagacaggctctcttgctctctgcagcgtaagctggcttctcatttcctgcctcacacgctcatgtgctgggattacacacatgtaccaccatgcccagcattgtttgttttttaattattgtaaaatgattcactgtacagtaccaagtcacaccgcaaagttgctggtcgtgccttctccactagtactgccggcccatccatctctccttttctcctttcttcctttattgtgtgtagcccacccaagctgatctcaagcttgttgaactcgtatttcagccgccactgctgagtgagtgctgggcctgctgacgtgtgaccatgccctgcctctcaccagtgctgccaccactgttctaggctctctcaggctgggagcccagagggccttccggcaactttgtgatttcattgcagacacagagcagatccgggagaccctgaggcggggactggagattaacagcaaacctgtccttccaccaatcaattctcagcgacagaacggcctcacccacgacagggctccgtaagtgtctgtgttctggggctaggacaaaaggacggtgtttttctcgaggggccatccctgaggattgcatgaggggaagagtgtacatggttcttgttgaatggaccccgagtctgtaggtttaaaggcagccctgatccaggcagggcacacggatctgtggactgtagcaaaggacctcaaaggggactctgcagaccatgagtacaaacagcagtaaatatttacatgggctgtgtgaacagaagagagtccaggttgggacagaaatctgactgagggcctgtgagccttgtgggagcccattgtgctaagccagtcccctccttatctcactctgggtcagagttgcccttccttccttcctggagcctgggctctggctgatagctacaaccccagggacctccttgtctggctagccctgagttgcatgcctgctgctgaggcccttcttcctgcctgcctttcctggggcccagagaggggaaggcaagtcctttgcaggcctctgctgcctgtctaagggtcctgtagtccttaggagaaaccagccaaccccggaggtcagacctgtcctcctcccacctcctcctttgttagaagggaagtggtgggctgggaactcccttcttgcacagtataatggcctagggtgctggccactcagagctgggacctcgcctgcctgggtggaaattgctcgggctagggtggaaaaggagttggactaatcctacaagactagggtgatccacctaccctctacgaagtctgtgtggcaacctcaagccctggggccatttgggatgcacagggccttcctttgggggaaacaataaaccagtcatggtatgtgcaatctgactgcatatacagtttgttgaaaaatgaccatgggtttggaatcaggctgcggttgctgattcatgatcctggaaagatcagtgatgcagcgcacgatggcaaacacagtatgtggaataggcagcatgtgtggagagagaggacccggactgtgtggcgaggcctgcagctagcgtgggaagctgctacagggacttgggagcagaggcctggctggtcagcattgaggatgcgccctgggagctgcttagggtacccacagggttactctgggcttgcttccggccactgttgtttgcctggtgtacctgccatccagaggcaggaaaacctgagctctctaacagcgtggggaggcctccagtgctacccagcgcctttagctgcagccaatgactttcttaagttgcttggattttgctctggcagtagcagatagccaagctgtgtcatggggcatctggaagctttccacctgcagcctggaccctgacccagagctgtgctcctccctaggccccaagtatgaattcttataccgacttccttggcactggtggtaggccagtaatgggcttgtagcctccagtagttctcatggaatgtggagccagtcaccttccaaatggccctcccacctctcaaagaaggccagggcttctgacagagagctttcggggagccccttgttggccttctttgacctgagacatgcctgatatctcattctctgtcttgtttatgtgtctgactattgtgtccctagacactgcatggggcacaggctggactctcagttcctgtagacaccacaactgggcagtaaggaagtggtgggctgggcacttggcagaagactgtcccctttgtccccactctttgctctgcattggctggtataaagacatgagtgagaataggtctggagtcatctgctctccctgcagctcaaggtccccaaggagctgaaatctgacatccggaggggtgacaatgtctccctctgaggttcttggtcctgtttgccaacttaacaagcagctgagcagtggtttctcctcctcactccccggctaggaccaccccagcgtgctctcagagctcccagagtctcgctctctgttgtctccaactcaacaacggtcagctcagttgagattagcaagcaccattgtaatatctgtgctgcccaccctgggacctgacctcgtttcagacacaccataaagatggtgacagagaaagccagtcccaaatgtgctggcaccgctgtttgcccttctccccctgggaagctgccgtcacagcatgggccctatttggtctgcctggccagttttcctttcgtcaggactttgggctaggcagtctgatgcataggtctttgtgggtctggatctgacctaaggtctcagagatggattggtttagaacagctgatctggctgagcatcagccgctgggtcctggcctacttggggaattggctacttgctaatttcatatatccatagcagccaaaagtttataccagtattaatttaattcatcctcgaagccactgtaagaagtagatgctattatgtattttcctttttacagaagaaaaaggtgaggccagggagctgataagtagcttagggcacactcaacaagtgtggtcctccttgccctgtgctcagggaccgtgaggtgaggaccatgcgggctgtgcctctgagataataatgatctcaccagaggaactcaggtaactaactggttgtagcatgaatagggacaagctctcacatggcaccgaggacaagctaggtccatgttagcagattgccaggcttatttcactgtaagaaagacctctcattagccccgatgattctagaaataatgagctgtgtcataactggctcatttatagaattacttttagacacaggcctcattttcttcttcagaaacaaaccctatctctggctcatctcccacctcaggaccaggggatttctttctttccggagccctatttcctgcttcccagaaaggcagcccctctggtaacctgttctgctcgatccactgttgccagccttcttcccactgccttcctggaaggcaagtcctgggccctctttggggcgtcttcagcatttcacaacccttgcattccagccatgaaatttgtatctgccttttcccaagatgatcagttgagaaaagcctccttcggcttgctggcgcctcccttcccactgcctgctcgggtgagtttgggaagcagccctttgtgccacatgaggacagcctggtccagagctgttcctgccaacacttgttgggatccagggtgggagtcatgggacatcctgtctgtctgaggtccctggtcagccagaggctgatattagctttcctgcctctccatgggcatggtgacaggcgagcctgtgtggtcaggtgtgtgcaggggaaggtctgtttctgtaagctgctcctctagcatcctgtccctgtcctcacttagccagtgactcactgaagaggagagttccataagcaactctgggtcttacatcttcccaaagaggggcaggcatcatgtgtgtgtacatgtgcgttagagagaaggctcttgaggagtcagaaggcctttcaaaagcaagcaagcttagtatcactgcttagccaggcctcttatttgtctaaaatagcacccgaagtgtgtcaggatgctccccccaccccttaatttcctgaagaatgaattctcctgttgtgatattacctctgtaagatttccacataacacacacacacactcactcgtccctccctcccttccttctttctatttattatttatttatttattcttacttatttatttctgtttaagatggaagtcttactctgtagcccagactggtcgggaacttacaggtagccaatagcacaggctggcctaaactcagggccgtgctccttccttggccttccgaatagtggggttgcaggtaagagccacacacacagacctgctcctctctttacctctgtgcaggcctctgcccccgtctttggatggggtgactttgctgcccctcactcccatctcatcctggccggccggccggggagttgttctttagctgtttgttttgttcagcctatggtgtccatgaagtgtaattagaagaagctctctggtttcatccactctgccagtgggtttgggtgaaggaggtgagtttccccctaggaaggcagctggttgctgtggtgccactttgtacgtaggacagattaggatgtgaccccgctgtcggtcggggttatgtgttagggcagcagacagcctggagcctctctgtcacggtggcttcactcgcagttctgatactggcacagtacagtcgcttgctctggaaagcccagagagaaccctgcttcagggctacagtggagaggccagggcctcgtctccactgctcctggaacacgggctttgttttggctccttcactgtgaacctagctgtcgtgctaaaggtctgtatggccgtgctcagagccacgtctgaaaggacaaagctgacgtggctcaacatatgttttgactctggtctttgcgccacttctgcaaagagaccaagcagtggccatcgttcaaggttcctggctggcgctttgagtctaggtgcaaacactgcatccccttcaccacgttgcacaatcgggaatatttttatcatctatccttgatcttcggtgtcacccaacacttcagcagtgagtcatttctgcagggaagggaaagggaaggttcaaaggtgacagctgaagaaaggaaatgactcagtgtctcagagaaaggaaagcttggggcagagtgggctctcacccgagactacaggggtcctggccttacccccaagccagaggagccaggtgagatggagtggccagaggatcttccgaagctcagcacctctgttacgatcttgttccgcctgcctttgtcctttcagcttcgtgtggtgtgtgtgtatgtgtgtgtgtgtgtgtgtgtgtgtgtgtgtgtgtgtgtgtgtgtgtacgtgtgggtgcacgtgtgtgcatgtgtgatgtttgtgtgaagcaacattgcccctcatcagtactgtcagtgagacacggccctgtgcttccctctccctcacaccctttcccaggcctgacctgaggagaggcctacaagtggctctttctctggaaagttcagagcttctgtcagcaatcagaaagcaatgggaataatctcccaggcaaaaagccaaagccagaggtggcactggggctttgccaggccactgtacttcacttctgatttgtcaccaagcccagtgtcctgcttccaggtgtccccaaggagaaggtctcaagtcatgtggccagtgtagacgtcatgagtatcacaggatgaggactgtggctagcaggaatttcagctgcttggttcttcctcccacccctgttgccatggatagaggcagagagcgctgcttcagtgagtgtggagaagtaagacctttccagaggggagagaactatagattaggttctgccagtctgctgtgaaggcagggtgactggagcatgtgccatacaccacctaggactgcaaatcaggaggcttgtctttccactggaaggtgtgctaggctatgtggaaagtcaccttatacagtgagaagggtaaatatagatcgtgttatacagacggtggtaacaacaaagaggaggattaggtccacttctgaattgtcatggtagtcactccttgatcttttggcaaagatcaagtataaccattctacatacctgccctctgtgctctgaacacaggcaggaccctaggctggagagttcttgaggctgagtaggtattatatatcacctatggggcaggggattgctgtttccccccacttcacgcagtagagtgccgttgccccgattctattagtatagagtcaagccagggcatggtagtacaagcctactaatccccagaacgtgagagcagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcatcggcagagagatctctgagttcagtgctagcctggtatatatgataagtgtgtacacacaggtcatggggctacgtagagaagccctgtctcaaagaaacaataaagagccgggaggaggtagcacactactttgattccagcactcaggaggcagagacaggcagatctttgatttctaggtagcctacagagcaagttctaagacagccaagccttgtctcgaaaaaacaaagacctgatgatgatgatggtgatgatggtggtgatggtgatgatggtggtggtggtggtggtggtgatggtgatgatggtggtggtgatggtggtgatggtgatgatggtgatcagtaggcagaggcatttgctcctgagcctgacacctgagttggacccctgagatccacaaggagatgaattggctcctacaagttgtcctctgaccatcatacatgttatggtatgtgtgtacttatgcatatataatatacatacagataagtacatgcggaggactgtagaaacgtctcagtgaagaacctaggtttgtttcccagcctcccacagcggctcacaaccctctggaactccagttctaggggacctgtgctaccttctggtctctgctggcaccaggcatgcacatggctcacagacagacctgcagacaagacacctgaccatgtaaacaaacacacaaacaaacacatgtgacaaactatttttggtggtgtttttgttgttgttattgttgtttgttttggggagaatgcttgtttggttagttggctttttcaagacagtttctttgtgtagccttagcatcctggactttgtgctgtagaccaggctggcctggaactcatagagatccgcctgcctctgcctcccaagtgctgggattaaaagtgtgcaccaccacccagcacaacaaaagtattttaaagaattagaaaattgggggctggtgagatggctcagtgggtaagagcacccgactgcttttccaaaggtccagagttcaaatcccagcaaccacatggtggctcacaaccatctgtaatgagatccgactccctcttctggagtgtctgaagacagctacagtgtacttacatataataataaataaatcttaaaaaaaaagagagagagaaaattgggctggagaggtgcctcagtggctgcccttccagaggacctgggttcaggtcccagcacccacatggcagctcacagctgtctgtaagtcctgttccaagggatctgacgccctcagacagacgtcaggatggagtcgaaacaccaatgtacattaaaaaaattttttaagttagaaaatttaaaaagaaaaagataaaaataattgtaaagagtaaaacagaaaaggtgaggaaaaagcccagaaagtgagaagacgctgaccaaaagcaagggctttagtagggtttgtttcatcttacactgccctgtctgtggccgaggggactctaggcaggaactcaaagcaggagcccagtcggaggatctgagtagaggccgtgggggaatgctgctcatgggctttctctgaggctgcatccttatacaacctgggaccttcagtgtgggagagacatagcctgcagtggggctggaccctcccacatccacatcaatcattaatcaagaaaaactgtcccacaggcttgcctgcaggcaggtctgctggggacattttctaagcagagattacagcctcttcccaggtaactctagcttgtgtcagattgacaaaaacaaaacaaacccagccagcacagtctccaccatgaggaggcaggggaggcaggagcaagtgtgagcctgatgctagatgtactgcaagaagaaaggcacacagtaagtaagagagcagaggtcaaggccagcctgctctacagacagccagggatacacagagagcctgtcttgagaaacgaaagaaagaaagaaagaaagaaagaaagaaagaaagaaagaaagaaagaaagaaagaaagaaagaaaaagaagggaaaagaaaagcaagcaagcaagcaatgaagttggaggtatggcccagctggaggaatagtacctgaccagtacgcataagccctaggccccatctccagcgtcacaaagataatcatttaagaaaatgaggacctgtgagaaaggagcctggtctcctctctccagtcctctgttttctagcttctgattgggggtgttctttaagtacacgtcatggtctagaggtgagaaggagcgatgtagttggtcatatgaagagttactgtggccacacaaaggtgccagggaaggagagccggggatgaaagagagctcggtgcccagctgccatagtggaagccatacacagatcctgggtgtgctgccattggggctggagagacagctgcctgcttaagagaactgaactgcctgctcttcctaaaccccacctacatggtgcctctcagcagactgtaactccaggcccaggggaatacgatgcctcttctggcctccacagatattgcacacacatggtataacatacatacatacatacaaacatacatacattcaggcaaatccttatcacataaaatgtcaaaaaatttgctggaccatggtggtgtacatctttaattccagaactctggaggcagaatcaggcagatccgcagatctctgagtttgacaccagtctactgagcaagtttcaagacagccagggctacacaagaacctaaaaacctgtcttttttttttttttttttttttttttttgctttctataccactttattccaacctgaggaaccttttttatttaaaaaaaaaaggaaagaaagaagaaggaagaggaaaaaaaaaaaaacagagaaccctttaacttgttaggaagatgatcctatgaatttgaggccagcttggtcttcatagcaagctccaagccaaccagaattacatagtgagaccttgtctccctaccacttaaagtgtgtgtgtgtgtgtgtgtgtgtgtgtgtgagagagagagagagagagagagagagagagagagagagtgtgtgtgtgtgtgtgtgtgtgagagagagagagagtgagtgtgtgtgtgtgtgtgtgtgtgagagagagagagagagagtgtgtgtgtgtgtgtgtgtgagagagagagagagagagtgtgtgtgtgtgtgtgtgtgtgtgtgagagagagagagagagagagagtgagtgtgtgtgatctatgaaatggctcagctagtaaaactacttatttctaaccgcgacaacataagtttaatcccaggacatggtagaaggaaagaacttgacttctgcaaactgtcctctgactccatacatgggcacacgcagcaagcacacacatacaatcgatagatagatagatagatagatagatagatagatagatagatagatagatagatattctaattagaacagtatcagcaggacagggcgatggactagtcagtacagtacttgctgactgaatctaaggacctgggttcagatcctcatcacacaaataaaaagccaggcagagtccacatctggaactacagcactgggcagcaggagtaggtagatccctagagcacactgccttctattgtagccaaatctgtgagctccaggttcaaaagacccagtctcaaaagttaaagttctgtctctgggacccatgtggtggaaggaaggaaccaaactgttggaagttgtcttctgaccgccacagtatttcatgacccatatgcacatgtgtatatatgtatatataaataaacgtgtaaaacacgttttaaaaagttaggccagatctggtggagcacccctttaattacagtcctcaagaagcagaggcagcttctaatagtgcaaggccagcctgcatatagagcgagttccaggacagccaggactattcagggagaccctgacaaaaataaatagataaaattaaagtggaagtggctggagagatggctctgtgactaagaacacatactgctctttcagagggcctgtgttcagttctcagcagccatgtcagaagggtcgcaacccctatagctctagaggctccgtgcccttctctggcctcaggtgtttgcactcatgcacatattgtaaacagaataaatctttaaaaaaaaaaacaggcttcagcctcctgtaatctcagccccagggaggctctaatcaagggatccagccaacccctgtagctgaatcagcaagctctgacttttgagaccagtctcaaaaacaaggtgacaagtgactgagaaagactcccagctctgacctctggcctgcctgtatgcacacacaagacacatttctatcagggaatagccaggtgtggtcacacatgcctacgatcctggcactgggagggcgagagggtgaggcaggaggacaggtctggctttagggccagtgtaggttacagagtcaaggcagagagcagaagagctctccgtatttgctctggccgtacactggaactggaagacacagaagacacagaagaccagctaaccagatgacagtgttgtctcagaagggaacctggagtaccaggaactgtgctagtgagccttgtaggaccatttggctctaagctgtagcagaaacagcccgctggcacgtacctgtaacctcagcagctgcaacgggaagccaggagaggttaaccaagggaattatgagttgaaggccatctggggctatagtggtaacattcccatctcaaaacaaaacagaacaaaaccaaaagaaggaggaggaagaagaagggggaggaggaggaaggaaggaaggcaggcagactgttgtgtgagctgcctgcccttggaaagacttaggacgcatgacatattccaggtaaaaacaccgttgtatcctcaaaagagccccagaggaacttgagcttccctggtatctagatgagttgtgtggtggtgagcggagaactctctgatatgatagccagacctttgggagcatcctgtcagcagtgagggctcagtgtggatctcctcctaaccaccgagcagtgatggcgtaggctggcacggccttggaaggaagaggctgcactaggcagagctcagggcggggaaacccagagtcctttcagatgacacctggcctttgatccccagaggcatcctcagagcctcgggggatttgggtgttcagtgaaaatggagttcttaaccggttcaaatatgctagctgacagaaatgaaaccagttggttctcctctgtagtccttagtccaaaataccagcattctgtgaaccactgatctgagaagtggcttattaaatctagccttgccctgtctatttttctagaagcagctcttaaaattgtgagaagcacagtcttgtattccagggaggcagttcttgtaagagctcagggaagcctggagctagcctaagctgcatagggagttccaggccaagcttacacacacagttctaaagttggagaagatatgggagattgtgtatgtatgtagagtagtgtatgtgtgagaaagtgtgtgtgtgtgtgtgtgtgcgcgcgcgcgcgcgcgcacgtggaggctagaaatagacattgggaatctttgctgtttccctcactgaaccccatgcttagactggccagtaagctccaggaatcctcctgtctctgccatcctgcccagcactagagttatagtcacatgctgctcatgccagctttaaagatgcttttaaaagtgtatgtataactctgcatgagtacaggtacccacatgagagcaggagagcatccagtcccctggaactggagttagaggctgagaaaccaaccttctgcaggaacaataagtgcttttaaccaccgagccatctctccagccccatatggggcctaccccttagaagggtgcctggggacctgaactcaggtcagcacagcacatgaccagctaagccgtttccccatccctgtagtgggaggtgtttaaaatgtttcagcatcagaaagagctgaagtgttacatcagcttttatgtgcacattgtgtgtgcacttggggcttgttacttaaggtctctggctttccgtttcctcatctttaaggtgagggaaataactcctatttatagggttgttatgaaaatgaaaggaagtgatgtatatgaagagcttagcataggaggaagcaccattgcccacactcagtataaggtgtctctgcctcagggaggtggctctgggtaagtgttggctgtgcaatgagcccaggtacaagtggaaggagagaactgactccacagaggccttctgacctccacatgtgcaccaagacatccacactccacacaatagtagttttccaaaacaagtggtatctcagtattattgtgaacagttccctgaaaacccaaaggaagcatggtagctctagataccagtgtaggtatgtagagaatgaaacacacacttcaggtttttaaaaaagaatatggataatatctaaaggtgtattataccaccacagatataagtagcagggtcaagaagagctagaatttgctgggcataatggccaccgtgggggcagacacagatggctctctgagtttgaagagtgagtcctaggacagccagagctacagagagaaactctgtcctgaaagatcaagtgggggtggggtgggggtgcaataataaatacagctgaaattcaaggactggatcttgaaagcaagtgtgactggcataaaggacttggcttggagtgggaagacctagggcttactgtttggacagagttggctgagcagtgacaggaagcaccatgtactgtaactgtattctgtatccatcgaaaaccaaacgatgtcaacctaggaagacccacaccacacggggcagaagccctgcttcacatcactgtggccccagaacactggaagaattagcagaataaagtcatgatggtctcggggtaaaggaggtgagtgccagcagactggaggcgtgtagaagtccaggctggtaagagcaacttgcattttctggaccagtaagcttgttgtcctctcaggaaaactctggactggattattcagcaaggaaatttgaatgctattggaaaaacaaccccaagagacggagtcaggcttctaagcttacctgtctggtgagatgagaggcctgctgtggccttgcctaggtagcatccagcagacttcgtgggtatgctctggacgttgttacaagaaaatggagctgtccagagagtgtacagtagggtggtgggaaaggtggattcatttataattggttggatgagcatacctaaaaagcagtgttgtgagtctgtctgcccagcccaggtctgttctcagtttaatcaatgactggactgaaaatatgataggaagttgatggtttatgtcgatgatgtgaagtctggaaggaattcggagatgatggataccagtgaggttcagaatcgaccacactacctacagctctagccagataacagagaagtctgttcttactgtcacataatccacactggacactggacaggacaggagagggtagcttgtgggagaaaacctgagtaagatttcacttggcagagtgctgtatgagctggtagtaagatgaggttacaaagaaagacaatttgatgacaattttaatagaaataaactgcctcagacaagagtggtcacagcctctgagatccgcacggcttagaggacatactgtgtttatttccacacatgccactcacttctgggcacgacactctaactttgacgagttcaaatgaatccaggggagggtggcttgaacggatggaggatttcagaaccttgtcaagaatgtagttgaaagttggggccacgtagccaagaaaaagatgcaaaagcagccttagggatgccagaggctgccagggagagattggttcacccaccgagctgcttaaaaggccactggatggagatatacagggaggcagaggacagggtgatttggccactctctccctcagggaagcaaaagccttgaggggttttctttgcctttaatctggtcttcccagcatttaatcctggtctaccttttaaaaccttcgctcagcagggaattgacctggccagaggcagctgaatcctgggtccaggataagtgcagacaaggtcctttcagagctgtcaccagtctttcaggcgggtccaagaagccctgcagctgcccatgcactgtaagatgcctcatcagacacttcttgttttaaatatgatgctaaccctacaattacttatttctatctagggatattgcagctcaaagaaatggttaagcccgataaagcaagtgatggatactacacacctggaatccagaactccaaaaactgagtcaggaggagagctagctgtatgtgttcaagaccagcctgggagtacaaggagtaggatgctggcatgcaacagataatagcacttgccacagagcctgatgcctgagtttaacccctgggctccacatggtaggagagtgataggttgtttctgccgctggtgaagtaagccagttcaagccagattagagtagattagattagattagattagattaaaggcaggtttattgggaagctgctcttgggcaagttcgatggccccaaagattgaggccaggggattcgcatggggagagaggaggatagagggaagagaaagagaaagggtgcattcacagagagatgagaaggagaagagagagcccaaaatatctggattctaaagggaagagtctctgggggaaggttcagggttgggagcaggctttgccaggtagggactgagggatgctgggagaacctgaaggccaggtctgctttagtaagtaaaacttggtcccttgtctgaagtctgaaaccatacggagagaaggaacccctatgcattgccccctgacctctgcacactggcatatctgtgcacatgtgcatacacatagtagataaataaataacataaaattaaaaagaagaaacgaccagcctgggctacatggcaaagctttgtctcaaaaaaaaaaaaaaaaaaaagagagagagagagagagagaaaaaggtcatttgccaaggtcacctagaatgtgagcctgcgatgtgcctcctagagcacactcgtgatcccatgggacctaggtcccctaggccttcccagcccccagccccaggagctctgccttccttcactatggagaaagcccagctgaaaaacgaggccatgctgcctagcacactacttatttttttatgactaagattaagctgacaaccatgcaaacctgtgtcggctgcagatttaatacctcgcccggcccacacaaataattcatgcttctgcatcgatgtccagaaaaaacaaatcagcaaaaagccgggccccagcgtgtgtgaagcagccgcctttccattgaagctgcatgccggaaatacccaggctccaggagtgcagagctagcattttgagattttttttttcttaaaagattaaagtatgttttctcaaatgattgaaggttggtgggaggtgtaaatgtgggcacttgtcacattaattcctcagatgattaagctctttgccgcttctttagagctgtttgcagttgggtttgatgtcctcgttctgggtgagtgtgttgtggcagttaccaaggtgactttagctgactttcaacaatttatttttccctccagcttgagactctcaagccctgtgtgctatgtgagtcttctctggcagcccccaccctacctccagaggctattcatcagcgtttctgcctggcccactgaggctggaattctccagaaggtcccacccgcagcgggccaggcctcagccccagtgagcagcctggctgcatagaataggagaaggtgttatcagataagagttacatcctggcactcagtggggttcagggtggggctcagtggtaaaatatttgcctagccgacacaaagctctgagtttcaatcccattatcccccaaaataaaaccacggctgtaatttgggttatctgtgctcactttatttataaaagggctaaatgagtgtccttgcttgctgtgaggacccatagagcaaacctgtgcatttaacagaaagcctgacacagaggaagcaaacatggttgctgtttcctgtgttctgctcttacttgagccccaggctaccccatgtctgaacccatcagtagtgcccggatgaaaatgtggggttgccctccttggaaggcagccagagaaggtggtcagaaggccacggttcccaagctggcctgccatgctcatgcttgttgtttggccttggatatgttttccttttgaaaaggaaagaggtaaattaagcaggttgagtttctttccgatcttgaaatgctgtgaccctcttggccagtgtttgtctccttcaccattcttgtgagacaagggaaaagcagttcccaaggcagctttgggagccacaggaagggctgccttggcgaccggggagtcatctgggggtgggtcctgggaggagcagagcagcagagccgagctgcccagcacctggggtgaggggcagtcgggctgagccactgccttgctgtcagtgcggccctcagacttgccagggaggggatctgcctgtcaagtgtatcattggctctgagcccctgtgctcaccctttgtaagttgagacctgctcctgggtggctgtccagctcagacatcctgagtagctctggcctgctgctcgaatgatttaaaaacaagtgctccgagcctggtattttgctgaacacttgaagaactgttctgggttgcccagcccaggccagagtcctaccttttgaatggaatccatggatgacagtcttttcctgctgggctagattggggaagtcaggatagctaaatttgaaacacacaacacttagaatgacaagagccccaggagcccagctttgggtggggggcttagctggaggggacctgagggacagtgacagcttagtgtggccaaggccactgtcagaagggacctaattcagggcttatacatgcacaacaccatatatacacacgtgtacacaccacaccacatacacacattgttagcatttcctctaagttccgtcccgcagttacctgacagcagctaggtgtgcctgactcactataaaaggggctgcttgttccttcctcactcactctcttgctgtcttcttctctgtcccttctctctctattcctctattccctccccccttctccacatgctcatggccagcctctcctccccctctgtctcctcctcctcttcctcttcttcctcttcctcctccttctttttctctccctctctctctctctctcctccttcccccctttctctgtctctactaccccctcaactgccctcccatgccctaaataaactttattctatactatacccatcatgtggctggtacctcagggggaagggacacctcagcatgggccctcagaggcaccccttccacctcaccataccacccctttaccaaacatattcctggttcttcctcctcttttttataaaacataccacaccacatatacacacaatgcacactacatacacacatatcaagccacatacatacatacgacaccacatacaccacaccacatacatacacacacacaccacatctacacataccagtgaagcccagctgagtgtcacccaggcagatgcatctgactgactccaaggcctaaccttcacctctcagcaaagactgggctgctccccattcttgcttatgttgctgccttgcctggccctgtgcaggagtaggcgctcactcagaaccagggtcagccagcctgcccttaagctgctgccccgtggcaccttagagagctaagagcctctagggctttgaggcagggggaaggcaccttagagcagctgttgatttcatgggcaaaacaagcaactgtgctgtgaacttgtgtgtgttgttggccaaagatgtgggctccagagcctgagtaacttcagaccaaatgccagcccgcctcttcattggctgtgcggcctgggactcagcctagcccctccatccccatgagcccacctcccggggcatcaggggaggagacagccattgagaagtgcttggcgcatgcccgcccttggctggtgctagagaaggtgagctagctactgtagttaacaggcatcacagctgctgaccaggggctcggccagaacatcccttcccatggtttccccttgtgcttgcttcacaggagccgcaaggacagtttgggcagcgacagctccacggccatcatcccccacgagctgatccgcacacggcagctcgagagcgtgcatctaaaatttaaccaagagtcgggagccctcatccctctctgcctaaggtgagctggaacagcacagagcacatcagccctgcaggaccctcacgatcgatccatcttccccaacacaactcagctaaagctttgggctaagcagtgtccagggctggggatggaaggcagccattcaggcagctctgtcctgggcctgagtgggaaactggagactctgtgtcacaggccctgcagtgtcttccccatctaagcctctgggcagtgcaggtagttgagaagtcttcaagcagggtagcaaggccagatggccctgcagttccttcctatagagattgttttgtatcttttaacctagagctgtgacagccccagtcacataacagttccccaacacattggtctgtcatctgagttttgtttgtttgtttgtttgtttattgaggcagggtctcaataagtagcctaggctggccttgaactcacagaaagcctctgattttgagtgcttagattgaagttgtgcaccctacacctggctttcttatcatctgcttctttgagaagtttcaaagtcagacaccatggggactagatgttgaggaagtgtccttcagctgtgccccttttgagaggttcagtgaccaagagagtttaggatagccctgccatcccataagctggagtgagagcgttctgaacaggttaggttctgcatcctccctgcttttccatgcaagacacttgattttttacaaaagccagtaaccaaccccgcagactccttgaagggccgaagcccagctgcgactcttttgctgccgtgagaatcagcgcccgcccgccggctggcgctgtggacagaacttcgctctattcagagcactgcacgaggctggatctcttgcagctgccctcttccaaacacttttgagttccagcctcactttacaagctaaggaagcaacaagaattcttctaaacgtgaggggacagtggctaggaagaagtaattgcatggtttgaaccctgctcatggatccaagagccaggagaagtggggaaggagttgagagtttagccagccttagacaactgccctgaacagcagggcaaaggtagcagcaggtggtccggatgagcagggctcccaggcccagcaccagactccaaccgtccagtctcctcctgcagcttctcaggcccaggcttgggcttggagcctggggaagtgttcatccgaagcagactgagaatgcagagccattttttctcctgcgatgcttggtatccctgcctgtcagtcaccactgactaccttcctccagtgtccaggatggggactagtggtgacttcttgcagtgaccctgcttggctttggattttttggttttgttttgtgtttttaaagatttgcttattgcctctaggataactgcttaaatgttacaggagaacccagacaaaggaagactgtcagggcaccgaggtctccctctgggagacatgagtcctccactctggccgtgacgcagagcacacggttaacttccctctctggcctcattgttctcaccttctcgagcttctttgagctctcatctagcctggccactgggtaggagctaaaggaaggacacctttagtgaagtggtagtggtgacctttcaactactgttctaccgtgaacaggtttggttaaagtccctgttagtgagcaggtgggccatcaggagggcgctggccaggcactccgcctcagggaatgttgctctttagccccagctccttggatagggaccatgttctaggcccagatccccactgtctccatattcccatccccaggggcagactcctacatggccggcacttcacctacaagagtatcacaggcgacatggccatcacgtttgtgtccacgggagtggaaggcgcctttgccactgaggaacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaccccaaggacaggcccctgtggctcccatgttgagctgggagctgcctcttggatatagaggttgtgagtatgggtgctgctgtcctcacagctgcactgcacttctggccattggtggaatggccggccagtgacagtgggaacccaggtgagaagtccccatactctgggaaatcaagatccaagagtggagggtgggacgtgggtgcccctctccagagacagtatggaaacctcaccagaatgtataggaagtgagctctgggactagggtgggcagcagagccccccacataggaagtgagctctgggactagagtgggcagcagagcccccctgagctatcaggtgccccctttgctcctgatggaaaccattgagcagaacctgatggcttgtccagcactcagttctcccgttctcctgctctgagcatggatcacggctgatggcgagcacagtacttggctaagggctcttcgcctctttcataccttttttttttttggcttttggcttttggctatgttttagagtaggagaaaaataatttgcctacctttcacaaaaatatcaggaaagggaatcagggctagatatgttgatacccaactttaatcccagcacttgggaggcagagacagggagatctatgaatttgaggccagcctgctctacataaagagttacaggccagctagggctacaaagtgagatcctgtcttagaaagaaagagaaaggggggggggggaggaaaaaggaaagggaaggaaaggaaaatcagggggctggggagagagaatttgaccttcatccaaaagggaaccaagctctgtctgtggtgtgtaagagaaagcaagcaggagttacagtaaaaaggcaaagaattatactggctttgtggattgcccagtctggggtctgcgctgttcttaacatgggtatgattttgtctgcgtatgtctgcttgcagttgagcctttcttcctcagagcatcctcctccccaccccaccccactaacccttaattaaaacaaacaacaaacaaagggtacagccactcttctcagactaagcccagaggtagaagtggaagctagtgctgtagggatattgtgttccataaattatcttgcctttttccactgttgttattacattgtttcataacaaaattactttgtaccataaagttataaatacattttaaaagtcccacttggtaacgttagatttcgtctgtgtggtgttggtagttactgtagcaaaagctctgaagtgtaacatttgaaatgagcccagcaagaatgggaaagacctcccacatccaactcccaccccagccctgtcctaggctgccatcctgctctgctgacaactggaggagcaggactcttcccactgtcagaacgagtatggaggtgggagatggggaccccaccagagaccccagccacagagagtccacagatcattattccaggacgagatgccatgccagcaggtcttagcaaagtgccgtcatggttcgtttgtggtacattggcagtgcaagcacattttgaggggggaattagggactgggggtcttcctagattaaagaagagtctctgccctttttttctttcatccttctaagaacatcttccagcctgggggctgggatggtctgcatctctggttttcagctgctcaggaatctgggcccccagaaaactcagcagatgtctggcagcccctcagtgttctggaaggaagctgcctgcaccccacccatttcccaaattcctaatcccctggctgctgctgtttccactcttggctctactgactcaccgcccctccccctccccaccgtgccacagacagcccctcgatgaattgggcccttccacactcccagcacttgggtcccctcccgtgggctgttgcctggggaaccagggagcggtgggaacgagttgctggcctcggcatgtttcaatcaagttgctgtgctaggagctgcttaatcaaaggcctgttatgggctcattagtgtggtccaccacgggccacccctcaggagagtcctgggaaggctggcttaggtcccgcccttcaggcacgcacccttgatcaccaaggggtttctcaggctggctctttgcaaggagccctgggaaactctccatctgacctgccctagtcagcccggttctcagcagtgaagccaacacccacatcagccttcctcctctcctgatcagcgttttctgcttctgatcgctagcctgacttttccttcagggtcttgcctctgtggtcacaggcagctcccgggcttgtgagaaccaggcttacaatgacttatgggcctctcgattgcttctgaagggccaactgtctccccaggaatctatcgaacttctggaaacctggggttccactcaaagtcacagatcaaaccccactatgccaagaaagggcccagggaaacgccggcacccagagcgccgagcctgctgtcacaggctgctttctgccactcccagggtctgcagtgcctcctgagcctctgctcagacctgagtgcaggtggacgagcaggaggcagctgaggactgcaggcatagggtacagagagagccagccctctgtcccttggctgcttgaaccatccctgtaagtcacagctggagtgggagggccaaggagactgtcttgcatcagccttcagcagccttccgagagctcactccctgcttggccccttgttctggccaccagcccagggaaaggcaaggccaaggcatctgtcctctcagtgccggggaaggggaggctaagggagccagagccctttgcagagctggtgggacggcctcagatgggcttccatagacatctcatcctggactgccacatggtcccccaattcctactagctcagggggactcaaggtactctggagggcagatgtaaactcacacacagggatgctgcgaaggcaagatctttccagagtagaggcatggcctcatccatcctacttcgtgtaagccaagtccagagctttatgagaggtctccagaccccggaacaggccagtgtcccttcctagccctggcactcttcgctgggggctgtggcaggcttcccccttggcctgttgactctgagttgccagtcttctgagcagagccccgcccaaagctgagtcagtttccgacataagttcttagccagagctatctgcaggagagacacttcagtcccagaggtcgctgaaaggtcatatgaccaaacatgagattatttttttttttaggccttgcaatgctttctcagctgtgtggtgtctgatagctcacccaggtggtgctcttagtcccagccactccctagcagcccaatgggaggtcctggcttgggagaagacgcctcccagctgttccctgtgggaaacctctgctgaactgtatcccagcccaggaacaggcttcccagatctctccagcctgtcttcttccgtccccatatacacctttggatgtggtgtagaagccaacctgggagtcccctgcccggcccctggccctccctttctggtgcctaccgtttctccttccggtgggcctgcctatacctggtctcctttggagatcttgccttgggccgtctccagacctctttgttcagtccagtgcctattacgttgcagagcaaactgtaattccccactgtgtcgacagagcaggagtctcagcctgctcctggccaccaaagccaacttctcaccacccacccagagcaggaaatgagcgagcgcccccaccactcacaagcacatgcctcgcctcggcccctcccaggacgggagtgtctgcctcaatgtggggaaggggagcagccgacaggagcccttgctgggctccacctcgatgccctcatgggtgccagggctgctccttggcaggccatgcctctgtaaagagcacacttccttcctggagaagaggaaagggagggaaagaaagccaagcttgctggggagcagaacaacatgtcaacacacggagcaaacagggccccaagacaaagtgtggattgtcatcacaccgagggaaggcatgggcactgtcagccacttagaaatccgttgaccgcagaccttggaatgagtgtcagatttgtggcggttcagtccccgcctgcagcacagccgggcctgcccggggcaggcaccaacaaaagatcacttttcaggttcctttctggaacttgctggaacctggagaattgagaggttgttgacaatcctttctcaccgccaatgagccaggctgtctgactgcactgcacaggtcctgtgatgggagcccactggagtgagctctgaaccttggctccagaccctctctccagctgaccaggccctcacaatcagtcacccagaggtagagctgcagtggggagctgctggttcacactcttctcagccctcctcctctgggctcttcctagcacttcctccccctatgcgctctcagggtgccttgtgaaaatgcaggtgtttttgcattgccttgggtagactgttgtccagagtgagagcatgttgcccagcacatgtgttctccagagccctccaagggaacatgttactcagaatggtccaggggcccttcctctctccttagagggtctccatcctccaagggctctttgagcgaaaccctcagtgctttgtcccggttcttcagacaagcataatagagtgcagcgagtgttgggatggtttgtcattgctgccgatgtttctagacgaggggaactgttaaaatgtgtggactcagaatgaagtgtggtcctataggtctctttaatcccagtgcttgggaggcagaggcaggaggatctctgtgagtttgagaccagcctgggtgtgtgtgtgtgtgatactctgcttccagccctgttggaatgcgcagatacactcctgactgggttgagggtactgttcttcctggtcattggtaaaagctaccatcacctcccccatcagaaagaggagagccctgagtatacacatctctagagtgggcacaccttccgcaaacaggaaaagagcatgctccgtcgccaccaggtaggcactgttctgaagtcaggaagactgccttccttctccgcacccagtcatctatcagcaagcacattgagaactagacttgcctcccttgcaagcccataacaggacccaaggaagagatacaggttaacacttagtgcaggttcctgcagataaggcagaaactactggaatgatcctcgaggttcctattcttgtggcagaggccagctgctctaagtggacagtttgcttcagaagctgcaaggcctagacctgcacaggcttttcccacagtgacctcacaacggcgagtctgttcccagtgagggctcccaggagctgctccatcatagctgtctatctccaggatcctgttgataagatctgttaacattctcagctccagctctgaaatatacaaagaacagggtctgtttgttcagtccaagcttctaaggtttaactcccaaaggaaattaaatcaggtgcccggagctacgacagtctgtcgtgtttctgtgcagagaatgtcacccttaatattatgtggatctcatgtataatttttccctttaattcttttaaaacaatgtggtttccagcagaaaccagcaaatcttgaaaagtgaaaatgaaggcacagctaggatttgtccccgtctcgggggcttgtcacccctcccccagcagagtacaaaatgaagtccacacacagatggagccacccttggcggcaggtctgctgaaagcccccatagctcagcagttccagacctttgacagagggactggcttaggactggattgttggtggccttacctttcttgttgttgaaaaacacccttgggagtcttcttgggtggcccctgttctcccctaccccatcctaccccagcaatagacagttccagccctatttactattccagcagagagctcctcccccggattatctgagggttagaagtgaactcagactggagtcagagtcgctaacataactgggtttgaggtatgcttgtgtttgtgctaacattttcagagatggcaacaagccctggaaatgccaaaaatatgaatgtgactttatattcctcaagcggactggtgataaccagtgaagaaactcggcttgggggaggggactcatgggataagaggagggctcaggctccaggaaggaaggccaggtgtgactggatgtggccaaggaccagaaagtgccagataggctggcaagagccagccaaccccctctggggatcttgaaggaagaaaagaaatgagtaccttgggtggacactctcctggacactctattctccctcctccctcctacctcccccctccctctcctttattcctggtcagtgctggttggtcctggtcctctggggagctgctagtcaggtgggaaccaggcttcctaggaggagacactgagtcagtgccctccccctcggtgtctgaggcatcaagtttcaggactgggatatggtctgtctttggccccacagggcaggtgccataacctctctgtgcctcagtttacccatccggaaagagactgaaagggataaggtgcaagcagtcagcgtggtgtctgctcttggcttccttgcatccctctattttgcccatcttgctttgcccctctttgctctgtttccttcctttttcctttgctgcctcactttacctcatggaaacttctgccctcctagtggaaacaactcccaagtgaaatttaatgggtattttctcaagtttttgatttcgccagcttctgaaagggaaggtttctctgagaggaacccttcactttcgtttgcaccctctacatacggctcaggtggacaagggcagcgaggaccgagaagcacgagaaagcttgcttagggcataaggatgaggttactccagccaagtggtggggctagttggcttggacaccaaagcttgtgggtaacaggcaccagaataaagcagtgaagtgggaaggtaggagacacccagagaagaggtatcccagaagtctagacgtgcatagctgctgactggggcctgctgggacagccctgacagataattctatggctgcagtgggaacctgagagactgcttgcctctgtgagcagccaggcaggctctcattctccaaggcttgggttttttggtctttcttgtctggctgtgacctgcttccctgcccctagtggtagagataggatccagggtttgtcatccaccattggggttcgtctagatcgcagacagggcttgtactccaaagtcacacggattgttttggccctgcgtggttgggaaaaggggaacacgagagcttgatgaggcaaaggaagagggtggcaggagctctcccacggccggcctttggcttccctgttctctgttgcctcgaaacacacagaggccaaacagcccaaagcggtgggtttccgcccaccttccggctcccttccgaggccagcgctgtccaccttccagatgccctcccttccttcactgcctcaccccccctctctgcccttccctagcgggggggagggggttggggcgagagtgcagtcttttctggaagcctcgagttcgtccctctgtccctagaactaatccttgggccatccctcctccacagctaaaaaaaaccccccttgctttgcagttggcaaaaaagactgtatattaaaaaataataataataattaaaaccctgtcttttgctttctttcccagattctgttgacagaagagtttgtagagaagatgttggaggacttagaagatctaacctctccagaggaagtgagcctatttcatttctcactgatagaggactcccgggtgtgtgtgtgtgtgtgtgtgtgtgtgtgtgtgtgcgtgcgtgcacgtgcgcatgtgcgagcgctcacccatctgtggactgttttcagaagtacaggcataaatctggagaggaacccctgagaaggttcaatgactttatttttcttgggcttcatgggtcagccctgcccagcccccacccttgtgaggacacccagcaccctgaatcgccagctcttgggaacctcattgaagaagtagccagggcctgtgggctagagttctccccagcccctgctgttccctggcagattctgaacagaaagcccgtgcctgctgccagagaacattccgctgggagctctcgtgggcaggaggggactcctgctcttgccttgggccacccaagtgccacgctcccttccctcgccagctctagcttgcctccctcagcctcttcctggctagctgagagcgtggggagctggcaggccaggtggggtgatttctctccttggctccttctctggagtgcaggaatggagtctataatcccttttgtttttcttccttgttcctggcctcctcgtttgcagggacttacctcatcttggaaagtcccttctcctataaccatcagcgcccaggcagcaggcaggcggatcttcctggcccccaggatccatggggtagtggggtaaatagcaagcctccgaggcctgagggatcttctggcccaccctcccctgcctgtggcagagatcacccccttcccttccattgccctaatgtgctcggggcaaagtacctcacctcccagttagttagaaacttctcagagccagtcaccccaatagagccaagccttccctccccctgccccagggatccagcttgattcattcattcatttgcatagtccaaggttatcaagtacccactctgtgccagccagtcacccctacaagtcactgcctcagaggcctagctcccggattcagtcaggccaaagccagctgcccagaagtgcttccggagaggtcttgtcacactgcagtggcgttctgccaggctgctgctttgagcttgggtgttgagtgggcgggaagaggacagtccaggcaggagagacaggagccaaggggagcttaggaaagtaggtcacgaaaaatgacttcttctgcctcattcctgtccagaggccatccccacaccctgccccagtctccactttgtcctgggtctacagtcccccaagagagaaaaggcagccgggaagtgtccgtttgtccacctccagcccagcttcaggcaggccagaacatgattctctcctcctgtgcctggctctgacttccagcctagcccagagacaatggggcttaagagctctgcaggaacccaagtcagggaggatctattgagcacccactgtgtgctgggctccatacaaggttctagaatccagaaggaaccagaagtcagcttctcctcctcgccaaagaccccaggtgtgggaaagaagcaaaattacaagacagtcattgatcctagtttggaaggccctggctgttatctggggtcactctgaacaaagagccctgggaagcagggtgacagggagcagtgggtggtgacacgcagaccaccttcaccctgaacttctcccagtggggtcacactccaagtctgatttgggggctgaacagctctcctttcttgtggaccctttgacaaaactacagagg

SEQ ID NO: 32 - DNA, 1415 bp, Mus musculus
cggagcctcgtgcgcaggcgcggagttagacctcgccgtagcccccatcgcctcggggagtctcatccacagtgggtccgctggcccataggggcgctttccctcctctaccctcccgggttctccgcgcgccctacgcgccccaatggcggagctgcggcctagcgtcgcccccggtcccgccgcgcccccggcctctggccctagtgcccctccggcctttgcttcactctttcccccgggactgcacgccatctacggagagtgtcgccgcctctaccctgaccagccgaacccgctccaggttaccgctatcgtcaagtactggttgggtggtccggaccccttggactatgttagcatgtacaggaacatggggagtccttctgccaacatccctgagcactggcactacatcagctttggcctgagtgatctctatggtgacaacagagtccatgagtttacaggaacagacggaccaagtggatttggctttgagttgacgtttcgtctgaagagagaaactggggagtctgccccaccaacatggccagcagagctgatgcagggcctagcccgatatgtcttccagtcagagaacaccttctgtagcggggaccatgtgtcttggcacagccctttggataacagtgagtcaagaattcagcacatgctgctgacggaggacccacagatgcagcctgtgcggacaccctttggggtagtgactttcctccagattgttggtgtctgcactgaggagttacattcagcccaacagtggaacgggcagggcatcctggaactactacggacagtgcccattgctggcggtccctggctgataactgacatgcggcggggagaaaccatatttgagatcgatccgcacctgcaacaggagagagttgacaaaggcattgagacagacggttctaacctgagcggcgtcagtgccaagtgtgcctgggatgacctcagccggcctccggaggatgaagaggatagccggagcatctgcctcggcacacagcctcggaggctgtctggcaaagacacagagcagatccgggagaccctgaggcggggactggagattaacagcaaacctgtccttccaccaatcaattctcagcgacagaacggcctcacccacgacagggctccgagccgcaaggacagtttgggcagcgacagctccacggccatcatcccccacgagctgatccgcacacggcagctcgagagcgtgcatctaaaatttaaccaagagtcgggagccctcatccctctctgcctaaggggcagactcctacatggccggcacttcacctacaagagtatcacaggcgacatggccatcacgtttgtgtccacgggagtggaaggcgcctttgccactgaggaacacc

SEQ ID NO: 33 - protein, 442 aa, Mus musculus
  VARIANT (1)...(442): Xaa = Any Amino Acid
GRFPSSTLPGSPRALRAPMAELRPSVAPGPAAPPASGPSAPPAFASLFPPGLHAIYGECRRLYPDQPNPLQVTAIVKYWLGGPDPLDYVSMYRNMGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVRTPFGVVTFLQIVGVCTEELHSAQQWNGQGILELLRTVPIAGGPWLITDMRRGETIFEIDPHLQQERVDKGIETDGSNLSGVSAKCAWDDLSRPPEDEEDSRSICLGTQPRRLSGKDTEQIRETLRRGLEINSKPVLPPINSQRQNGLTHDRAPSRKDSLGSDSSTAIIPHELIRTRQLESVHLKFNQESGALIPLCLRGRLLHGRHFTYKSITGDMAITFVSTGVEGAFATEEHX

SEQ ID NO: 34 - DNA, 26991 bp, Homo sapiens
  misc_feature (1)...(26991): n = A,T,C or G
tgcccaggagttgtttgttaatggggaatgagacgtggaggaatgaaatctttctcccaagtgagcaaggtgtagaactgtaactagcatttttggcggggaggggagagactccttttgctatcctggagtggtatttcccttccagtgaatttgccaaacaacataaaagtcgggtagctgagggaggtttctcctggtacctgggggcaaagctccaaggagggaagggaatagaaagtgtctacccagcccttacctggaatggcgacgttctttcagacactgggtgcgggggagcctctgctgtgtggtttaagtggaggtctctgggattttcaccctgacttttcaatgaggataccttggggagcaagagagaggaagccagctcctgtaaccgctggactgaacagctgggcctctaactgagacattattagcatttgaaagcccctctgaaggggccaagagcttcccagggtgggcgcaggggcctgagtgctgagaccccacagtggctccaacagaatgggtctgagcatccagggcataaagaccagaccggactcaagaatgaactcattgtggctttgtcccatgcttgaaaactgtgaccagggctctttcattgttaagaaagaccatttcttgtccacagaagagctcataagtctagttccttcatcaggcagagctgcggaagaccctgcccctcactagaagtttctgttagtgtcctgctctccaagcatttctgatggaagttgcactttctgctccccactttaactcaggagtacctttggccaaagcctgatcacacatgctcagggtggaacgtgttgatcctagagcaacacctgggcccgactcccttttcttgccttagagtctccctttcccagctgcctaaattaagcctcttcccaagttattaagcctgcacaaagtgctttttggtcattctggttcaaacagtttgggtttgcacagtattttaaaatcatgttaattctggttaataaaaggtcaaaggtcatggctccaaatctttccagccttttccctgtttccagcctaaataaatccccacccggtttggggtatgtttctttttcttttttctttttttttaattgtactttaagttttagggtacatgtgcacaacgtgcaggtttgttgcatatgtatacatgtgccatgttggtgtgctgcaccgattaactcgtcatttaacattaggtatatctcctaatgctatccctcccccctctccccaccccacaacaggccctggtgtgtgatgttcggtttggggtatgtttctacagactagacatcagatagggatgcagagctccagggaactggcccatctgtttcttaaaccaggagcaatggtgccacctactgggcacttgctggtagcgacaagctctgtggccagtcctgttttctggtgacttgggtgagagtatctgtactgtattccagtacacgagtaataacatactgcagtagaaagcatattgagtaggcacgctatttcctgttaacaggcttagatactgtgtttgggcaagttgcccagggtcacatccagttagggatggaggcaaatagaaacagggccttcccaactccgaagttcaccactaagccagggtttgccaaaaccagcaggcgatttcagctggtaactgcacaagagtggtaactggtagcatgaatagtgaagccacttttctctctttggttctctttgtcttttttttaatttaagatggggtcttactatgttgcccaggctggttttgaactcctgggctcaagagatcctctcactgggcctcccaaaatgctaggattacaggcatgagccaccatgcccggcccagtttgttctctctcagtcttggtgattttgtctcagctctatatgactctttaaaccttgaacagctctttgacccttgtttatttcattttttaaacaattttaggtaggcaacaatatcagttagaaattaataacattttgttatattatcctgaagttaccacttgaggtaagcaacgctaatttgccattaattttccttatttagtatagtgatatgaagttgccttttcagagtaagtttgtttaggttaaaaaaaaaaggcaagtcaattttagggggaaaaatacaggtaagtaatggtacagatggtgcacagatatggcaaacatgctgatgggtgttgtggatgagcccaaagtttggaaagtgttgggccatgcccatcatcactgacgtactgtgagactgtgggcaatctcaagcatccttttctcatttgtagaaaagaacatgttagtaggtgattgttcaggtcatgtagacatacacagtgctgtgatgtctcagcattatgggtcaggtttctcccaggccaggctgctgtgcctggggtggtgggaacaaggaatttaaaggcttggccttgcttcccctactttgcctgtgcctcaagattccttccttttgcctgctatattttcttttttaataacagatttattgacatacgattcacataccatgtaatccacagttgtgaaaccatcaccataaaaaaagaacctcatattggtcactccctattccctccaaccatcacagccctagacaaccactaatctactatctgtttccatagatttgcctattctggacattccatatggatggaatcatataaggtctattatgactggcttttttcacttagcataatgtctttaaggttcatgttatagtatatattagtattttgttcctttttattgccagataatacttgtaattgccatcttttttgttttaaacattctagtggatatgaagtggtggtgtctcattgtgggttttctgttttcttttcttttgttttttgagacagggtctcactctgtcatccaggctggaatactatggtgcgaccaaagctcactgcagcctccacatcccgggctcaaacaatcctcccacttcaacctcccgagtacctgggactacaggcttgggccaccacacccagctaattttttgtttgtttgtttgttttttatagagatggggttttgccatggttgccctggctggtctcaaactcctggcctcaagcgatcctctcaccttggcctcccaacactttgggaggccactgcactggcctcattgtggttttgatttgcattcctctgatggttaatggcattgaggatctttttatgtgcttattagctatttgtatatcttttttttttttttttgacagagtctcactctgttgcccaggctggaaggcaatggcacgatcctggctcactgcaacctctgccttccgggttcaaacaattctcctgtctcaacctccctagtagctgggattacaggctcatgccaccacacctggctaatatttgtatttttagtagagacggggtttcaccatgttggccaggctggtcttgaacttctgacctcaggtgatctgcccgccttggcctcccaaagtgctgggattacaggtgtgagccaccatgcccggccagctatttgtatgtcttctttggagaaatatattcagatcctttgctcatttttaaattgaattatttatcttttattattgagttgtaagaactctttatatattctggatacaaaatacttaatatatgctggatacttattagatatatgatttgcaaatattttctctcattctctgggttttttcttttaaaatgtgattaagcctgggcacggtggcttacgcctgtaatcccagcactttgggaggccgaggcgggtggatcatgaggtcaggagatcgagaccatcctggctaacacggtgaaaccctgtctctactaaaaatactaaaaattagccgggcatggtggcgggtgcctgtagtcccagctactcgggaggctgaggcaggagaatggccagaactcgggaggcggagcttgcagtgagccgagatcacgccaccgcactctagcctgggcgacagagcgagactccgtctcaaaaaaaaagaaattgtgattaaatatatgtaacataaaatttatcattttaacaatttctaagtgtacagttctgtgacattattaagtacattcacattgttttgcagacattaccaccatccatctctagaagtttttcatcttccccaacttaaactctgtacccactaagcaataactccccactcgcttctcccccagcctctgacaaccaccattctattttctgtctctataaatttgcctaccctaggtacttcatgtaagtgaaatcatgcagtatttgtccttttgtgtctagcttatttcacttaacataatattatcaagtttcacccatgttttagcatttgccagaatttcttttttatggctgaatagtattccattgtgtgtaaatactacattttgttaatccattcatctcttgatggacatttgggttgtttccaccttctggcaattgtgaataatgctgctgtgaacataggtatacaaatatctgtttgagaccatgctttcagttattttggctatatacccagatgtgagcttgctggatcatatggtaattctgtgtttaaattttttttgcagaaccgccgtactgttttgcacagcggctgcttcattttatattccaccagcaatgcacacggattccaaattctttgcatcctcaccaacacttgtgcacttattttctgttttcttttttttattaatagtcaccctaatgggtataaagtgatatctcaaaagtgattttgctttgcatttctttttactttcttgatggtattgtttacagcacaaacagtttgttttgttttgagacgaagtcttggtcttgtcacccaggctggagtgcagtagcgtgatctcggctcactgcaacctcctcctcccgggttcaagcaattctcctgccatagcctcccgagtagctgggattacaggtgcccaccactacgcccggcaaatttttttgtatttttagtggagacggggtttcaccatgttggccaggctggtcttgaactcctgacctcaggtgatctgcccacctcagcctcccaaagtgctgggattacaggcatgagccactgcgcccagccagcacaaaaggttttaattttgatgaagtctaatttacctatcctttgttacttatgcttttgatattgtatggaagaaacctttgcctaatccaaggtcaaaagatttactccaatgtttgcttctaaaagttttatagttttagctattacagttaggtctgtgatccattttgaattgacttttgtttgtgatataagaaagagctccaactttatccttttgcgtgtgagtatccagttcttttagcagcatttgctgaaaagactatttcctttatcgaattgttttggcccccttgttgaaaattaatgcccacaggctgggcgcagtggctcacgcctgtaatcccagcactttgggaggccgaggcacgcggatcacgaggtcaggagatcgagaccctggctaacatggtgaaaccccatctctactaaaaatacaaaaaattagctgggcgtggtggcgggcacctgtagttccagctactcgggaggctgaggcaggagaacggcgtgaacctgggaggtggagttggcagtgagccgagatcgtgccactacactccagcctgggcgacagagcaagactctgtctcaaaaaaaaaaaaaaaagaaaagtaaattaatgcccacaaatgtgagagtttatttcaggcctctcaattctattacattgatcaaatgtctatccttatgccagtgccgcactgacttggtgactatatctttgtagcaagttttgaaatcaggaaaattaagaccttcaactttgctcgtcttctttaagaatgttttggctattctgggtgtcttgcatttccacgtgaagttttgaatccgtttgtgaattactgcaaacagcatacctggcattttcatagggattgcactgaacccgtagatggatttggggatactgccatctcaacaacactaagtcttccgatccatgaatgttggatatttttccgtttatgtaggtcttctcgaatttctttcaatgatgttttgtagttttcagagtataagttttcatttcctttgttaaatgaagcattgtattatatttgatgctactgtgaaagaattgtttttcttactttcattttttattttgtttatttatttatttatttatttttttgagacacagtctcactctgttgcccaggctggaatgcagtgatgtgatcatagctcactgcaaccttcaacttctgggctcaagccatcctcctgctccagcctcccagatagctgcagctacaggtgtgcactaccatgcctggctaatttgtgtgtgtgtgtgtatggagatgggtgttcttgctctgttgcctaggctggtctctaactgccaggctcaagcaatcctcctacctcggcctctgaaagtgctgggattagaggcatgagccaccatgcatggccttagttttgtttttggattgttccttgctagtatatacaaatacaaataacttttgcatattgtttttgtaccctacaaccttgctgaacttgtttaatagttctagtaatttttagtacattccttaaggttttctgtatacaatatcatgctatccatgaatagaggcagttttacttcttcctttccaatctggaagtattttctttctttctttttttttttttttttttttgagacagtgtcttactctgtcacccaggctggaatgcagtggcatgatctcggctcactgcaacctctgcctcccagattcaagcaatcctcctgtcttggcctcccgagtagctgggactacaggtgcacgccaccacgcctggctaatttttgtatttttagtagagacagggtttcaccatattggtcaggctggtctcagactcctgacctcaggtggtccacctgcctcgacctcccaaagtgctgggattagaggcgtgagccaccacacctggccttttattttgtacttctttttcttgcctaattgtcctggcttgcactctaatacagtgttgaatagaagtggtgagagtaagcacctctgtcgtgttcctgatcgtagaaggaattagttcagtcacttaccattaatcaagtatgatgttagctgtggggttttttgttaatgtcctttatcaagatgaggaagttccatctattccaaatctgagtttttttttttatcatgaaaaggatcttgtcaaatgctttttctgtgtctattgacatgatcatgtagtaatttttataatctgtattacattgattttcttgtgtataactaaccttgcatttctgggatagattctacttggtcattgtgtataaccacctcccccccgactttttctttttttttttcttttttttttttttttttttttgagacagagtacagagtctcacactgtcacccaggctagagtgcagtggcgcaatctctgctcactgcaacctccacctcccaggttcaagtgattctcctgcctcagcctcccgagtagctgggattacaggcgccttctaccacgccctgctaattttttgtatttttagtagagacggggtttcactttgttggccaggctagtcttgaactcctgacctcgtgatccgcgtgcctcggcctcccaaagtgctgggattacaggcatgagccaccacgccaggcctgtataaccctttttatatgttgctgggttctgtttgctggtattttgttgaggatttttgtttgtatatgcataaagtatattggtctatagttgttttttttcttgtcttacctttgcttttcatatcatggtaatactggtttcatagaatgaattagaaattatttcttttattttttggaagagtttgcgaaaagttgatattaattcttctctaaatctttggcagaatttaccagtggagtcatctggtggacctggactgtttgtattgtgtatgttgttggtgggggttaattacttattcattccttttacctgttgcattgtttcttgcttgcagaacatgcaggttgcttgtagaaacacacttacgtaaaaggagagagattctgggaagagtgggcctagcaggaatttggaaatttaggggtttctagttggctctacctgaagctgtgccttctcctctcccctgtattatcacatctcagatgaagcagtcttccttctcctgcctgaatgaacactattgaggttaggaccaataactgaagccgtatcttggatggaaaaggtgtgtctgtgtgtgtatgtgtgtgttctgccttaccttaaatattgataaaaagtgaagaaagatacctcaactgttgagattccgagatcgtgaatgacagaccatagtgaactctggaacagccatttaaagaatgagatagctctccatatgctgagaagcagtgatctctgctgggtgctgtggctcatacttgtaatccccgcactttgggaggccgaggagggcggatcacgaggtcaggagatcgaggccatcctggctaacaccgtgaaatcccacctctactaaaaatacaaaaaattagccaggtgtggtggcacatgccagtaatcccagctactcaggaggctgaggcaggagaatcgcttgaacccaggaggcggaggttgcagtgagcagagatcgcgccactgcactgcagcctggcaacagagcgagactccatctcaaaaaaaaaaaaaaaaggtgatctcgtgctcacttcagcagcacatatactaaaattggaacgatacagagaagattagtatggcccctgcgcaaggatgacatgcaaattcgtgaagtgttccatattaaaaaaaaaaaggtgctgtctaagatatataattaagtgaaatctgcagaatagtgtgcttccatttgtgtaaggacaaaacatggaagggagcctgtggatgcataggctggacatatagagcaccttggcacccacgatgagagtcagagctggtgagagacttagtaccttgtggggttgttttcccttgtggttatgtggccttaaacaaaactctctctaaagtaacgtacctgcttgaagtgcagtggtgagcctgtgtgtgaggaggctatgccctcatggcaacagctacccttggcagaatctgaacatctcagagacatggcctgaggatcctcatgagttgtctctgccacggtgtgggaggcactatttagacctccatttacttgaagcctagtgttcctcaggaattcctacatctgcctgtgggaaaatggtgatagatttcaaaggctctccaaggttcgatgtttccttctgagtgccatttcagcaacataggaatttcggtctgtttctccaaggtgaagggctttcattgccctgttgcctctctgtggacttctggccaggtggccctacagaaaagcaccttattctttcttggcagatccagtcatggctcctgcctcccaccatgagtcgggatattggggaagcgaagcagatgccagaagtctttctggtttcccaggccgaaggagctttcacactaatagcctgtccttttcaagtctgacagaactggcaagcaggaacaatttaggtttttggaaatatccacaaactctttgcttccatccggagtgaatgcttctcttccttcacaggggctaccctaagaggctgggaagcctcccagcctgggctagtgagatcccagcccagattccaggcctggatctggggccttgaacaatgaggatccttgtatctctcccacagagaacaccttctgcagtggggaccatgtgtcctggcacagccctttggataacagtgagtcaagaattcagcacatgctgctgacagaggacccacagatgcagcccgtgcagacaccctttggggtagttaccttcctccaggtgaggcacaggttggacgctggctcaagccttcctgtgggaagggtcctgggaggacaaggaggcttgaggagggggagtgaagggagtgggaggtttcctttggcctcgtcctgatttctgtttcctctgatggtttgtcaggtagattcagatggtctgatttaacctgctgagatgggagaggggagaaagggaagggggcatttggttgggagagaatggctgtagctgagagggagtaatggggtggcgggtattctttgaacagtgaagacccagtatcaggaacaggactttccagcgggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgataccagactgggtaggaatggctcccctgaacctccccctacttccagagacatggcctgaggacacatcttgagttgctcaggccttggttttctcctttgtagctaagagctagacttggtgtcatccagacacagcaagggcaagggtcaggcctcagggcccacatgtggacccagccatttcccagccaggcagccactccctcctaagggaatcatccaatcttggctgcaccagctcctgagcacagatcctgcctgtggtctcccaactggaggtgactcagagagcctgggtagctgaccttcttggggtggggggtggccattaacacacaatgggctttctatcctgggcctcagatcgttggtgtctgcactgaagagctacactcagcccagcagtggaacgggcagggcatcctggagctgctgcggacagtgcctatgtgagtacccatgcaaggtgggagcgcggctccctgggcctgggggtgggagtccctccactaccctccatgtggggctccctcttgcgttgttatttcagaccctggtttttcacatcagggcttcctgacgactcactccctgacagtccctgaccacgaactattcccctgtgtcctaggcctggggcagcaaacagggcaggctgtaggcccagcccatcagccccagaccctcagttaccattgtatcccctttccttgtccacagtgctggcggcccctggctgataactgacatgcggaggggagagaccatatttgagatcgatccacacctgcaagtatgtcttgagtgaggaaaacctttctagcaccctgtgcctaggcctcttccaaataacactggctttcatcctgggaaaacagaggacctttatgtgtgagtgagtagaaatatggcatcacttggaacttgtcccctgaattctgcagagcacgtagggagcagaggtttcagcccaggaaagctagtcctcagacatatgtattttggcattttaaaaggatatttttattgtatgtaaattatatattggcttaaaaaattagattgccagcaataaaagataagtgtagtggatattgcttgcttgcccagtattcattctcctgcctcccagactttcttttagggagccaccacggccaccaccgccctgtaccagacagtagtgtaggtgatactgactccatggctcagctgcaggagtgagggctgattggtctaatggtcctatccccattttcgccacattttctatcttggacagtcagatgcagagctcctagcctggaaagattggcaccttagacacacaggctggcagctgcccactccctgtggcccacctggacattgtttcagtgtcatctttgctgttttagaagcattcctttgtcatgcaggtaaagtttgaaagccacaagaacgtaactgccttttctttttttgagacggagtttcgctcttctcacccagcctggagtgcagtggcacaatctcggcttactgcagcctccgcctcccagggtcaagcagttctcctgcctcagcctcccgagtagctgagattacaggcgcccaccaccacgcccagataattttttgtatttttagtagagacagggtttcaccatgttggccaggctggtctcgaactcttgacctcagatgatccgcccgcctcggcctcccaaagtgctgggattacaggtttgagctagtgcgcctggcccataactgcctttcttatgggcttctcttgaagcaggagccacagacagctaataatgttacctgcctggtgtctggctccttctactcccctgaccaaatgcaggtcattgccatctctaaacctgccatgcttctgtaaaatatctggtaggccacaggcagttgccgggagttccatgtgttagagcaagagaaaggtggcagatggacatgtagccagcagcccctgagttcttcactgtagacttgtgagttcttgggcataaatcctcttcattcacagatgatgctcctctgttttcctagtgcctttaacactgaacatttcaaactgctgccaggatcctctgttctctctgctttaaacttggtttccttgtatcttctgcatatgcaagaaccaggaaccaggaaggctatctttccctaagcccttgttctgtagccacactgggatccagcatggggcactgtgggccgttgtttggcccctgtcgtaagtgccaagtactaagaaagaacctggtcctttgcactagtagggtaaacagctgtccttccatgccaagggctgttctccttcctagtctgcaggatcccctgagagcagcccacaggacccggagcacctagtggtctttgaaagcaagccagggtcccacaggaagaaaggacagctttctttcctggtggctctgtgcaccaagtgtgaactcctctgtattcactgtgcctttctggggcctgcttgctatcagtctctttagagctggcatatattcctgtgattcaagctctacactaaccagctgtgtgcccaaataagtccctcgccttctgggtcttaactttttctttttacttataaagtaaatagcccagacaagttgagccaagaattgtctgtctgcaactctttacctaagtgagggaccccagggcagccagtgcagaggaaaaagctcagactatcccctgagcacaccagggtatacatgctccctgcccagagtacacagagcgcttccctgcttagcctcttcctgctcggaacccacagctttgcccaggccagcattagcacttgaaaggaggagatgactgatgggaaggaggcgtctggggcagagccacttgctgactggtcccaggaaataaggacagtacctgtacttctcccacatggggcttctgggctgatcagcaggccagtgtggtacctgtggagccgggaagcacagattattgttgagatgctcagtcacaagcttgatttggcccacatggacatagagccttccagatgacttttaattcaaggtccagcatcaatgaactgtgttttaccagaaaatccagggatgttttgagtacaactcttccttgaagccatttggagagtgtttgtactcagcagtaccaaggcctgcacaaaggcagggtctcgatggggagagaagggtgtctgcagatagtcactgcactctaggcccccatttcagtctaagaaatgggaaggaatctccatccagagtcctttgctaaacaagggaaccaatgcatctagggaagtccagcctttgttctccagtggctcttccctgtgtgaccacaccctctagctgttagaaggggaaactgcaggtgtggcctgttgcctgtggcaggcttccaccctgttttctatagcagtgactgggaggttctgcctgaagatcgggaggagaggaaggatcacacctctcctcagagaagtaggctctctcatggccacatcagccccaccagccagcgtggcggggacaggtttggggctctgaaacaggtagaggccattgtgctggaaggctgatggtagaagagatgtttcccttgggatttgcattcctcctggcttcccctaatccctggttcccctggaggagtccaggagctggcagagaccatcatgcattggtaaccagggcagaacaaggtcagagatcctgctctccagcatttgtcccatgctcagcaccacaagggctcagtaaatactgtaagagcggtggctgaaagggtggtcaccttgggtcaccagttctctgaaagaactctggctctttggttcttttcaagcaggagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaaggtgggagccatcactcagcattccaccagccttcctccttccttttccccagggcctggtttccagtctctctaggatgggtctctaacaaaaacaacccattcaatagtttatttcctggcatgatttaaacagcaagtgaagtcttccagcagggcggaattaagggagctttattggcccattcctagttgtgtttcctgtgtgtatttcaaatgcatcaccagcaggcaccgttgtgttttagatatgccctttgcaatctgaggtcatggaggtgagtggaagcctcagaacagttacaggaaaagtccatagtccacccaagtgcaagagaaaagtgtcggccacccacggaattgacacagggcccagctctggcctgaaggccatgccagatccaaggatcactctggcctcgggccctcccaggccttcaacaaatgaggcctgagtgtgaggctggcttgcaaattgcccacctcctgtcatatagatacagggttaggggctgtgggcagggcctctggacccaccgtgttccggatggggtctttgggaaggaggatgtggctgtcctgttggaatctccctgtgctgatcttggctacagaaacagttgtggtttttagtagagggcgtccccagctaactgcaaaggagaagcagccacttacatatacatgtgttgacagcttctttgtctacttcctttcttcattcttccatcttttctttttttgaagaataagatgtctacagccctgaataaaatccttacatatatgataacacttataaaaggtttttgttcgttctgtaaaggacaaacttaaactcctagtgcaaatatttgagccctttctttttttttttctttgaaacaggggtctctgttgcccaggctggagtacagtgggttgatcttggctcactgcaacctctgcttcccaggctgaagtgattctccagcctcagcatcccaagtagctgggactacaggcgtgagccaccaacgcccagctaatttttgtatttttttgtagagtcagggcttcgctgtgttgcccacgctggtcttaaactcctgagctcaaaacaatccacccgcctcagcctcccgaagtgctgggattacagatgtgagccaccgcacccggccaagccctttctttccttcctgtttgttctaatggcatgccaagcctattggaggctcaaagagagggtatacagttattggaatcatttggttgcttttgacaaaagaggtgatttaaagagggagtcatagtcttgtctaaaatttcagtcattactggctatttttaaaaattgtaaaagtaatccattccactgtaacaagtcaaatagttagaaaagttagtaatcatctccttcccactctaaggccactctttgaacaactaattttaatttgcttttttgtatctgtttacagtttgcagaggtaaatttagatccaaatctcaatacaggggaccagactagtaagcttcatcccaaagaccagcaaagcaccttacaaagaaataatcccaccaagggaactctttcacttcctggcccttgcctctccatggagaggcagagtttcctgggatagaccaaggtggagagatgatcttagcatctcactgacttgaatgcaaggggaaggagtggcgggaccagatgctagttgactacccagaacccagaaaggtgtgttagaggcacctgcccattcatggcagggtgcttgcagccttaactcacatccatttcagtgggcagaatccccagtagtcagtcactgtgtggagccatgttaagggtaaacctcgggcctgtgacacaggaaagaaaaggatggtggagagcgctcttctgaactctagaggctgcccctggcttctacaagaatggtactcttccaacccagagcttcttaagagcgcggttgtcccctcgcaatctgtactcactcagcgcttacatctggatgcgtagagtgggctcaggactggccagcgtggtagtttttcttagcacctctgctgagccaggtttcaagagcggggtgagaattgctgggagcccactgggccactgggcaacttagtggtgtcgttgcagacacagagcagatccgggagaccctgaggagaggactcgagatcaacagcaaacctgtccttccaccaatcaaccctcagcggcagaatggcctcgcccacgaccgggccccgtaagttccccagtgtccctgggctggaacaagaggacgacttttttctgaagggcctgtccctgtggattgcatgagagagaacaatgcacatagcccttgctggatgggcccaggatctctaggcttaagggcaggcatggtctggggcacacagatctatctgtgggtcataggagagggcctcagaggggacccagcagaccgtgaatattaacatcagtaaatatttacatgagccgtgtgaacagacaggaggccaggttggggagaaatctgacttggggcctcccagccttgtgggagcccattgtgctgagcacggttccctccttatctcagtcttggccagagttgcccttccttccttcctggagcctggtctccggctgatagctgcaaccctgggggcctccctctctggccagccccatactggatgcctgtggctgaggcccttcttcctgcctctcttccctggggcccagggaagggaaaggaagtcttttgcaggcctctgctgcctgtccaggggcccctgtagccctccggagagactgtggccaccctagaggtcagatccgcttcctgccaacctctcttcctctgatagaggggatgagtgataggcagggctgaagctgggcacccccctctgcccttagtcccagggcagctctagggaatagctgctggcaggagatacctgggggctggcagcccaaagcaggaaccttgcctgccagggaggaaattgctgtgccttgggctgaaagggaggttgatcatcctgcaagaccagggtgatctagccttcttctatgaagtctttattacacatttgctgtctgacaagctcggacctagggggccatctggggtgcacaggctcttcctttgggagaacatgagtgaaacagttaccttttaatggtgtgcatctggctgtcgatgtgatttgttggaaatggctgcttctctggattctagctctagttgctgatcgtgtttcccagaagtagtaatgcttcagtgcactacagaaaagacaggtccacaggatctggggtagttagggagggcatcttggaggaggaagaacatagcatcgaccttgagggcgccttagaattttaataagcaggggaaggaactcaagaggatagcacaggggaggcctggctggttaaagttgaggctgcctgctgggacctgactggaactagagttactctgggaacagggctgtactgagagttgagctctttggcaaaagcctggagaagcctccaccgccacctcagagcagcttttaactccggcctgtaggtttctccagccagctgccctgaagtagctggctggaggcatcctgatcatcccctggcagcagcagatggccacaccaggtcatacgacatatggaagctctctacctgtgagtctggaccctgtcccgggtctacactccttcccattccctgagcttggcttctcgctttgggcctccttggcactgttggcaggccagaggtactggaaggcctataacatggacacagtctcagtccagatggctctctgcctctggaagcctggggtttctaggcagaagggcacaagctcctgcagagatacaaccttcttgccccgcttgtgtatctggaacaggcctgagatctcactccctggcttgggggcacttccagctactgcacccctggacattgcaatggggcacaaggctctgtgctcctagatatacacataagccgagactctcagcctacaccctaactgggcagtcgggtattggttctggcccaagggttctctgtaaacataaggcagagaggctgcagcttctaccctttggcttgagttggctgagatacagagagatgggtgagaatagattcgaggtgccggggttgtctccccttcctgaaggtttagtgcccagtaaggtctctaaagcaccaggacctgtagtctgaggggaatagaatgtttcctctgaggctgtcagtattggttaccaatttgttagcaattggttgagaaatggtttctcctcctcctttgccaagaacattctccaacacacccctcaagcctgtcagactcaagtttcctgttatctcaggatcgatgatgatggactcagttcagatcagtgagcgtgacggtaatatctgtgctgcccactctgggacctgaccccatttcacatacaccacatggattgcaactgagaaagctgacccaaaatgtgctggcaccagtgtttgctcctctccctgttggggggcagccagcgtgggccatattttgtctgcgggtctgatttccccttagtcaggacttctgggccagggagctcttatgcatgggtcttcgcgggtttgtctgtggtctaaggaagatacagagctaaatcagaggctcagagcagctgatcaagcctgggcaatagcagccgggtgccggcctacttgggggtgtcaagcacttgctcttttcacacttcagcagcagctaaaaccttattagtgctcattctgtgctaggtaatgtgccagctactatgtgctgccattcatttatcttatcctcatagccatcctgtggtcgataatcttacatattcccctttaatggatgaggtacagagaggctaataagtatcttttccaaggttggaaaggggtagagcttagttacagccatctatcagccattaaaatggatgtaatcttccttaccccattctcagggaccccatgggggacacatcagactgtgtctctgagaaaataatgacctttactggtagaattcatctaactagttgcagcatgaatcaggacctctcacatggcaccaaggacaaggccaaagcctcatattagaagcttattgggcttatttaactaaactctaggggagttaaataactcctatgagatgccatgagccttgatgattccaaatcccagaaataacaagctatgtcataattggctcatttataccaaaattattttgtgacacaaggccttactttcttcatgtgcagaaactaaaacaaccctctctctggtccctctaccacctcagggctaggggatttctttccattttgagggtctatttcttcctttccagaaaggcaggccccctgggtaacccgctcctctcctactcttcattgccagccctcctcccactgccttcccggaaggagagtccttggccctctttggggcttcttcagcatttcacaacccttgcattccagccatgaaatctgtatctggcttttcccaagatgatcagttgagaaaagcctccttcagcttgctggcgcctcccttcccactgcctgctcgggtgagtttgggaaggatgggaagcagttcctttgtgccacatgaggacagcctggcttaaagactgtgcctgccaatatctgtagagatttgaggagggaaaagttcctgggcatcctctctgtctgaggtcacctggtcagacatggtctacggagtctggtctctctacagtgcacagaagatacgtgtggtcaggtgaattgtgtgtagaggttttcttttatttatttcttttttttagacacagggtctccttctgtcacccaggctggaatgtggtggcaagatcatagctcactgcagcctcgagctcctggcctcaagtgatcctcctaccttggcctcccaaaatgctgggactacaggcatgagccaccacacctggcctgtatttctctaaactgttgctcagatgctgggaacctgcaccagtattctagggccacctcctccctcagccagtgacttaccacctgaggctgggaactcttaggaagctctctgagttgtgtgccctcccagagagggacagggcacatgcaggtgtgcacacttatgttagaggggaaaagttcctgactatgggagaagcactttgtagttgaggcacctctaaaaagcgaactcaccatcactgctgagtttctcagtcttctagaatcacaccagcagcttttaagacctttaaaaaattttttttgccttaatttcatggagaattaagattctgtaccatgaattcctctgctgtaacattcacatttgcaacacctccccaacatacacacacacacatatacatagatttctctctactcttaggagtgtctctgcacttgtctgtttggcctttgattggggtgactttgctgcctctaattcccatcttgaataccttgtaacctggccagggagtcatcctttagagaaaattgtgttttgttttgctcagcttgtgaggtccatgaagattaattagaggaagaaaatatcttgtttgcatccaacctaccagtgaattggggtgaaggaaggtgagtttccatctggggaaacagctgggctgtggctggtgccgctcgcacgaagggcagtgttgggtaaccctgcttcaaggggtctctcctgtcagcgcagtggccagcctggagccctctctgtcacgttggcttccctcacactcccacgctggggaagtacagttgcttgcactggaaagaaagcccagaaagaaacagcccttctcttagggccccagccagactctgcagggctgatgagaggaacagcccaggcctctctgctccctgcgtcctggacagcaggctcctttttgcctccctcactgtgatccatgttgtcatgccaagtgcctttacaggcctttctcagaaatacatatttgaaagggcagagcaaggggctccacagcaagtctggcatgggtaaatttctgttttaactccgttctttgctccgcttccccaaagagatgaagtcacggccattgttaacacctcaacttcagaattccttgctggtgcttgaattctcagtccaaacgctgcatccccctccctcgagttgcacaatcaggggtatttttatcgcccatccttgatcctcggtgtcacccaacacttcagcagtgagtcacttctccagggaagggaaaaggaaggctcaaaggtaagagctagagaaaggaaatgactcagtgtctcagaaaaaggaaagctggggttctggctagagtaagctcattcaggagagtaggggtcctaatctcccacccaagtcagagggtagggctggggatggcggcccctggtgcccagaggagttaatagttgactaggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgccaaatattgcatttttaaactgggtgtggtggctcatacctgtaatcccagcactctgggaggctgaggcagaaatagctcttgagtccaggagttcgagaccagcctgggcaacatggcaaaaccccatctctacaaaacattagccaggtgtggtggcacatgcctgtagtcccagctactcaggaggctgaggtgggaggattgcctgggcctgggaggttgaggctgcagtgaaccgtgatcacaccactgcactccagcctgagaccctgtctcaaagcaaaaaaagaaaatactgcattttgtcatttggttattggtgtttactattcaccttttgtggccttttactcctatattgtccttataagaaaatttgtcagaataaccaggttatacagccttgtgcttaataagaacttcagaggtgagctggtcccctctccctcgatcccacagccacacccttttccagttctgccttaaagggagacctgcaggtggttctttctctgaaagttcagagctttcgtcagcaatcagaaagcaaaaggaagaatctcccaggcaaggggcagaagccagaggttgggctgggctcagcaggccaaatccacttcacttgtgaatagttgccaagcttgatgccctggttcctgttcctgggcatccccaaggagaaggccccaagtcgtgtgtccactgcagacgtcatgactcacaggactgggattgtggctaaaaggagtctcaatggttcagctcctctcctttccacccatgctgccactgactgaatgggaccaatgccctttaggcgaatgtgaaaaattaagacttttccgttcagagagaccagggtggaggggaagcatggttgagactctgttggtctgttatgtgtaggtagggtgatcaaggcatgtactatgaactgtacactgctagaaatcaggaatctaccttgacactggaaggagagggtatattaggatctataaaaagtcaccttatgcagtgagaaatacaagtatagaatgtgttatatagacaggtggttaaagatgaaatagatcagtttagatcaattgcacctctaagccatcccataaaccaccccttggtgtggtgctctcaatatagaaggaatcctgggctggtcctcgcggctgagtgggcagtttttattgcgcatcaccttgtgccaggccttgcgtcgtgggatgcccttgttcctgtcttgtgacttagaacactgagacttagccaggttgtagaacttatctagcatcagactgcagggattaagtgtcagccaggatttgaacctgagtggtgtgactctagatctgagcctcttcactgagtattgcctgtaaaagaggataaaggtggagggatacatgccagttcaccagaaaacataactggaaacagggtctttgatgcctgcatgccggtgcacagaggaaagctggtattttagtttgcctggaaacccctgaaggtggcagttcaggagagaccatttagctgagagaggcatactaaaaaaataaagtgaaatcagctagaggatacactccatccaaatctaagtgaggaagacatatgggggtaggaaatggattcaacatgagaaagagacaaggagaatccggggtgaatgggagagtgatcccagatgacaacggtatagcaggaatgaaaggcagccaactcaggtgggagcgggttggaaggatcctctggagaaatgtctccaagaaaataaaattgataaatacctgatgtatttgaatgtcctgggaggaggatgtgtggaccattggtaagagtaattttttttttttttttgagacggcgtctgactctgtcgccttggctggagtgcagtggtgtgatctcaacctctgcctcctgagctcaagtgatcttccctcctcagcctcctgagtatctggtaccacaggcacatgccaccatgcctggctaattttttgtacttttggtagaggtggggttttactgcgttgcccaggctggccttgaactcctgagctcaatcgattttcccacccggcctcccaaagtgctgggattacgggcatgagccgccacgcccagccaataatagtaattctgatttaattggtgataagcacatagaaaactaagacaggtattaaatccaaggaaaatagaaaattatgacagaaaggaaaagtatattaatataatacatggctcaactgtaaacagcattgatatagtcataaaatttaaacacaccagtccacacaaactgatggtgcagttatcctgaaaaggtgggaaggtgcatggaagagagctaaaagctcatcttccctagtggggagtcagtaggtaaagcctgaaaaggaaataccaggccaggtgtggtgactcacgcctgtaatcccagcactttgagaggccaaggcgtgcagatcacttgaggtcaggagttggagactggcctggccaacatggtgaaaccccgtctctactaaaatacaaaaattagctggaaacggttgcgtgcctgtagtcccagctactcgggaggccgaggcaggagaatcgcttgaacccaggaggtggaggttgcagtgagccgagatcttgccactgcactccagcctgggcgacagagcaagattccatctcaaacaaaaaaaaaaagaaaagaaagaaaagaaaaggaaacaccggggaaagtttatttaaaatatcaaggatgggaggctgaggtgggtggatcacctgaggtcaggagttcaagaccagcctggccaacatgataaaaccccatctctacaaaaatataaaaatcagccaggcgtgatggtgggtgcctataatcccagctcttcgggaggctgaggtgggagaatcgcttgaacccaggagttgggggttgtagtgaaccaagatagcaccattgcactccagcctgggcaacagagcgagactctgtctaaaaaaacaaaaaaaaaatttaaggaaaatgcgaaagaatcatctacagaggtgacagttgtctccgaggaggggagcatgggaaaacagtgactattgtaatgaccctcatgaaaccgtttgactaaacacttaaaaaagaaaaaagaaaaagatattgtatgagctgttacagtttaccctgcccagtgaaaagaaaggatgatgtgtgccaggtaaaaagcacacagttagtgccaaggcaagcccaggggaacttcagcttccccagcctcaggctgagagttgagggtgagccatggagaatcatctgacggccccctgaaaagtgtctgtctcaggggcacagaagataatggggggaacttggctgtggacccaattctgaccagcagggagtgtgagtcctgtgagaaagcagcttgggcaggcagagttcaggagggaaaaccctgggccagtagtccctagaggaggtccccacagcgttttaggggattttcttgggtgttcagccagaagagggttctctggctacagttggaaaatgctggcttacacaaaatgaaaccggtacattttccctctgtcctcctcagagtccaaaatgccaacattttgtgaatctctaatctgagatgggacatattccatccacctttgccacacctgtttttctagaggcttctcttaaattaaaattccatcgaataccctttgggaagtcctgccctgtcttccaggaaggcagttcttttaagaattcaaggaaaagatagatatgtcttcatagtcttgaaaccccggaagaaaagaccactcaaaagagatgggagtttcttaaggagaaatgtagaaatattatagttacttttggggttttatctcagctctttactcattgtgcgatcttgggctagttatttaagtctctgagtttcagtgtctttatctgtaaaatggggaaaataatgcctctttatagagttgtgatggaaatgaaaggaagcaaagtacacaaaggattagcatgggacccagcaccatagtctgtgctcaataaagatgtctcttattattgtgaatagtcccctgaaaaccaaaaggaggtctattacctccagggaccaatataggtctgtagagaatacttcacacaactcaatttggaagaatttgaacaaatgctggaaggagagagatgttatgtcagcatagactttaaagaacagggtcaagaaaagctgaaactcaagaactgagtcttgcaaaaaaagtgcaatgaccagcaaaaaggacattatttttgtactt

SEQ ID NO: 35 - DNA, 568 bp, Homo sapiens
agaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggcccc

SEQ ID NO: 36 - protein, 189 aa, Homo sapiens
  VARIANT (1)...(189): Xaa = Any Amino Acid
NTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAX

SEQ ID NO: 37 - DNA, 122859 bp, Mus musculus
  misc_feature (1)...(122859): n = A,T,C or G
tgacactacagagagaaatgcacactaaggctggggatatgaagagaagagatcgagggcacagaactcaggcaggcagcctcatgtccgggtgggctggtcaggcaaaggctgggggcgccaagttgttatctgagttggagacaggctggctgaggattaagctcccccaaaccgggagaggccaggaagctggggagttgggccaggggccagggacttcatctcactcagtggatagttagggataaacagcagtgtggaagcagcaggactgggtgatgctggcagggccagacatagccaagagataactggtgatgtatctagatgtatcgagggtttgtctggccacccctattctttctgccacattgtgcttgggatgtgaggtccaaacttcactggcattatggtggctagctcaggcctaggggaaatagaagaccttcaggtatgtcttgatttcaaagtacaaaaggtctattatggacaagcaagaacacaatagtcataagacattaagggcaaggcacagaccataggctaaagaagtcacactgagggggggtgtgtatctgtggttcccaaggaatgaaagctcactgcaagaaggcaactctcatggaacctgcttacagtccagaggagtagatcaaggccacaggcagaatccaagacaaattgaaacatcagtgcctgaagcaggaggaacgagcagggaaggaatgggagaaatcttcatcttggaggcagcggatgaggagggagacaagcgggaccaggattgtgatctatggctctgcttagcaaaacagtaaactgggaacaggtgaaaaccaaggtcctgaacaagtacagtgccatcgcacatcctgaggctgaagcgaacccctgggatggatacatccttcttctattcactggaggtacacagtgtccagactccggtctgctgaactgcaagtgtgcagcggaggacagattgtgcagcagagaacagatgtgtgcccacagcttcgggacgaaacccctgcacctcaggtggaggcaggatttgatgtattcatgttatcaaagggggtgtattggggatcagagaaggagttatacatacttttcagtgcccatccctcacttccttctttgataaggcattatatgtgttcacgaagaggcatccccagggactgaaatccactaactttaactttctcacagtctagggaggcaaacggaatataggatgaaaataacggagcatatagatcttactctcaggtgtgggagattagaggtatcaagtgttggggggctcagaggatgcaggcacatcattgatatgggggttgaggagaaagagaagggtcagggtcttctaaacagcccacaactgttgagagtatttaaagggcactgcagagcctcatttgatcagaggcttactgtggaccatgagagtccagcaggaaagaaggtcttcagttgaggagtcgtgatgagaggtaattgctgattcggatttagtgtaaaggctagactgttcgtggcttttctgttaaaagcatctcctacattcagggtgtggtgacatatgcctataatcccagcactcaggaggctgaggcgggaagatcaagagtttaaatctagcttggtcttgggctatatagggaacccatatatgaaaataggggcagggatgaaacagcagcaacgaatatgaagaatctgtgagatctctagcttgattttatgtaacctgcatgttcatttccatgtactggggatggaaccaggccccttgcgcacgccaggcaaacagtcgggccccttgcacacgctaggtgaacagtctactaccactaagctacctgaggcacatccctagccccacccccagcttaattttaagacttctaatcgattttgcatcctatttcataaagcacaccatgtccatatacacacctggccccagtcttaaggaagacagaccgtggccagcccattgccgtcctattcctggactgccttcctagctccacaccaagaagcgttactgcaagcccgaggacatacaagcagatgacatacaaaagtgacatctttgtgacctttatttgcagtggtaactagaatggatcaggctggggaacagatttgtaaagaaggtcgaaaccatgccaggcagcattggggaggaggcactgaggccagaagtttccagttcaaggccagcctgggctacataaggaggccctgttacaagtaatcagaaagttaaagatggtcttgaggtggaaggatggggagagtcttgtacatcacatatgtctcttaccatagttctctccctctccccgccccccatcacacttacaggccactatcaattactgtgcacactgtaagtcctctaaagctcagattctaatacctccttttggttagctctcatccccctctcccatactctagcaagcgtcagtcaaaaaatggggaaggaaggattcgacatgctttgatcactgtagttcagcctcagaccttgcaccctgccctctcttcctagacctagatcctaggctctcattgacattctcgagcagtggacaggcagagttcagatcaggctatttggtagaaaggtgaatatacagtggggaactcctcatgttctcagagagggataggggtgatagctgacactggaactccagggaagatgttccatctctccttaagagtctggctgtagctggatcaagggtatgatcagactactctaaggcaaaagcccttgccttccaaagaaagatgctatggtcacggggactgcagtttgggcagaataatagccacgaggcttcttccagtgtccctccgtttacaaagagctttccttctatacgtgactgatatgcttcatttaacccacaggcccccgagtggcaggggtgtctatccctgcttatatctccaagaaggcaggaaatagtcccaggttgcacagaaccaagaggtttgaaccgagttctgctatttttctggtcttccacgccacactgcagctatgagtgactgacacgtactgattgccagaagccctcttaagatccagttctactcaactgcctctattgcttctctgaaaaggagctctggaagttagctgtccacaggacccaagcacagtttcctaagcttgtaagccgcccactcccaaccccatctccagtttcaggagttcagcaagtaaagtcttctgctcatgtaggtctttttgtgttgtagattttcatcctgctgcacctaaactttctgtcactcttccctggctgcattcctggttccccatgtcaactattctctgcctctgtctctctgtctctgtctgtctctctgcctctgtctctgtttttctctctggaacccaggaccttggatatgttgtgcaaatactttctcactaagctatactcccagctccactctctgacttctctaggcctgtaacatcttccctaagagctgctggtcagttacacactcggctacatggtttcatgcaagaatggcggattttctttttagttatctttgttatgatgttatctatctatctatctatctatctatctatctatctatctatctatctatctatcatctctttggtgaaagcagaactttgagttttcaaagaaccagctgtaatgccttctttctttcttctctaacatggagtctttcatttcctggatagtttcagtgatttttttttcttttttttcccaaagcaacgggagcataaaaccctgagacctgtatgataatgagatgggagcagttgaggcatggttttctatttatcaaggagagcaagggacaaataaaagatgaggaacaaggtcttagccagtacctaagaaaactttaggactgaggaatggaagtaggcgtgtaagaaataagaattatattttactcttgggtggagaatgagaaaagtagcctcctcctctcccactccctttctttcttcctttctctctctctctctctctctctctctctctctctctttctttctttctttctttctttctttctttctttctttctttaaaagataactcattgttaaacagtgccttgcgttagtcctcctgaaaactcaccccctggctgagttgtcatgtttgcgagaatagattcagagttccctttgctctgtcctcttctgcctaactgggctctagctagagttggtggtcagggagtgtggtcattgtattggtccaaaggaatcagcctcagccagaaagaaagcaaactgagacattcttcctggccaggctgagaggctagtaaaggcaccccgtgggaccacagagtcggaatttcagcggcccctttctcaagaccataggctttgctttgtgaaagggttaaaattttcttgtctggaaggttcttagttggtcaaggagccttgagtgggctaacaaccagactaggaatttgagggtatccggtcagttgtactggaattagggttagaaagaaagaaagaaggcctaacagttgacttcgagtttgtgaggggactgagcccctcggaggcttgtgagtggcctgcggctgctgcaccctgtagcttagtcttccctttgtagggcttagtctttcctcagtttggattggggaagtctactgatgccctgatctctttgagctggagcgggggttgtcttgcagaggaaccctgccccaaggccgtgctgcaccctttactctcccagctcctttcaggcccaaacgggcaggagaggcaaaatcaagtttgaaaactgggagctgggatttcaggggacccaccgagccgaccccatggcacataacgcagctgggcaggcgctgccggataggtggacatgccagtcggccagggacattccgttcaccactgctggacacatcgtctgctccccagagagacccactttgccgccccaagcgttctatccgttccaaaccccacgtgccgctgacattctgtccgattccgaggaggctccagatctggacccttccagatccaaacggcccacgacagacctgccagtcgtgtcgcgttgtgctggcagcttgggccctgtagctcgcagcggccatctgacccagtagcgactctcgcaacagggctccaattccaactgcggagcagctgggaaggaaagcatgagctactacgcgcacccctacttccagacgctggagtctgtctaagcctgggccaagtggcgctgcgagccgcctgttgcccttaggctgagcgaccgctgccctctcctcagttggctacccttatcaccttctggcccttgccgcttgcccctagatttcaaggtgctctctggtaaaggtttccagactacccactctgtggttcgtgcagttcttcggcttctctctgagtcccctaaatctcttctcagtcccccacgtccttcctcagagtttcccttctcccatgtcccagccccggggctactatacgccttttcccttttgaccgattccccaaacaccagagttcaaccgccccaggtttccttttaggagtcccaggaccagccttggtccctcggtcccctgagcccctattccctgcatggtcaagtactcacagtgcgtcccgcagcaggcagactccgggtggtggctgtggcggcggcgttctggagcgcaggcaggggccaggggccaggcaccctgcggggtgggggccgcccccctgctctggggcggccgctccgctgggctctcccaggctagcggaggagagagtgagtctcacagtgcagtgccaccccccgccggcgcccattcactttatggcaacccagggcgcccccagcccgccgcagcacgccgcgcgccccaggcccgcccctttccagatgcgccgcccttgctcctccctttccagctgtgaacctttaggccccaccttagtgggaggggtcctgccacccggcagccaagaactccgcccctatggccaatcagaagcgtttgccatccactgagcaacgccccctccccacgtggcccggactgcgctccagctgggactctcgggttcggcaaagctagcaaaagtacggtggtccgtgtcgcccctgagtccagcccgaactgtggctaattgaggccttgggctctccccggagtcacgagaagcagtgccgggggagacggctgcaggaccgtcaggcgggacagagaacccggctgtcgggtctcagctcccacactttgctgccgctcgtttcgccgattttctccacttgtcgctgtctgtctttccactcttttgtctctattccagtcctcgtgcgccttccttttttcttctgaccaccgctttgctccctactctatcacttcgaaaggctttcttttttaaagaccacccctcctttccatcctatctttctctccttagctatctctatttttttttttctcccctaaagaagataacttggagaaagcaggatttggaacgagagaaatcaaagtggtatacagcagcatcttccctcactcactgaccttggacaagtaacaacgatgcctccctggcttccagtggctgtctggccttgtgtgcttcaaaggtgtgagcactcggcctctcacgctgcagttatcaatttgcctgggctgtgctttcctggcctcagccgtgtcgtgtttcccacgacaacagatttggtcctgtgggtaagggtagcgttggcgtttttggattaagtgtttgcaagggacaggacaggtgtccaaggagtatgacaggcgggttacttagtgcccctgagagtccttaagccccgtgcagtatgctccaaagatgaatctaagcatacgtatcaatttttaaagcacgatagttctctttactgccttcaggagaaagtcaaagtttcctaatgtggcatatttgatcttcaggacctgaacttccaatccccccttcaatagagtcttgctctgtagctctctggttttggctggccctaaacgttcaactattatcctacctctgtgcattgtactgagtgccctgatttgtcttcatcttcagttttgttcatcctgaacgacctctaatttttcctgaccaaaaacaaaaaacaaaaaaaacaacaacaacaacaaaaaacaacaacaacaacaacaaaaacagtcgttatattgctgatcctaatttctgagttccacttaggttctgttttatctgagaagccttgcctgaacttccaggctggccaaaggtgtagcttcttgctctcatgaccccttatgtatagatttgatatcactccatcctccatattgaaggaatcaactgatgtgttgacttgtataaaataaaatttaggagaacaagaagcatttctttcctctttttctattcacaggcatatagaaactcaataaatggggggctggagagatggctcagcggttaagcgcactgactgctcttccagaggtcctgagttcaaatcccagcaaccacatggtgggtcacaaccatctgtaatgggatctgatgccctctgattctggtgtgtctgaagacagctacagtgtacttacatataataaataaataaatctctgggctggagcgaaaggggctggagagagaaggaaaaagaaactcaataaatgttgcactgaaataaataaaaaaaaaacctgttttatctgttaaatgatgtgtagcacctgtgaggggctggggattgctttctctctgtctctctctccatctttaattgataatcacatacttctaagatgtctaatgtctggaggcatacctagatagggaggggagagtagggagttttagtttacttacagggttttcctatttgctctccaacctgagagaagccctaaagaccaaacgaagagaaaaatggctcagaggtatcatagaatgaaataccttggtgatcgtatcatcttcatctgacttcctttaggttcctagctggacctagagaccaagaccaatgcatagacacagggagttgttgggggattcttcatattggatttggctctgatggttttttaaattagaggatcataacctatggatgccttgggtgcctgtttcaaggccacattccaatggccttagaaaaggtttgctttgctggacatggtagcatatgactttaatcccagcacttgagaggcagaggcaggcagacagacctgagttcgaggccagcctggtctacaaagtgaattccagggcagccaggcagccagggctgttacccagagaaactctgttttgaaaaacaaacaaacaaaagatttattttttattatttgaaatgtatgtgtctgtgcctggcatagtggtgcagcatttgggaggcagtggcaggtagatctctgtgaggttgaagccagcctgggcttcaaggacagtcagtagccagggttacagaaagatctctctctctctctctctctctcccccccctctctctctctctctcacacacacacacacacacacacacacacacacacacgagagcgcgcgtgtctctgtgtgagtatgtgcccaaagtgttggatccctctggagctggagttacagtagatagtgctatgtacatcctgggaactgaactcaggtcttctggaagagcagcaagcacacttaactgctaagcttcctttccagtctcacctgtccgcatttcgaaggaaaatgggaaatcatcatcatcatcatcatcatcttcttcttcttcttcttcttcttcttcttcttcttcttcttcttcttcttcttcttcttcctcttcttcctcttcttcctcttcttcttcttcttcttcttcttcttcttcttcttcttcttcttcttcttcttcttcttcttcttcttcttctttttgttaacgatgtggactaatggtgtgagattaggccctcagacttgatcctcatacacctccaccaatcgttcattaagatttgtccaaggcttaataggaagggctgaactgagagtcatatagccctatggagtaaggtataccaagtattgagggaggctggagagatggtttagtggctaagagcattatcttaaaatagacaaattctttctttttaaaaagaagtattaagtacccccatgccccttactctccgcaccgaattggctggggtaggtgtatgtttttctctgctatgcatggatccagctttcctcggtagaactctttccacgtctggaaaatgaggatactctaattaggtatccaagatttctgctaccattttctctatttctggatggtaggaatggagtagaaaatgcaaaaatcagagttaggatgagacaggcacatatacccaagtggggcacagaagacaggagggcgtaggcaagattgcacgggccggatttaggaacgcgtttcaaccccagacctgcctggaaagagagcgatccctaaagtagtaaagcccaggtgactttggtaggatgaagttgggggagtagggtcgcccgctcaagctctcaaaacggaccccgccccctttccagcaaatcatagccttcctgcccaggatgcccagcagccactgctaaacagcgcactgcaaccgaaccctatctgaccccacctcttcaaccgcccagcacaatttttcattgtttattggcttctgtaactgtcagtcagagaatcctcgtatccgttggctgtcccctacctactcttctttcccttgtaatctggtctctttgggcattgcacgcctcccagagctaatttctttcttcgattggatagtcggaatgccacttttcagagtgccacgctctgattggctgagcgcggcaggactctcgcagttaccaggcagcgggctagactgaggctagttaccacgtcagtgagctgacagggaaggtagccggcaccaccgagcgtcccggcccacttactccagcctgcagtgaggtctcaccctgaagttagggttgccttccagaagacaggatccttcccttctctcactcgccgccggcgccgggagagcggccgggagacgcctccggggccaggctggacatgagctgcggctgccgccggttctgggactaggccccgccattttggatccgctgacaggtcagcgaagtctcttcttagagttccagcgtcgtgagggcctcctgacgttgccatcaagaataaggaggaagggtccttcggttgggcgaagcggcctgggccatgggcttagtgggaagaagtaaacccagaggactgatgtgagagggagttgggaggtgtgcaggggccaaaggtcagacccttgtccccgaggggtgtttcagctccacctgtgactcggtggatgctagaatctgttttttgtttttgtttgtttgtttgtttgtttgttttccctaggcataatctggcctgcagctcttctttttcagacccttctgcaccctaaagtcctcaacatctgaaagcaaaattaaggatggtttcagggtttagagagtgaatcttttcagattctgtacatctgtcacttcggggtgactgcgtcctagcacaactgaagcgccccattaatcctgaaagatgagccagctcagtttggattaggtagtcagaaggcatagaagactggaggcagccgcctgagaacctggcctgtaagatcttgcttttacaggatagctcagctgtcaccaggggtctgcatgtaaacacctttctttctttttgagtcaggttctttctgtgtagctctggtttttctggaactcactatgtagaccaggctggccttggatttacaaagatccacctccttctgccttaaactctttaggtgtgtgttatgggtaggcatttacccactgtaactcccttctttttaaggatatgaggtttgatcccaaggcagccactcttttgtgacacatttgattgagagttaagaggtactgataaggcttggtcctggtggtctatttatttttagtaggtgaaaaatcatgaaaagggctggagggagacgtagctggttgagtgtttgccttgcatgtatggagtccttgagttcagtccctagcacttcataaactgggcatgttggtccacatctgtaattattccctacttgggagatggaaacacgagggttagccctgacattcaaggttatcctcagctacttcttgagttagaggccagcctgggccaagtgagacactgtctttagcaaagagacaagttatgagagttgttctgctccttgtggtagggtcagggaaacagagtgaatggtagggcacaacccgaaagagtgtagtttatggcccagtagtgacctttgacattgctgtgtcataaactggtgaagtccttcgaaggtaaagagtacgttagagatgagagacaatgtagtgtttcctgagtgcagaagctcatatcaagaaccctaggtacaagtaagcctcatggagtatataaacgggaaaacctgctctgggatcgctcagtttacacagagtcttgcagtagtggggatgggaccctagggtcccatatggtatagtcaggcagtctaccaccgagctatacccagagctagtgcgctctctctctctctctctcagttgtcctgactggtctagaatttgctctgtagcccttgaacttgtgatccttcctgagctgctgggtttacaggcctacagtcctagatcttcctgtatatttctgaaaagtagtgacatatgctaggtgtagtgacagacatttgtaatctcagtactttcaggaagtccttcctatgaggaaggacattttgagtttaagaccagtcttcctacataacgagggccaaaaaaaaaaaaaaaaaaaaaaaaaaaaaaagccaagttaaaagtaagagtgtgcctaattccttttagcagtgatggggcccagcatgtgccgtccatccctggggttagtgtagtgtgtggttagcctttgtgtcctggtctggcccggggagtcagctgtacatttgcatggtgagtagtgacaaggtggggcactcttatcaggtattggaagacagatcatctaaagatgttactacttgaaccaagtttctcttacttaattctctctgccctcttaagaatggctgtgttagactatgtaacctgtgtgtgtgtatgtgtataagagaagtaatagtgtttatggtttatttgtatagatgtaaaacaaatgggtgggaatggtacagaacactgttttgttttgttttgttttgttttttgtttttattgttgtttggggggggtatcttttcaacacagggtctctctgtgtagccctggctggcctggaacttgatttgtagactaggctggccttgaactcacagagatctgcctgcttctgcctccccagtgctggaattaaaggcatgcaccaccactgccctgctaatagtgggttttgtaggatgcagaatctagacagtagttaatttgacaggtttcagaatggtagcccagcaaacacccaggttaggtgcctataactctgccaagttgaaagcgctctgcataattggcagtctcttgataggtagtctgacagcatcttttcagtttttggcctaaaggtgactacagagacttcagagaaaaatcttttttttttttttttttttttgtacttaagtcattttctgagctggtggtatatctcagtgataaaggatttacctagatgtgagaggaggccctggatttgatcgtcagtgatgtggggcagaaatgtaaatttctacataggaataattccactaacataaatttctttaaggttgtacttaaacttcttttactagtgtctgtatgttctagtcttaatggtgatgttcattggcacagtaggaattaaagttgtggacacattttagtagctggttgagtttcagctcaacacagtctttccctcccctgtgttctagaagtcaggatgactgctgctttaaaataatcacactcagtgataggttgtttattctagctgcagtgggcagctagagaggaagaaaacatagttcttgcttgtgaggagatactatttataaacagcatctggaaaggccattgattgatcacattctagtgactgagtgtggctgattagcgtgattggatgttgggttcatggtggggttgggtcgaagggagaaggagagattcattttacctttatgctggaaaagctctgaaataaataataaattgttgttaatcttttattgctcctcttttgtaacatttcacctgcatttatttaactaaaggaagatacagtagagtggaatgctgcactagaactccgctagcagtggaaatggtcatgaaagtgatgacttattcccaataatagtggatgtgatcatagaagcaatagtataaattgagggagtgtgagagcaagccttataaacaaggactataagttcgaatgcacgtcaggtagctactgttagtgcctgaagttagtcttgggagtggagggtagtagagcctgtgatatgcaggccctggttggaaggggcagctgcttcttactccgcaggtggttactgtttgaggacctaagcaagggtgactagccttcctgttctttagtatatgatgatccctcagtgggaagataggcaggctgtgtgggactgtcactgctgccccccagtgtgccatcactcaagccggtttctttgttccactctgccgctggtcacctaatgtcctgggtgttctgagtggttagtgatgtgggatagagagaagctttgtttcgttttcatctctaagatggcagctttggacaggtcagtggcttaccctacatacggttctagagatcgtctcagcagtcttcacaaaggaggagatggcgtccagagctaaggtacactggtcacctgactagcaggtttgagaggattttccagccgtggctggtcagatcagagtagcagctttttcttgattctactttaactcccactctttgtgtaattttcttgtgtttagtaaggtttttgtatgttcttcctccatattggtagtgcattttgattgcatgtatgtgtgtgctagtgtgtctggtgcaggtggaagttagaagagggagttgaatcccctggaactggagatacaaatgattgtgaaccacagtgtgggtgctggggacactggggaccaaacctgggtcttctgtaggagcaacaggtgatccatctctccagcccctcatttttttgagagagggtctcaactgtgcagcccagactggccttgtgcttgtggttttccagccttggcctcccagtgctgggaatacaggtgtgtagcgctgtccacgctgaggttggttaaaaagcgctgtggacacagtgttatgtgctggccaaagagatgtgctcatactgtgtaggagagtgagttagctgaggacgactcttgaggagacactgtcataaaaacagtgttcaggagatgttggcaacgttcagtgccatgctgggtactcccagcacacccaagcgcaagcgtcttcattttgcggtggagaattgtaggattttgtatggttttgttttgttttgttttgttttgcttttggacaagatctcaatgtgtagcccaagctagctctgaatacttaattctcccatctaattaccacatctagctactgtggaaaactgtaaagcaaggctcagaaagattaggaaacttggttaagagttataagtttgtggtacagtgcttagttaaccttcatgtagccctgtgtgcagtctccaacatgggatgagaggggggaaaagcaagaaagcaagaaagcaaatgcctgactgtaatcagtcaactagaagtagggaacacagtcaagtctgtcttgcataactctactattgacttttaaaaattttttttggtcctggaacttgctttgtagactaagctagaactcacagagatctgcctgccgctgcctcccaagtgctgagattaaaagtgggagccactacatctggctcaactattgacttttaatgtgaaatgagcaagagtttacaaaaatggacaagaggaaagctgaacattcattcagcacagaatggggtagcatttcagaggcacagagggagcaaaccatgacctggagcttggtgtgtttgcacatctgtacatcccatcaccacttgggacacttgaggcacgaaaatttgagtttcaggctctctgggttatacagcaagatcctcattaaaaaacaaacaaaataccaaccaagactaccacccagagtgagtttgcatttgcccaccctctgccttactagtctcaccacccttacccttgccagcttttgtttctctgagaactagacccagaagtagaattgctgagatgaagaataagaagttctttaacttggcatgatgatatcgaattgttattcaaacagattgtatctgtttagatactctctagccatttgatttttactaaagtatggtcagatttaaatttcatcattattattgttttgtatttttgagatagtatcttattctatagttagtccagtttgttttataactcattatgtagcccaagctggccttgaacccctgacagacctcttgccccagcctcctaattgctgggattacatttcattattataaaattattatctgttgtcattattactattatggaggtctaaaatggtttctcactataatctttttaaatttaatattttaaacaggatctcactctgttgttctgattaacctagaacttactgtgtaagtcagattggctttaaactcactgaaatctgcttgcctttgcttctgaagtgctgagatcaaaggtgtgcatcactatccctggtttattataatctgctcattttgctgattataaatgaagctaataatctttactattaatttgttatttgtattttcatgaagtgcatgttctactcatatttcttgctaactttttctattttttttctttttttacttcagttttttgagatagggtttctctgtgtaacagccctgcctgtcctggccttgatttatagaccaggctggctttgaatttacagagatcttcctacctctgcctcctgagtgctgggattaaagatgtgtgccaccatgccaaaggctaactctttccattttcatgtgtgtatggtgttgtatgcatgtttccgtgtttgtgcatgtgcacatgtatgtgtgtgtatgtgtaattccaaggttgatattcataatctataatcttccatattgttactaaggcagggtttcttaatcaaatctagagcttgcctatagtattgctagccatcttgctttaagaatcctatttctaagccgggcactttaatctcagcactcgggaggcagaggcacacggatttctgagttcgaggccagcctgatctaaagtgagttccaggacagccagggccacagagaaaccctgtctcgaaaaaaaccaaaaaaacaacaacaacaaataaatcctgtttctgccctctgaggctggagttacaggtgggttaccatgcccacctggcatttatgtggagtcaggacatttgaactctggacttcacacttgcatggcaagtgcttcaagtacctatccatttcctgaggcttctcttgctaatgaaaaaaattacaattatttaccttgtgtatttgtgtgtatgtgccatggtgtgaatgtggaggtcagaggacatcttcagaagctggttctcagggttgactgtgtaagccttgggcatcacacttgggttgtcagggttggcagcttgaagcactccttaagggtaaatacccaggagtgaaagagcaggcgatctgttcttagtgtattgagaacctccatattgccttctatgtagctagactagtttacacactaccagcaaggcataaggaagaactcccttttgaccacattcttatcagcatttttcattatttgttttcttaatgactgcccttctgattggaggaagatgattctcagtgttgatttgcgttctctgatgactggtaaaggtgaacatttttcttaggcttattggccacttgtagttcatcctttgagaagtgtctgcccacttactgattggattgtttgagaccgtttttccttctttgtgcgtgagcatgtatgctgtacctgcttgtgtggtacataggcacaagtgcctttggagaggataggtcagggtcaagtgtccttctccagctctctccacctggctttttgggataagggtctttcactggatgggctcacctgtgtgaggagactggcttggccagcaagccctagggatcctcctgtccacttgcccagcacgcaggttacaggtacctgctgccatgccttttatttggcatcctttttattttacttgcattttatctgtgaatctgaactcagatcttcatgcttttctgactgtgccatctccctggctctgggctgtttatttcttgtatattttagatgtagtcttttgccagatgtttagctagtaaatattctcttctagtcgtaggctgtgtctttactcagttgactggttcctttgctgttcagagggttttctcaatgagctctcatctgtccgttattggcctcatttcttgtgtgacgagagccccgtcgaaagttcctgtatatacctctatcttgaactcttttcctctaacagagtttgaggctttatggtaaggttttggtttgtttggagttgggtgttttattttgttttgttttgtgggatataggagatggggttttagtttctttattctgtatgtggatatctggttggttttcttttattctgtatgatatctggttggttttcttttctctctcttcctcccttcccctccctccctcctgccagtcctccttccttcccttccctccttcttttctccctatctccttccttcctttctgtggataattggttggtttttcttttcttctcttctcttctattttcttttcttttcctttcttttttccctcccaagatagggtttctctgtgtagccctggcttactctatagatcaggctggcctcaaactcagagatctgcctgcctctgcctctcaaggctgacttgtcactgtgttgaacttggtggttttcaggactttcagtttttgtataagaaatcttacaaaaaacatgcaaatttagcttctttaagaagttcattttatgtgtgtgggtgttttacatacatgtatatataccatgactacctagtgcccttggaggccagaagagggtgccacatccccagttatagatggttgttaactgccacatgggtgctgggaatcaaacctgtgtcctctgaacaaggagcctgtgctgtgacctgccaagccagctttccagcactccaagctgaaagcaggtttctcctcagtgactttctgtgttggagtgttttttttttttttaaagatttatttatttatttatttatttatttatttattatatataagtacactgtagctgttttcagacaccccagaagcgggcatcagatctcattatggatggttgtgagccatcatgtggttgctgggatatgaactcaggacctttggaagagcagtcagtgctcttaaaccgctgagccatctctccagccctgtttttgttttgttttgttttttatactattgaactgtaaaatttctcaatggaagtaatagatctcttattactagtgtttaatttatattggtaatatgctaaaatattcttctgaaagaaatcaaagcagtacagataaaggtttgattataccctaatttccaagcactttctctttagatagcagactgtgagtttgtatatacttgcctagaccctttatttacttggattaaaattaaaacaactgctgggcatagtggctcacacctttagtcccagcactgggagacagaatcaagtggatctcttagtttaaggccagcctggtctacagagtgagttctaggacagccaggctatacagagaaactctgtctcaaaaaaaccgaacaaaacaaaaaatttaaatttatttatttaattttatgtgtatgagtgttttgcctacatgtctgtctgtgtaccttgtgtgcttatggacggctgtgagccactgtggggtcctgggagctgaatcatttctccagctcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagtcactacatagttaaggctggcttcttcacgagtactagtgtttcttgggttaactatactgtctctaaggagtttttaaacaatggaaagtggcaaatttgttgttacatacttctaggatatactctctgctaagaagatattttctgggaaaaagtgtcgtgtgtctaggttgtctccagtttgcgtttgtgaaagatgacttcaccctttctgctttgtctgcctgtacctactgtggggcttagattccaggtgctcatcaccatgcctgtcttctgtaagtggggctgggcactgaacttagagctttgtgcgtgctaggcaagcactctaccatatgaactacatccctagtcttccaagagaaattccgtttttcaatattttcaccttgagaaataattaaataagtgctattctgggcagcaaagacaatcctgtagtagttccttcgggagcatttacaataataaattagttcctctgcctcagcctgtctcgtggctagaattacaggtgtataccaccatacatggctgtcatttaaataatcccccatcttggggttgaagagattgctcattggttaagagaactggttgctcttctacaggatccaggtttgatttccagcacccacatggtggctcatatacttgcaggctcaacatttgtatacatgaaatagaagggaaaaggcaggcgttgccatgtgagcctttaatcccggcacttgggatggatctctgagtttgaggccaacctggtctacagagtgagttctaagacaaccagggctgcacacagaggaaaccctgtttcaaaatgaaaccaatcaaccaatcaaccaaccaaccaaacagctgtgaaaaggaaaaatattaaccaatcttttctcttcaactgttctggtaggtttgtcaggatggtggataagaatatttacatcattcaaggaagaaattaacattgttgttggtgccatcaaacgaaatgcccgatggagcacccatataccactggtaagtggggaatgggcagacaggtcactgaattatggacatctcatccttggttaaaatgatcaactaaggggggagggaggagtgtgtgtgtgtgtgtgtgtgtgtgtatgtgtatgtgtgtatgtgtgtgtgtgtgtgcatgatgaaagaagaaaggggatgtaaaaggaaaggaataggtcctgtggtggattgaataggtatgacctctaagactcatatgttctaatgcttggctcatagggagtagcccaattaggaggtatggcttagttggagtaggtgtggccttgttgtaggaaatatgtcattgtggagtgtctcactgtgtgagactttgaggtcttatagaagctcaagctacggccagtgtgacagtcttctgctgcctgtggatagaggtatagagctcttggttcctccagcaccttgcttgcctgcacaataaccatgcttcccaccatgataataatggacttaactttggaaactgtaagccagccccaatgaaatgttttcttttataagagttgccctgattgtctcttcacatcagtgaaaccctaataagacaggtcctgatagaaggagggagaaaagagaacaatagaatccatgtgacatgaaagcacagagggaacaagctggctgtagtggtatattcctgtaatcctagcacttagaagtagaagcaaaaggatcatacattcaaggctagctttggctacatagtacgttcaaagccaacctgagatgtttgagaccctgtgttaaaaaccaaaaataaaggagtgggtgggtgtttaggtctgtaaaaatggctctgtagaaattttccagtagaccaaatttggttcggagtactcatattgggcaactcacaactctatcttcagttctgggtgatcctataccctcttctagcctccttgggtacctatacactatactgtatactcatgaagacatacacacaaacacaataaaaataaatcttaaaagggcataggctagggagatggctagcagttaaacacccttgctgcacaagcaataggcctagaggttggatccccagcactcatgtgaaggattagtggttatctagagctggtgaagtgactgagtgggtaaagcttgtaatctgagccttgaaaggcagaggcaggaatacctggagcaagctagctagtagactagtcatactagtaagctctggggttgtttgagagcttagcctctgaggataaggtgggagaatgatggaggtagatgcccaatgttaacttcaggcctccacatgtctgtgaacatgtatatatacacatgcataccacacacatatccaaatggaaaagaagaattaaaaataacaaccataaaaacagtggctggtaagatggcttagtggatgaaatcctgataacctgagtttgatccctgaaacctacattaaaaataagcagagaaacagttctacaaagttctcctctgacttcgacatgtgcatgtgaagtacacatattatacatgataaaaaaacaaaccaagcccaaaagaaagagaaggcagtctacttgaggggagtagaggatcagctagagtggctaggaggatgggagagggcagtggggattaatgtgtaggcgaggctggctgtctttaaactgatcttgcccccatttcccaagtgttaagattgcaggaatgcatccccaccaccctctagttgaaatccgttattttgtaggctatctgaaaaatatttgcaggctaacaacaacctagggctggcaaggtgggagagtggctaaaacctaatgtatgaatccctgttccattgctgtgaagagacttcatgaccaaagcaggtcttaggaaagaaagcatttaatattgggtgtatagttagtctgttatcatggtggtctacagagtgagcagacatggtagcagacttagttctagagcagtggctgagggctacatcctggtccttaggcagcagacagagagaaactgcacattttcattcagactccatacctgaccacctgggttcaagtcatggaactcacatggtggaagaaaagaactgactcccacaggttgtcatctgactactatatgagtgtgcctttacatataggtacacacaaataaaatacaggtgaaaaaactcccccattaaaacagtagtcatgtttctggtaataatggtaataatgaaagtaatcggaatccagaagtgttattggtatgcaagaacacttgtgttttttgttttattccagctggcatcagatttacaggtttaacccacaagatgtccacattgtatacacacacacacatgtatagaatgtatatatacatgaagtgaaaatagagacacattattaagaaagggaaaccactcctttttggagacaggtttctctgtgcagtcctggatatcctagaacttgctttgttggcctcaaactcacagaaatccacctgcctctgcctctcaagtgctgagattagaggtgtgcgccacgcccagcactcttgatactgggagtgggctggtgcattagtcacttgtctgctgctgtgacagagcactaagcagggatgtagacgtggctcactgtttcagaacacttgttgcttttcagaggacccagattgattcctaggacccacaccagttccagggaatctaatgcccacttttggtctcatgggcactaggcacatgtgtgcacagatatacacgcaggcaaaatacccatacatacaatagaagtttaaaacagaaaagcaaaaaaacccaaaactccatgtctagggctggagagatggctcaggggttaagagtactgcctgctcttccagaggacctggctgagattcctagcacccatatggaggcttacaactgtctgtaactccaatttcaggaatccaatactcttttcttttaaaattaaaaaaaaaacccctatttatgtaaatggatattttgtctgcttctgtgtctctatgtgccacatatgcctgatatttttgtaaattaaattgacatttgggactttagcatacctggaaacattagaaagattaccgtctatgataagaagaaaacacatttcttgggattggagttagagatggttttgaagtgccctgtggatggccgagccatctctccagtccctgattcctcttttgacttgtgggcactgagggcacaaacagtgcacatacatacatgcaagcaagacacgttgtcacacacaatgtaaaccaaaacaaaggagactcaggaaggagtctcctttgtcttacttcctgggaaagagttccatatggtggggttggagtgtggcaatacatgaccagagcaagaggctaagagagagatttttagctacaagcatgaagcagagagtgggacatgaattctcagaacctagtgactaacttcctgtaacactatcttcccaaacagtgctactaactctggaccaccggtttaaatatctgagcttttgagacattctcagtcaaatcctcacaggtagtgagctagagaaagctctcaaaagctttatttgaaaatttaaaaatgtttatttatctttattttatgtgaattggtgtctttcttgcctgcatgtatttctgtatgaaagttccaggtcccctgaacctggagtaacaaacaattgtgagctgtcacagctgagaattgaacgcaggtcctctggatgagtagccagtgctcttttttttttttttttttttttttttagttttttttttttttaagatttatttatttattatatgtaagtacactgtagctgtcttcagacactccagaagagggcgtcagatcttgttacagatggttgtgagccaccatgtggttgctgggatttgaactctggaccttcagaagagcagtcgggtgctcttacccactgagccatctcaccagccctagccagtgctcttaactgtgagccagctcttcagtcccacctcatttttataattttttgttttgttttgtttgtctgagacatggtttctccatgtagctttgattgtcctggaactcattcagtagaccaggctggccctgaactcagagatctgcctgcttttgtttcccaggtgctggaaataaaagagtgtggcatggccacccagttataaatctattttttatttatgtatatgtatatatatgtgtgtgtgtacatgcccacacatacgcatgcccatgtgcatacagtgcttgaagtacctgaggaggccagaggaaggtgtccgctcttctagagctggagctacaggtagttataagcagctggatgtgggtgctgggagtccaactcagctgctgtactgtttctctgtctcctttataaattaagttcatatttgggactactttagaattcctagaaacaccagaaagacttaaatttcctagggctaagtaatcaaattcattcaaattaggttagttattgataatacataaagtacagctgggtgatcccaattctatgcagtggagtctgcaggcttccacatatggagcagaccttatcttacaatcagatgggtaagaaacttagttattattaggtctcaggaagtccatatgcccataatgagctcaggctgacctatagaaggatttctggctattagataaaagccagcattcttaaggagtttataaagtgatttacttgttttggtttgttttgatttggtttggttttcgtccccaaaaggagctccttcccccaactactcccctttctcctatactctgcatggtttgcccacccctgctatcctaagctcccgtgctctcttgctgtgtctgttttgctatctccactattctctcccatcctccagcaccctagccctgccatgtccagtatgtttctcttttctctggctctggactcttccagatgtctatggatattcactttctcttattcaaatacaaactctcctcctcaaagagtggttatgtctgcagtttctttattgtacctctcacatacagttataaagttagcttgttgttgtgtgtatgtatgtatatgtgtgtgtgtgtgtgtatatatatatatacacatacatacacacatatgtattgtgtatctatgtatatttaatggaattggtgtaaaaaattttggcacaattataaaaacaagtttagtgctttctgactagcattttacccactaacccatctctctagcccccctaattaatatttttgaattgacataggaacatttcaaacatactcaccaaatagtttatatattcttatcaagttagaaagttcaaatatatttttatcatgtgtatatatggaataaaagtacagacatgtggatttgtatatacaaacacttagataaataatgttggccatttttttaaatgtcagtccctttttgtgtgagaaaatttaaaacaccctggggcttctagatatgtaatcaggcagacaaataaaacatatactgatagtacatcataaagaaatttatttaaaaataattctgagatggcttagagtgtagagttgcctgccactctgcctggtgacccaaccttgatccccagaacgcagtggaaggagagaagcaagtcctgcaggctgggctcaaggcatgagtggctgtgtgcatacatgcatgtacaaaacaaagaagtgctctaaaaacattctttgctatacgtataatcttactgtttattaaagattaaagcagatttacatactaatgaggtctatgtacttatatattcttacataaagaattaaaccatggctgagtctttggtacaggaggatgtagaacgttgtcactgctcttcagagttgatagttattttgattttattttgtaatttttaatgctgacagtgcaattttgcataaatatgtagtacacaaaggcagaagaagtatgttaaggaacatttcagaaattgttggaaatccttttgtcatcttaagccaagattcatttcatgatcttttttttcttttttctggtttttcaaaatagtcctggctggctggccttactttgtagaccaggctggcctcgaactcagatacaactgcctctgtttctggagtgctgggactaaaggggtgctggctcgtgatttttttttttttttaaatgaagcttgttagtaacacaaacggcaattttaaaaccaaacattctaaaatataatacaaagacatactaatttgatacctacatcctgaggagtgacagtagaaaatatttttaaagtctttttttccataactaaacttacattatgcttctagaagggcagaacattttgtatgtacagtgaaagtactgcagctcatcaaacatcccggtttgaaatctgaggtgatgtgtttcaggcatgctcattgtaatgcaaggtgtggcatgtgcaatgcaaagtatatgctgattagagcagtggctgccagtggtgaagtagggaaaggcagcttgggggatagagctgaaacaccatgcattcatcattctgggattttgaattaaaatttggtcattctgtattcagaaacattgctgttgctaaaaacttcaagacctctcacatttagttaggtgactcccatatgggatgtgattcacaggagaagctgggttgaggccgaccatggcgtgccacctccaccctatatgcacatgcatacaaagtaaataaactgtaagaaatattaaagagaataaaagaaactgggttctaggctagcactgaagaacttattttcggtaaactcccagtgcctctgaaagaagagagtaaggagctatggctaagtttcttctctcagagggaaacttactagatgttctggttggatttagagaaagagttttgatcttttgttttctctttcctatcttggactaatcatttttttcttgacctatgatttcctaggatgaagaacgggatccccttctgcacagtttcagtaacctgaaagaggtcttaaacagtgtgacaggtaaggcccacgtgtaggaaacagtgtaacgggaggaatacatgaatttgatttactgcagggacagataaaattttcatataacagatcatatgggacaaataaatggaacaaagacaacaagaccatatagtaaacacttcaggctttacaaaggttgtgtgcagctcagctgctcacctctgcctgttgagctcactagtcatagataagatgtataggagaagtgtataatttcttttttaaaaagtagcgagtcagatttggctcctgggtaaagcttgccaatcttttagtcttcctatgttctccggtcctttgatttttattttcctagtcaaatcaactttatgtaatactcacatttagagttttcaaagccgcttccatatttattatcctcgctaagttttccccaggtgtgtgaagaaggcaatcataatgttgtctccttttatgaaagaaagcaaatcgatgtagctaaagggctagtggtgtagctcagtttgtagagtgttcatctctcacaaataagccctagatgcagtcctgatgcccatcaaactgggtatgggatgcccatatcagcatggacctgtaatctcaggtcttgagaggagtcaagaggttgggaaattcaatatcatcctttagctacatactagttttaggccagcctaagctgtaagaagagacctatctcaaatgaaacaggcagatagacagacagacagacagacaaataaacaaacgatacacctaaagtgacttagctaatttattctcagaggtggaatggagtaagttttaggctgctgacacctggtttagtgctcttttccatgttttccattgccctggtacatttaattagaggagactgtatgtataaaaggtcttttattgtgtgtgggagaagagggtaataaaaggaaaacaatcagttcctgtgagtttgttgttgttagttattgttcttattttactcttgtggttttcccccaatacagattgaaagggagtgtcttagaactgtggttttgtaatgtagccctggaatcctgttagctggtggtatatctcagaccataattgaatagtatttagacttcaacaaactaaacaaacaataaatgaaaaatgtcctcattttatgagaaacacaagagaaagtttggagaacaattcttagttgttttcccaagatggaagtcactataaaggaacaccttttactttgaaaggctttagatctataagccaggtctggtggctaacacctgtaatctaagcactcaggaggctgagacaggaataccatgagattgaggccagcctgggccacatagtgaagaataaggagcatacacagggctgaggcttccttcctctgttactttgaatacacagtacaagggactttgtgtatatactgagttccacgagagtctgggctataaaatgaggccctgtcctaaacaagtaagcaaataaacaatacaggcatggtggtacaggcctagggcaggaggattgaatttttttttttttttttttagtttttcgagacagggtttctctttagtcctggctgtcctggaactcactttgtagaccaggctggcctcgaactcagaaatccgcctgcctctgcctcccaagtgctgggattaaaggcgtgtcccaccgcttggctaggattgaaaatttaagacctgtttaggctgtagaatgagttcagggccagcagagactctgtcttaaaacaaaaaaaaaaaacaaaaaaaaaatcaaatggatcagagatacagctcaatggcagtacatttgcctcacattcacgagatcctgggttcaatccctagtggcaaacaaacaaacaaacaaaccaaaaagaatgatcttgaaacatcaaatataggcagtggcttagtggttaacccgagttctattcccaatactcatgtcaacaagcagctcaggtcacatggaattcttgagtgacgactttaccagttctggctcaaaactttcccttttttttggtaagcatagaaacttttgcatatatacaacacacgtacatttcctgtctaaggaaataaccgtgtctccagtgaagttggttgagtccaaaccacttactctcacagatgtatctttagaaaatatttgtgtcaggagtcacacaaactgggatgactaaataccctacaattaaaagtacagaatttttatatttttattttgactaaaaaaatgtcagtggtggggacctgactgttccctcagtcattacaggctcctggggtgcttcctgtttcaggaagttcttctgaaagcagaggtatgctctctaggactgtgagtggttttttaaggggcaaagaaagtgttttatggttccataactctgaaattgtatactgaattgtatactttataaggatagatttcatagtatgtgaattctagctcaaaacttgttttttaaactgtagtcagcgtcctgctgtgctccccagctgtgctcctcaggttcgctttggattctggactcaagtgatgctgtgctaagttcctcagtggctgggactgtgggtgtggaccaccccgcttcatagttcatttaaaacaaatcaaacgtaagctaaaacactgatgagttcacatgtctcagggctcagaatgctggagggaagcctttgagtgtagtcatggccgagctttggacccattgcccagcaaaggcagcataaggctctgttcagcctcttggcccactttgtccttttatgtctctctcattaactcaaggaagcacatggcttttatatttaaatttattcaagctgtaatctttgacatttgagttagcttttagtacagttttgcatttatagtaatatatattatgtattttctctatccccaaagaatcccttttaatcttttccggatgcaaatttcaggctgtcttgtcccatctcccctctcttgctctctttcccctccccccacagagtatgtttgatcaggtgtggcaggaatatccactgtcaagctgcgccctttatattagtcaatattatccttctcccccctccctgtctgtctgctcctttgggctttcccagttgatttataattttggaattctcatcggagtctgtaatacagtttgttcattatttaaccaaaacctgtttaatgagcagagagaggcaatgtaaatgttagacatgttgcagtgatgtacctttgtgcttcttagagctggtgggtagttaactctgtgctgcctgcagggctgggggtatcctgggcttaggggctaaagggccactgtgggagtgggagtgggagtggcccttttgcccctatgtgacctttaaatctgcccaaacactgccatagcttcacattccagtaatacatttccttttaccattctagtaatcttatggggctctggcaaaatactagagttatgctcaaactagaacctgtggtaagatctgtggcatggaatgggccgtaacagaaaggtcaggtgtcagggcttctggtactgctcttggttttaggtctgaaaaaagatgacagttgagaacagtgattctagctgacgtggtttgtgatctttgggtaattttttgccagactaggtaagtctttgtaagtcttaataccttcatggaatacttttatggaatgaattttattcagttatgatttgtggtgtttggctgtgcttatttgtatccacatttaggttgtcctttttcttggtcttcaagcatctcctctgtatgtttgtgttcatgtgtgtccacaaattagtaaattacatctacaaagggattctttgctagaaaaatcttggattttcatcagaaagaaatattctaaaatttataacaaaaatttcttacaagatttcttttttgaggaagacttctcatatatatatgtgtgtgtgtgtaaatatatatctccaaatatatatatgtatatatatataaaccatatatgcatgtaatatatgaatgtatgtatataaaataactgagagagcgtgagaaccgaggtgtttgtgtatggtgaaccaaatgttgtgtttttgtagcctctggtgttacaagactaatggctgtcaaaccactctgaaacgacttgagatctctgatctgttccctataataatgcttccaaggtgtggagaggatgacagtgaatgaggacagctggcggccaccttccccccttctctcactctttgacttggtctcactatttatttagcacagggttattttcccatgtgcttggttacaggtttctgttgccatgtctagcttgctgccatttttgttgttgttgttgttgttgatctgagtaacaagtcaaggagaatgaataaaggttgtgtttttcaaggtggctttctcatgtaaagctgttataggccacaatttagatgtttctaaaggcttcagtggattgcatagaatacatctcagggataggctatctctttactgagctaactgggatagcaggaactctgacatacttgagttttaagagggagaggcaggtgcctggagaaagtgaatgttggagtttatttaaatatagtttatcttggacaaacacacctgtagggtacagcctgcctcaagcttgctgaattcagcatctgagcaggaggtttgagtacatctaccctccagaggtttcagagaacatttaaacagagtctggaagccaatctgggaggaactatgacttaacacctgtctggcccagacctcttagaaatagctgcctaggtagaaaagagcttctcaaggatgcctgattaccctaggagtaagtgtcaggaaaaggattgaacacattatattagatcactagatttatttcctgtagagattgaatgtatatattcattttttctataggtgtctctagtttggggaatagcagagtaatagatcattagatagcccctgaagagccatgagtgagccattgactttccttcacttggaactgaagtaaactttttgttttgctttgttttgaggcagggtctcactatgtaggtgtggctggtggaattcactatgtagatcaggctaccctggaatgcagatgtctttctacctctgtcttctgagtgctgagattaaacgtgtatatcactatgtctggcaagaattgaacttttaaaatttcaaggtataacagaaaactatttttgtttctttttagaggaaattaaaagaaccaagtttgtcagataaatttatataaatgactgaatattggaaggggcaaagttggccaaatatatgtatttcctataccacttatttactttcttggtttataataaacataagatgatatatataaatgtagtatatatttacatgcatacatacatacatacacacacagagacaaaacataagattgatgagcatgttagagtgtggcttgattactgggcacagtaactatatttccagctgtttgcgaagtagaggcaggattgctgaggctcagcagttcaaatcatgatggagcaacaaaatgagaccttgttaaaaaaaggttacaagatcctgcctcaaaattaaggtgaagaataatagaagatggccaatggtgacctttggttcaatgatcatgagctcatgtagacacaaacatgcatacatatgatggggtaataaagactcttgagactagatagctgggtgtggtggtgcgtgcctgttataacatgggagactgacgcggctgcatcatgagtttgagaccagcctggattatacaggtccaggaagggatgagcatagtgagaccctgtctccgaaggaggaagggaaagggaaggagagggttctgtatagcgttgcttcttggggtacactctgcctttactcgcggtaatacccagtcacacagcctacagaagcaagtctgcctggcaggaatatttgttttttgtggttttttactatatctaattataaagggggaataataataataataatacaaagggtattgttaatatattagttctcaaactaaaaaaaataaaaataaaaataaaaggtagcagaggcacctgagcacttcctagcatagtctgtaggcactgtagcgggatggcctcaggtgctaggtgtcagactccttagggttgcttttattgcctttgctgccttctttttttttcagactttatcccagtctaccctccgactattccacacccataactcctttcctccatctccacgaggatgtccccaacccccatcccccagacctccccactccctgggcctcagtctcttgagggttaggtacatcttctctgttctttagcactgtttctctctcgtgagggctgagtgtcgccctgggtatatgcccaacttgctgtgtcagcagtcagtcgcataaaggagggaaagccagctgctcttttgtttttaaccaggaggtagtaaactctttcttctacacccactcaaactctgggcaaatgccaaaaggatttacagaaagccaaatgtttgaaatccaatcaatgtgtagttttaagcaggaaagataatgaaaggtttgttttaactctacccttctctacctgcctcatgttcataggacggtaactaatcaccctagtttctgaaatagtatagggtatgtttgtggaaagaatgaatacctctctcctcctccttagaaccattaaaagagagttagatatatagcaaaatacaaaatagaaccctttagctcagaccactttagaaattcacggtaggtggtgagaagctctgacttgtttgtggtctcacttctgcctcaggaagtccacaggcagtgattccccttttctgtagcctttgtcttataacctctgggacttggatggacaagggctgctggatgccttctggctagcttctcatggaaagtctcttctggaacaccagccttctgttagccaccgctgccactgtaggtcatgttctgaagggctgccacatgtgcacagagcacactgacattcccttgtttcatgcttcctgagccattacttgtcagctgtggagttcacattattgcctccagtgtgaactgtgggtgttttggaaggagtctgagagactgcatcagagggaaataaaccatcactgggttggagggaagagccagatgtgctgtaggaggaaggactttctgtcgtcacccatgcacttgcttccacatgttccatatcccggaaagcagcttaagaaatggaggataagggtagctggggacatgatgggataggcaaaggaccaagagggcttcagtgttatctaggattggccttggattgagaaaagtcctttaaaaataggaataaataagatttccctgatattggtgttttccattagttatttttgtttttaaataattaattggcagaaaaataaaacaaaactggaaaacacctcattccacatgaatgttctttttctttgaataaacagcaggtttaaggaaactggcacctgaggcggttaagagcactggctgctactgtgctctagagctcacctcccacactcagtcccctcatggccgctcacagctgtctgtaactcagtgccaggagatccatggcaccaagcactcacatggtgcacatatgtatctatgcaggcaaaatgcacatacacataaaaaataaaaataatcttaaaaaaaagctggcactaaattgacttaacaaaacaggaactgaggtgatatcatgactgtcttacagtgagctaaaataatattttcagattgcttcccatagtgaattatagtgtaacagtgaggtgtgtgacatctcttacgcaattttaattaatgaattatttttattgttactttgtatggatgtagagtgatttttttatacctttacctggattccagggaccaaatgcaggttgtcagagtttgcagcaagtgctctttaccgagcagctcgtttttccagctcacctcctaattactactttttattttattaaaactgttttaatttatatttatttagtagatcatagatagttatgattttctaactctatcattcattttgcatttactacttggcgttctctgtgaacagttgctttcctctttacctggagaataagccaaaaatttttccctagaaaggcatggtaaacctttaattcttggttttaataagtgttcaaaacagaaagttcatataaataatgaccattattgatgtcaaatttatttttttcttatttgacttataattagtcaatgctgataagtaatcaggtattactaatatttaagttgtttcaagcttgaccagtgaaaccatctttagactggttagttactttgttctattaacatgcctcttttgagtacttcatgctttctggtaaagcaggtaacattaatggagaggtgggaaaataaagtagaagctactggtgtatcatatgttagtaataaaggcaaatattactttatttcattcagagcctgggttatggtcatttggtaaagtgcttgccatgcaagtctgagtctctgagctcggatcctaggactcaggtagaaggctagacacagtggcgtggtcggtaatctcagctcgagatgtgggaacaggatgcctgggtggaagggccagccagtttagccagttggtgagcttcaggttcagtgagagactttttccagaaaataaagaagagatcaaggaagatacctagtataaacttccgatacacacacacacacacacacacacacacacacacacacacacacacgtgttaaaaaatagaaagaaaggaaggaggaaggaaagggttatagtcaagctgcgtttttgttgatgatactcataacagttagaagcctggcagagttaattccctgctcccagaactgttttggatttgcagtattatttcttggacaaggaatccaaaagagtgttgtcaggatgtccctcctactatttatttatcttctcctcctcttcctcttctaacccccttcctcctcctcttcttcctcccccttcttcctcctctccttccttctccccctcttcctcctcctctttttcttcctcttcctccttctcttcttcctccttctcttcctatttttttctcttcccccatcaccctcctctggtataaatctacatccgtggttcattgttagtactcactgtaagtaaacacattttatgaacagacctgatgactttggtgaaggatcctagttacctctgcccaggaaaaaaagtacttggctcagctcacctggacagagattgtagggaaaacatttgcagggaaaatggacttctgttgtcagaatccaaataaggctcattaatcctcccagttgagcaccagcttagcatcttaatcagtttcctttcagggtttaaagactcattctgttttctacattctatgaagaaaaaaatgaatagtgcctgctttgatggaattgttatataggtatggaatgggagatatttccagggttcttggtagactacaggctcaagtaataacataaaactggattgtgtgtggactaaggaagataagggaaatgtttatgttggtataatttttctccaaagaccagaggtaaagaggaagttggcttgtttctacaccagagattatttcacccctatttacctagttgatgtttttaagacatttttatcagaccaaccgatagtaatatgtagtttttggaatcatgctttgaaatttttgtttgtttgttttgttgtttattgagacgtatagtgcctaatgctggcctagaacttactctgtagcttaggtcagccttaaactcacggcaattctctaccttgtccttcccatgctggggtaacaggcttgtaccaccatgcccaaccagtaatttcaaacttgcaagaaagctgtaaaattaatactgatgtctcccatatgcccttttgctagttgattttattgtcttctttctcactatacagttattttttctaaattatttgagaaattaatcatatgcaccttgacacttcagtgtgtgtttcctaagaacaaagatatttcccttaatctaagtaaaatgatcaagtttaagaagtttaatgattcagtaatttaccattaatgtttgtctaagttaaggtttctattgctgtgataaagccccatgaccaaaagcaaattagggaggaaaggggttatttcatcttgcaactctgaggtcacattcatcattgcaagaatgatgaattattattttttttttaagatttatttatttattatatgtaagtacactgtagctgtcttcagacactccagaagagggagtcagatcatgttacagatggttgtgagccaccatgtggttgctgggatttgaacttcggaccttcggaagagcagtcgggtgctcttatccactgagccatctcaccagcccagaatgatgaattattaattcctgccttattcaaggcaggaacctggaggcaggagctgaagcagaggacatgaaagaatgtttcctattggcttgctcctggtggcttgctcagggccacacgcctaggggtagcattgcccacagtggactgggccttcccatatcaatcttaataaagaaaatgccacacagatttgctcccaggaaattctgtggaggcattttctcttaattgattttttctacccagttgacagaaagcaaccaggacagttgacacttgtcagtttgacccacaaacacattactgttaacttctccttccttccttgtccctaagatgccatatttatattaatatcacaatataaaacattccaactgtgtgggtgatcagagggagggggaaggggataggagttttcggaggggaaaccagaaaaggggataacatttgaaatgtaaataaagaaaatatctaataaaaataaattctagcttttaaagtcccacagtctttaaaaattcactttaaaatttcagtgtctctaaaatatccaaaaatatctggtagtagtggagcacaccttaatcccagcacttgagggggagaggcaggcagatctctgaatttgaagtcagtctggtctacagagtgaattcaggacagccagaactatatagagaaaccatgtccaataataatggtgatgataaataaaatatccaacatttccctaaaacgccacagttttcagagagactctgaaagttcacagtttctcaactgtgggctcctgtaaaataaaaaataagttacatgttttcttattccaagacttaagaaccaggatacagctacattgaaatcagagcaaaacttcaaattcaagtgtgcaaagttcagtgcttgatgtctgggacccagtcaaggtcctctgggctccacagaatcttgcctaagtctgcttctctagctctgtcatccacagcacatacagcttgtctcctaggcgaaggttggttctacgccacaattgctgctgtccttggtgttccttctgtggtattggcatcttcaaaatgatgcaactctgctgagccttcactaaaagcttcttctgagctctcttcagggactttgaccctgccactggctgccaagccttaccttctctccatgaccacttcatcgctgctgctttcactgcagctgagcctgcacattcacagtgttaagtctcagctattctcttcaatcttcaaaagcagtaccacctgggaaactcttaccaaggtcagcttccagctgtccactgaccctgaagagacactttccagaagagtttgcatcaataatactggtctcttcttaatcacagctgattcttcagccccaggtgaccattatcaattgtcccagcaaagcaaagatttcactctagttgttttggcctcttggttagtcacagcctcagataaccagaataacagattcttaattcaaaatatcagtttctcaaatagtctttaaggacctgtgaaaatttccattaaaatttcacaagccaggctccgttgtctgcaggctttgtttctaccatcatctcattaagctccaaacacgcattcagtggcttttctagcccaaagttctaaactcctccataatcaccccaaaacaacaagtttagttctgtcacgcagtgcctctcctggttctggtttatgtgttagttacatgtctatggctgtgataaaccgctgcaaccaaagcaatgtggggagaagagggttgtctttccttgcagctctcagtccatcattgagggaagtgagggcaggaacttagggcaggaaccaaacagaagctatggaggaagacttcttcctggtctgctcagccagagcaggtgctgcgtatactttccaggatcccaggggtggcattttaaacagtgggcaggctggcctcaaactaatagagattctcttgctctgtttcccaagtgtttgggattacatacgtgtgcctctacactggctatgacattgataatttctataatcacagataaggttcatagatctattgtccatctatttgttcttccctctcactttctctcattttttaatgtttattcataattagattcgggttatgttatttggcatgaatctacagatcactgctaatacagtaatgcttttatgttgtcatagccatagttgtcatttataagtgatactagttttaatcatctaagtattgcatggattctttattatatgggtactacttgctacttagaaccaataagccatttataggagtgaattttgagtagtcttttttttttttttttttggtgggcaggggagaggatctaatatagtcaagactagcttcaaacttacttcatagttgaggatgaccttatatttctgatcctcctgtttctgagtgtcgggattacaggcatgtaccacaaaacctgttttatgtattgctggggattgaacccaggactttttgcatgataagcaagcactttgccatttgaactaaatccttagcccctttgttttttttttttgtttgttttttttgtttgtttgtttgtttgtttgctctttggggagatttactatgctgttcaggctggttttgaactcatgatcctcctgccttagacttccaagtactgggattatcacagtacaccaacatacccagctgtaatgctgttcttttttgaggaaaataagttactgactgagcagcaaggttttataacactgttgttcttaaaacactgggcagaaccttacaaaatgttttgttgttgttgtttgtttgtttttaaacaaatgataagacaacattagaagcagccagagtaaaggtagatgaagaatttaaatcataaaagtaagacttcactagagaaaatagaagagctgatgaaaataagctccagtgtcaaactattgctcagaacatctgttaaagaagtgttcacactgcccacacggcaccggagctggtctccaggagagagtcttatagaatgtgccgtactgtgatgtgtcaatcagaagcactgaagcttcctgagtgaagcctggctttgcaccttttgcctttagatatataactcgcaaaggtcttagaaatgccgatgtttttctgtgaactgatatgttgaaaatgagccacgggctaagagctgcacagcaccacacagtattatgctgactgttctcaccgacaacctctagatcatgactgagtgattgggaagatgggacattctcccctcttttcctttgataggtagaacaaaagctatttgccaatgaagcacttcaccaaattggtgacttttcagtaatccactgctaagtatacagtgctacatcgacttgctgtttagtctccaaaatattaaaaaatttagtgtgtaatcctagcagtgggaagtgggttggataaggctgcccccagctatataatatgtttgaggctagcctagctatttgagactttgtcacagaaaaaaaaaaaaaaaaaacaaaccatagttttgatgtttccaaaaagatttgtcttgaggctagggagatggctccagtgattaagagcactgtctgcttttccagaggacccagtttgattccctcacaaccacttcagtcataggggatcacacaccttcttcaggcctctacaggcgctttacacacatggtgcacaggtgtacatgcaggcagaatacccatacataaaaacataaatttatttagaaaaagagttgtctcaatgaggcttgactgggtggggtcttgatcatttcctagaattatgctagcatcacccagtggcgatttttttctccactcaaccaaaagcacaaatacttgtttttttaggtcagatggcagccatataaatcttttctttatttatttatctatctatctatctatctatctatctatctatctatctttggtcgtagtggattaaacctggcagccttgcccaagctaaaagcatacaagtgtctgctactgagatgtataccctcaggccccctgtgttttataataagtggaattggctttaaattcatcctcctatttctacttttaatctcagaacatttaaaagtatgtggagtggggtggaaagatggcccattggtgaagggtgcttactgctcttgtagaggacttgggtttagctctcagctcccatgtgacaggttccaattttcagacttttatgggcactgtgcacatatggtacacatacaaacataaaattaaaggagtgttttaaccaggcagtggtggtgtactttaaccccagcacttgggaggcagaagtgggcagatttctgaatttaaggccagcctggtctacagagccagttccaaaacagctagggcacagacaaagaaaccctgtttcaaaaaaaaaaaaaaaaattccactcccccaaaaagaacatttaaaagggtttagttgagttcattgagaaattgtccataagcttttaaaacctataaggtttggaaatacccctgtcccttgaagatgattgaatgattagaaaatcgttccctattctctttttctgtcacctttccttccatcttacctacatttcccctgtactttcttatattacctttacggatctcattaacatactgtacatcttagaaaagagatacaggattgcttttaactatctttgctatcaacaataggttacagatatgagggtgacttttgtaacccttgtcaggtattggtcatattttcttaagaaaaccctgtccatttaaaagcaagagaaagataaataaggacagaaaagcagatagagatgtagatagtaaggaagaacagatagaggcaaaagcaaaggacttgggataggagacctgcagtgggagagaagcactgagaatgcagagccctgaaccaggaagcaggagtcaggtctagtttgggttttccctttcagtagtgtgttataaggtaggatgaagtggggcgcatgaaacattcccatgagttattcattggatctgcctactcagaactgaagagatccctctataatacagtgacttgacagactgatcctagtgggttaaggtggaagaaaatattaagtgatgtgtcttggctggctagcatcaacaaggttatttttaactttccttttcagtcttttcattgttcgtgctccctcactagctactatgagagcagtcaaaattagcaactacataaaatgaagttcctcttgtctccccagtcacttccaaaataaacagggagtagtaatactgtccgtattttgtctcactttactctgagggctagcaatagaggaagcatggattagtgtgtagtgatttctaggctctgtcctctggacgaattcccctttgagagctctagctgagtgacaggaccatgtggcaggcaggagtgcagctggaggtctatcacgggcacatttgggttgggtaaatatagtaggagcaggatgtcagtgtgggagatggattgttctgggaaaggaagtgttgtctttcctctgagaaacaatttcctgtacttctgggaattttgctttcttcttcttcttcttcttcttcttcttcttcttcttcttcttcttcttccttttggggcagaagaagagttggcaggggttggatacacttgctgaattctgtctctggctgtctgtctcttcctacatttgaaattgggtgtaaaaatcagatctatttcaaaagttaggaaatagacccaataaatagccataattttttttacagttatacaaacccttacctgcttaaattctcttttaaaaagtaaccattctttcctcaaaccagacaggttgagaggcaaaaataaccatacaaagaaaatgaactctattgaaagtcagacatgaagcagcagctggcaggaaacagctggggtgtttctgggcgctagactctaccccagaccttaactcttcaagctcttcgttatctgagctgcttagaaggctgcctacctagcaacactctgcataaaaaacctaaatctatgagagattatatattacaattaaatagaatttcatgaattataaatcatttttgcatctaaaaattatttgactgggggcagggcttagttggtaaagtgcttgcctagcatgcattgaacccttgtttccattctcagcaccacaatagaacactggtacacccctataatcctaatgcctgggaggtgaagggaggagggtcagaagttcaaagtcatcctttgctataatagcaaattcaaggccaacctcggctatgggagccttgcctcaaatcacaaaatgtatgagtagtgttgctaagaatgtatgcatatgtgggttttagtacctgttttcagttttttttgggtatgtactttggaatggaatggctaggtcatgtggcaattctatgtttgccaaatgattttccttcttttcctttacattctcagaagtacagaaggattccaatttctctatatttttgccaatacttgttgttttaagtatgctggatgtggtggtttgaataggtgtggcttccatagactcatgtgtttgagtgcttggtccatagggaacagcgctattagaaggcaaggtctcgttggagaaagtgtggttttggaggaagtttgtcactgtggggatgggctttgaggtctcctatgctcaggctacacctagtgtagcacacagtccccttctgtttggctcaagatgtagaattcttggctcctctagaaccatgtctgcctggatgctgccatgcttcccaccatgatgataatggaccaaacttatgaaaccataagctagccaaaattaaatgttttcctttctaagagttaccttggttccagcaacaaaagcctgagacaatagacaagcactctacccctgagttatgtcccaaaccttttttaaaaaattactatcataacttcaaaagcttttgagacctgattagactttgataataaagctccttccagttttgttatcttggcaacatctttcctgaagtaactgggctggctgttctttggggcccaatgttttaaggttttagtttttgtgcttaagaattaagaatgtggagggctggagagatggctcagcagttaagagcactgtctgctcttccagaggtcctgagttcaaatcccagcaactacatgttggctcacgaccatctgtaatgtgattggaatccctcttctggtgtgtctgaagacagctacagtgtacttacatataataaataaatcttaaaaaaggagttagaatgtgttttgagttagggtgtggctcctttggtagactacctgcctgttaggcttgagaccctgggctcaatcgcttgcactgaaaaacaataacaacaaaagactttcccacaatttgcaacaaatatagtgattatagcttagaggaaatgttcagagagggttgaaatctgacttgcaaaaagtagaaaaagttgctgaacttgatggccacccttttgatcccagcacttgggaggcagaggcaggtggatctctgtaagttcaaggccagcctggtctaaatatgacatccggtccagccaagtctatatagttgagaccctgtttaaaaaaaaaaaaaaaaggtgacaattatcgtttgtttctgggatgggtattatttctggtttattctgccattagattccttgaccacatcaaaggccaaatcttgctatactgtaatctcagtttgcttgtagatagattgccactttttctgcctgcttataaaatcaatctctttctctcattggtaatagtgatggggatcaaacaaactcagggtcttgcacatgcactgaactaacatgtactgtcttagccctagaatagcctaaagagggagttttaactccttcactgaagtgtgattggtaccatatttcagttgttactactgtctgggggtggtggtggtggtggtggtggtggtggtggtggtggcggcggcggcggcggtgtgtgtattgtcaaaggtcaagcctatgacctaacatattgggttagtgcagtcttgccactctgctattaggttatatactctgcccttccgccactacttatattaaaactctagccaggtgtagtgttgcatgcctacagttctagcacttgggaagctgaggcaagaagattgtaacaggttcaaggctagcctgatttagactagtcagagctacatagtgaaaccttgtctccaaaaagagagagagaatgacaatgacgagggaggaaaaggaaggaaggaagggggcatactggaactactgattccttgcttttctttagaaatatgtttttcctttttttcttagcagtgttctttccagtttacatgttgagtgatagatttttctaacctttagaaagatgtttttttaagtacttagtgtttgttatgtacatccttaaaatactgtaaatcagaatatattcacgtatttaatgccactattggttgctttttttgttgttcagtaaatttgagccagtttcaaagtacacagatggtagtcactgtaatatccctccaccatcagtacatttggtgttaggttacgaatgtattctaaccacttgatcaaagtcaggctttgagtaagtcaggtgtggtgaatgacaggtgcgtctggatttggtcttgagagatttggggacgtggaaagcttaagaaccactgcccctccacccccgtaatgtaccgtggtctgtaataggttgagttgtaacagtcattaaaccactcctcacagtccctgttttcaaagcttatcaggatgagtttgatttagttatttggaaccaaaaaggcagttggtggagctaggttcggagctccgtagctgtaatatatcagagatcagacttgggtcccagtgggattattccctgggcttttatttgcctggaaatatacgcaggagccaagtggtatgtatggcgagctttgctggaatgcaaattggacacattttgttggaacctgtaggggattttcactgcttcataatttttcaaaggtttgttatacagcagacagctactgcctcttctttaaatctgtaaatccccctctttttcctgttctaaaggtcagattttttttgacaactgtgtgcaggaacaagatttgttaaatcccttcatttttattcatacaaatatcagaattcagtgaacatcagttatacagcatttagaggtaaggaaaactcagggagaatcctgtgactctcaacttagtgtcaggcgtatgtctctggggatacatttgctgcctcaactttaacccataactgatctgataagagacagccttctcattgtggcttccatgtttgcaaaacctatctttaattaatcccatgtctggagaggtagaagacaggtaatctaattagcaagaggatattgttttgggcttttctcatggaggctctttgactctgacagtgcttagattagtattgggaaagataggtaattccttccaatgaagccatctttttattcttacttttcacttttagtgataccttaggcattgctcatttttagtttgaggatgattatttctaattccatttatttgtgcgtgtgtgtgtgtgtgtgtgtgtttgcaacagtgcatgcatggatgtcaaaggacgacttgtgagatgcagttctctctttccatttggatcccaagaattgaactcaggttgtcaggcttggaggcaggcacttactcgctgaggcgtctccccagaccagatggttctttcttacttactagctcatcagatagtcatgttatcatacaggacaggtttccatcacacttgagtttgatattatactgtctattgctgtatagcagattacccaaaaatatggcagcttaaaaaaaaaaccaattcaggaagtttttgggggtcaggaatttgggggctacttagctagtaggtaggttcttttaagataagtcggggagacagccatttgaaggcagagctgaactggaaggcttgtttccaagctcaccatggccatttgccagaggcctcagttcttcatagtgtaggcttctcaggactgctacccacatggaaggtggctcactcctaggtagatagtctaggagtgacagagtgaaaacatatgtgtgtgtgtcactggaagtgtcatgcctccatgctaagcacatgctttatcactaagctatatccccagtccagaatcgatacctttttattgtttgctaattcatgcatgcatataatgttttgattaaatgaccccccctttctcccttattccccactacttctccctcccaactttatgttctcttcttgtttgtttttgacacaggatcttactgtgtagtcctggataactgggagcttatagagatgcacctgcctttgcttcccatgtgctgggattaaaggcctgtgccaccatacctggtgctcttttaaaaaagattcatttatttttattttatatgtctctgtgcatgcctgagtgtatgtatgtacactacttgtgtacagttgcccccagaggctggaagagagcattagatccctggaactggagttaatgggtggatgtaagccacctgatatcaatgctaggaatgtgggctctggaagaacagcaattgctcttaatagatgagtcatttctccaacccatgggccctttttaaagaaacattgagtccagttagtgctgccgtgggtgtaacgctgtcttctggagcatggggagcatttcccagggccacatccctgaagagaaccaactgtctctctcccagcagccgtcattggccaataactccttatctaggagtgggcctttgtttgaccttccctcacccatgctagggtcttggtgcatacagtcaaaactgatgtaagttcacgtgtcaggaaaagtttcactacctctggttcgtgcaaccctcttaaagatcctggagcctggtaggaggaagtcataattttttttctttaaaaaatatttttgtttcaggcacatacatttaatccctgcactcaggaggcagaggctgagagatctctgtaagttcaaggccagcctggtctactgaagttccaggacagccagggctacacaggtccttctctctcatgtgtgtgtgtgtatgtgcgcgtgtgtgtgtgtgtttgtgtattgtgtgcgcacatatttatgtttacttattttatgtgtatgattgttttgttcatgtgtatatctttgtaccacatgtgtgcttggtgcctgtggaggtcagaagagggaattagatcggctggaactagattaggagtctccatgttggtgctgggaattgaacccaaatccttgcaagagcaacaagttttcttaaacactgagacatctatcctgcccccatactttctttttatattctacttaaaaagtaatgtattatcctttctgccttaagtttggtcacacagactaactgaccctgacatatctgagaatggatcacccaggatcactagaagtccacagtaagataaattgaaaattatgtatgtttactgggatttaaaaattgttctatttttgtggattatttatttgtctagtgtgtgtatatagctgagtacatgtatgccatggtaggtgtgtgtggagtcagttctgtcttcccatcatgtggatcccagggtcacccagcttggctcactttacccactgaactatcttgcacgtcctggagttttttggtttttgttttttgtaaatgttatttatttattttatgtaaattaatacactgtccctgtcttcagacacaaacagaagagggcgtcagatcccattacagatggttgtgagccaccatgtggttgctgggaattgaactcaggacctctggaagagcagtcagtgctcttaaccgctgagccatctcaccagccctctggaattttattatatgaaaattacatccaccttgtacttccctctttctgtaaccaggtgcctcttccactatttcatgtctctgaaattagccatggtgcttattgcaaatgtgtatgtaaatattgcttcatgtttcagttgcttcctccctcttgtaattccagccttgttctttaatataagactaataaacattatctgtccatttccctcctcccttttggtgggccttcatggcaactagacaaagaaaccttcagcccttaagaggcatatatttggatttaagtaatcgttagcacctcttcaaaacatttgccactgagcctttagattttggtgcaaatgaagtaaactgaacagttatgggggacactatggctcttttagactaagatagatgtgacagttttgtttgtttgtttttgagacagtctcctgtatcccaagctgcccttgagctcaatatgtagctgggctaaccttgacattttgtgtctgtgtatggtgtatgtatccatttttgggtgtgcacatgtttacgtaaatgtgtttgtatataatggaaaccagaggttgacttctggtgcgttccttgattgtgtgcgtgtgtgttgccccaggaattgagtctggggcctcatttatgcctggtaagcactatacaagttgagctttaccttcagcctgctgtggggtgttttgagttcttacagagaggtgcccatgcatcacctagtttattgaagtatagaaacaggtcagggtgctcatggtagcagtgagtgtgaagaataggcaatccaagatgtaagaagggtagatgaggacaaggctgacacaagacctataaataccttaaggtctcatttagtgctttgaaatagtaattaggtcatttttattgtcttctccaagttatttattggttggctctgaaaacaaggcattagaacttttggagaaaatgctactgtcagtgactcacagagaccggatagagggctggggtatagctcaggtagtagagtgctttcctactacctgatgcacaaggccatgcagtccctagaacctcacagaccaggtgcattacgcttttaatctcagcactcagaagctggaggtagaggaggcaggaggttaggagtttgttgtagtcagggtttctattcctgcacaaacatcatgaccaagaagcaagttggggaggaaagggtttattcagcttacacttccacattgctgttcatcaccaaaggaagtcaggactggaactcaagcaggtcgggaagcaggagctgatgcagaagccatgttactttactggcttgcttttctggcttgctcagcttgctctcttatagaacgcaagactaccagcccagagatggtaccacctacaaggggccctctcacccttgatcagcaactgagaaaacgccccacagctgcatctcatggaggcatttccccaactgaagttcctttctctgtgataactccagcctgtgtcaagttgacacaaaaccagccagtacagagttcaaggtcatttactgctatatagcaaattcagagtcagtttgggatataccaccccacacccccaatctaaaaagtgcagattctggtcagccttctcttttttgtttgttttatttttgtttattgagacaggtcttactgtgtagtcagactagtctgtaactcagctggccacagcttcccaagtgctaagattacaagcttgcactaccaggcagagctctgtcctgccggtcacagacagctctgtcccagtgagttgatgaggtgtagacactgagggctgggacctagctggagataatacccagcttcctgagcaagaagtggggttctgagcagtgagaggacctgaccttgtcatcatggctccttactgactggccacatgacatgggagcaagctggtgagtgttgctctcgccatactgcaccattagcccgtctgtcacactcagacgcctagaatgctttctttaaaattaataaaaaattttatatgtgtatgtctttttgtgtaggagctgtcagagtccggaagggtcattaggtcactctggagctagggttagttgcaggtggttgagagccactggacatgggtacttgggactgaacctgagtcttctgcaaaagttccaaactgctgatccgcatctccagcctctcctcctagttttgtttttgtgtttgtttttttaaaatgaggttctagtttttaatattcttttttggggagtggggataagggtcttcttgttttcttctctaaaataagaaaattggaccaaatgatttctaaaatccctaaagctataagattctgaggctctgttgtcctctctcatgcaacttttgaaatattttcaagaggattctattccatataaatatcattatggtatatttgtaatgaaatttttgctgttgaaatattacagagtataatttaaaggagaaatatgtacagtctgtgcttctcagcctttggaggcagcctgaaacccagtttccttttgtatttctattgtgtgtgttgagcatcttgaatcaggaaatccaaaataaaaaatgctgtgaaatctaaaaatgttagagcaatgacatgcctcatatagaaaagtatccacatcatttcatgttgcagaaaaaatacatgaagtattataaatgttgtataaaattagctgcagcatatatacatatatatatatgcatatatataatatattggaacataactgaatttcgtatttagacttgtgtcccatcccgaggtatcttaccatgtcaattaaagtattccaaaatctgaaaaaaattgaaagatttctagtctcaaatattttgaattaaaaggtatttaatctgtaacaatgttttaaaatatggtttcagttattcttagtaaactaatgtattgctattaaaaagaagtaaatatataccaagtaggatagctgactttcagtctgtgcttctttattctgttctggttagtctgaccaatagaagaagaataaggccagagagatcatggtttgagcaagattacatagtttattagctgggaaagctagaatttaggtctaccaattctttgtcagttgttgatgcttctgagaaaattgttgatctgactcaaatgagaaagtggggcttggcggctggagaggtaactcagagtgaagagcacttgctgctcgtaccattcccggcaccacattggtgtctgactaccattggcaactccagttccagagagtttgacacctttttctggtctcgacaggcacccagcatgcatatgttttacagatatatataaacaaaacagtcatacacataaaataaaataaaataggttgtttttgtttttaaaagaaaatgaggcgtggcagttttttttttcccttaattaggtattttaaacgttgttgtttgcttgagtagttctagggatcaaaccatggtctagggcatgttatgctcatgctgtactattgagccacatccctagcccgtctgactttagctgtttgtttttagaacactggctagaaatttggcttttctcttttatgtaaggtgatagagataagacattccgttttaaagcctagtagaaatcccttcccagtgatgatagctttagttcttcagatgacaaagacttgctgatgggtaagttataagtataaaagttaaagttaggcaaagaaaagattggtgtgtgtgtgtgtgtgtgtgtgtgtgtgtgtgtgtgagagagagagagagagagagagagcatacaaatgtatatgcatgtatatagaagcaaaagagaaaccttggtgttccttaggcaacccatattgttttttgagatagggtctctcacgagcctgaaatgtgtcaagtaagttggctggccagtgattctccagggtctacctatctctgcctccttaggcttgggttatagccacatgccaacatacccagcttcctttacattggttccaaggatcaaaccaagtcctcctgtttgcaaagccagtgctttgttgactgagctctcctcctagggcttctctccaccccctactattttgtaggcagagactcctgtgtatcccagggtagtcttgaacttactagggcgccaagtgctccttctccctctaactcagttgttctcaaccttcctaatgctgtgagcctctaattcagttccccatgttgtggtgaccttgacccataaggacaccacaagaaaacccacagaatcaactaacctggtctcatagagggtccctgagactgaactagagaccaggggccctgcatggatctgacctagaccctctgtatatatgttatggttgtgtagtttggttttcttgtggtactcctctgacagtgggagcagggtctgtccctgactcttttgcctgattttgggacccttttcctcctactgggttgccttgtccagccttaatatgaggggaggtgcctagtcttattgtagctttatatgccgtgtttggctgatatcacccggaggcctgcccttttctgaagggaaaggagaaggaatggatgggagagagtgtctgggaggagaggagacgggaaactgtgcttggggtgtagtgtatgagagaagaataagtaagaaaaattgttttggttgctactttatatctttaattttgcgactgttctgaatcataatgtaaatgtctgtgttttgtgacggccttaggtgtgacccctgtgagagaatcatttgacccagaaggggattgagattaggaaccatcgctcttacctcttgagccctgagattacaggtgcatgtccttatgcctcatttgtgtggtgcaggagagcagacacagggcgttgagtgtactaggaaagtacagtatgaactgagctacaatcccagccctctgattgcaggtggactttaacttttgtttaaaactttcattctctcttccaagtccaaagtactaagcaagcagcataatttataacttgccagctatgcagaacggttacttgtatgtgtgtatgtgttgtttgtgcatatgtgtgcatgtgtatacatatattatgtacaggctgaaggcaggcatcaagtgccatcctcagttttctccatctgaccaggctggcctcaaattcaacagagatttccctgatgctgcctcctgagttctgggattaaacatgtgtgacactatactggtcctcgttttgtttgtttgtttgatttttttatttaagatttaaaaaactgaatatgtgtatttatgtttatattggtgattgtatgtaagtgcaattgaatcccttggagctagagttacaggcagttgtgagccccctggtatggatgttgggaactgaactctggtcctctgcagggggtggtattgagagcagctgagtcatccagctctttttcaattagttctttgaaacagggttcactgaacttggaagctcgctgattgggctagcctggctagccgagtgaacaccggggttccgcctgtggttaaccaacactaggcttagagacttgtatcaccgcacctgttctttacattaggactgggcatccaaactcaagctctcaacttgcatgctaagcacattatcaactgggctatccttcctcccatgacagatcctctgtaaggtgctttgctataaagttatggctagattttgcttccagagcaagttagaaaatcaggatttgagcagtataattttatatattttatttgcagccttaatttaaaagttgactttgtatttctgtgacaaagtactccaaagaaaccagaaaaggagggaatattgactcatagtttcaaatattttaggccatggtcgtttggcttttgtgtttctgagcctgtatggaggcaaaggatcatagtggagaagggatggtagagcagaactgtgtgtctcatggcagcaagtaagcagagagagtgaggaggagcctgtggacaatctttcaaggcactgcacttcccggtgacttacttacttttactaggtcccacctcctaacaggccatgtagctatgaacccgttagtggactaatccattggtcaggttcgctcccttgtggtccagttacctctcattaacaccagcagctgaggaccaagtcttcatcacataggagggtttgagaactacagagccaatctgtaacacctactaaactagacctggctatcaaagagctagttctgtactgacgtaggttcacaagagtaaatatcatttgaagcaagatatatagaaagcaccagaagaaagtagattgagtcttgaggatggatttgaatagtctttctacaattctagtctctagagtccttttttttttttaaccttcctatcttcctcctaaatacttatatattttcctgtttagacccaatggatgtcaaagagaaagaaatggccttataaaattcatttgtgtggagaacttgaagttacttcggaacttgataacttttagaaccatactctgtttccctaaagaacctcctaatttttttaagcctgatagtggtggtgcatgcctttaatcccagcactcaggagtcagagacaggtggatctttgatttgaggctagcctggtctacagatcaagttcaaggacagccagagagctacacagagaaaccctgtctcaaaatcaaaacaagtgaaaaagaattctcctctaattttttgttttgtttggtttctgaaacaaggtcttgctttataagcccagctttcctgaaattcactctgtggcacaagttggccgtgaactcagtcctattggttccccctctagagttgtggagttacaggcatatgccaatatctgggtgtaagaacaccaacattttgtaaagaaattactcaagaaaaccactgaagggctggtgagatggctcagtgggtaagagcacctgactgctcttccaaaggtccggagttcaaatcccagcaaccacatggtggctcacaaccatccgtaacgagatctgacgccctcttctggtgtgtctgaagacagctacagtgtacttacatataataaataaacaaatcttaaaaaaaaaagaaaaccactgaagtcttattatgtatattaatatttacatgtaatataaagtacataatttaaaaatatttttcctctaggtatctaaattattggaacaaatactgccttaaattgcgttgagtaggactgaagagatggttcagcagttatgaatatttgcttctcttttagaggacttgaatttgattcccaacacccacattgagcagctcagcacagggtcagaaacacaaaagccaagtgatcctgccatccagttccaggggatccactactcccttctggcccccacagtacctgcacacatgtggtacaccgttacatcaacacaaagtaaaaaaaaaaattgagttgggtacctgaaattaaagagttgagaccaatagttttaaaatatattctaggggctggaaagatggctcaatgtttaagagcacctactgctcttgcagaggaccatggtttgattttccagcacctacatagtggctcacaaccaactgtaattccaattccaaaggatcagataccctcttctggtatctgtgtgcattgtacacatgttgtgcacagatatacatccaggcaaaacactcttacacataaaataaaaataaataaaatcttatgatttttaaaaatgtaaatatttctaggctcagcatggtaatatatgccggtaatcctgtgatttgatagacaaggggcaggaggatgagttcaagcccagtctggactgtattgagagactctgtctcaaaaatagaaaggtaaagctattatctaaaattaactatgagtttatctctatttactatttatagatccaactatacaggttggcaccatgtcgtataatagcatcaaatctctttttaataaaatgtcttttatactcttagcagggatcaggccatctaataacttaattaagtactgacatatttttagttaggcactttatttggcaagattttattggtcttatgtaatatagatggcaatattatgtcaggcactttgcatatatcatctcatttaatcttttcaagaatatttcaaagaccagaaaggtgtcttaacaagtgaatacatttgccatgtaaacctgacaggcttagttgtcacatgggtgggtcccatggttgaaggctgtgtgattgactccctaaaattgccttctgacctccatgctcaagctctgtctccacacactcctcaacaaccatatttgtttacaaagaaagtatttcaagatatgctgtgaacattttatgtaagagaaatagggtccaaagcagggagaacctttaggtcgcatacttagtaagtggcagaatgggtactctaagtatgggccttttcacatacagttcttgcacttgccgctgcctcttgagggcctgaaattacagaagataaacaagtctcagccttatttttggcaaatacaaaactcttattctttggttccacaagagtgcttgatgtttccatcgagatcctaggctgctctctcttccgagagccttggagaatacgtgcaaactggcagagcaagtaagagtataggttctagattagaggtgtgcagatctggttttgaatcgcagtctcctctcgatgacttccagcacactagttagctaatgttagcctcggtgcctcgtctgtaaaataggggccgtgtggagtacaacttagcaataaggaggaatgaaggttgatatatgtttaatcttggatagagctcagatccaatctgagtgactgattctggccatatggtactctgaccaggcaaagctatagaaaagggaacagcactcagcaggaaaaggggcttcccatgaagcccgccttcagtcccatgatggaaggagaggagcctgtggcaagctgtcctctgacctccacatatatgcacgccacacaaataaattgaattcaaaaattgaaaaatctaaacaataaataagtaaacaaacaaaaaaaaaaaaaccaggttaacttgtatttaaaaagcaacattgtgctatagtcagcagcaggtagcaaacatatcattgtctgcttacacttgtccacaacagctttcctgacttcttccctgcacagatgtagaagtgagatctgttgtgattctttttttatgacagggttctccatagaccctgaaatgtgtgtattaactcaactttaacctcacagcctatattttgatagatataggataaggataggtaaaagataatgactaccaagggatgatgaagggacttttgaggtaatgaaactgttctacagcttcactttggtagtgtttacatgaaactatatgtgttaaaattaacagaaaatctgttccacccttcaaatcaatttactgtgtattaatttataaagcaaattaagcaagatgtggtagtatggtcccagctactcaagtgactaagatgggaatatctcttgatcccagaaatttaaaactagtctaggaaacagtgagatctcatctcattaagaaaatagctggatgtggtagtgttcatctgtaattgcgactctcagatggtggaggtagaaagatgaggagctcagagttatccttggttacataatgagttcaaaggcagcctatgttacttgaaagcaggtctcaaaaatcaaaaatcacaaaagggctggagatgtagctcagttggtaatttgccttatatgtttgaagttctgggttcaattttttaaaaaagattttatttatttatttatttatttatttatttatttatttatttattttatctatatgagtacactgttgctgtcttcagacacaccagaagaggacatcagatgctattacagatgattgtgagccaccatgtggttgctgggaattgaactcaagacctctggaagagcagtcagtgagtgctcttaactgctaagccacctctccagcctcctgggtttaattcttaataagacacaaactagatatggaggtgttagcatgtaattctagcacttgggaggtagactggtggatcacaagttcaaagtcatgcttggctacatagaaaatttggggtttgctctaaaattttttaaatataaaaataatcgacttatccatgaaaatgagtatattcaaatagtgatagcatttttacttttttttttacctttttagatttattattttatttgtatatatattttgacagtatgtatgtctgtgtactctgtgggtgcctgatacctgtgggggtcagaagaaggtgttagagcccctgaaatttactggagttacaaatggttgtgagccatcatgtgggtactggggacctggagctttgaaagagcactaagtgctctaaaccgcagtctcatctttccagcctttatacttatttattttttaagaaatattttatatctatttgttttatagttaaatttttataaggtcattataaaaaataaaaataagatagtgtaagtagaatagtatcacagtgcctacctagtaggtagtatatgttaagtatttttgttctttttgacattattggaagtattttaaatgtagcgacattcattgaaaggatggcggaataaagttccatcccatccacatgagtagagtcagagaacagaacccgaggaacatgagtccaggggagcgagttttcacatgacttggcaaaggccttgagctctggacggttacgtgtagcacttctgcaatgacagttggcttctcattgttcttcaacaaaatagtaaaatagttttggtctcagaagtttcagcttctttccctggattcagactagtctgcagtgtggattgaacaaattgattagagaaggagccggaagtgtttctcatacttagaagtgtaactggcttatataacagctgcagctccaatgtctgtctgctagccacagcctttggattagatggggacaacagtaggagagcatagctcaaagctctctctctcttttaagttaaggtcatagtgacattatagttataccagcaatgaaaaagaggttgtaaggtaaattttaaaaatactttaaaaaattatgtctgtatatgtatgtctgtgtgttggcatgagcacatggctactctgtgagatcagaggtgtctaagtctcctggacttggaattacagacaattgttagccactcagtatgggtactggtaactgaacttgggtactctgcaagaccagtacttagtcttaagtactaagagccatctcttcagttccataaagtannnnnnnnnnnnnnnnnnnnatttttacatttcacaatattaagtgaaaactgcactttttttgtattctttctccctccaaaaatattcagttaggaagggaattttcctttccatgcatctagtaaacactcgggctcagcaccaagagctcctggtggaacagaacaagaaatacaaaaaccatcaagagcgcttctgctcttatctgtctggccgggtcatgccaggccgggtgggcaccatcttagggtgggcaggaggtctcatcatgggaggtccgggcatcatgggcatgtggcctcccatgggtggtctcatcccagggctggtcccacgggcatcattctggacggaggggggcccatcattggcatcatgggagggcctcccatgtgggacgcaggcatcatgccaggctgaggagggcccgggagactgggggaggtgggatcatggcccctgcaggcagaggagcagagaacagagcagagggatcttcccttgttgaaatgcagccgttgtcttgtcaatcaggctctgggcctgctcttccatccatttctggtaatagtcttttacattctctttgtgtttccgaccactgcagtgtgtcttcctcacagacggagaattgtgggtaagatatgtatcacagtagtcacaataaaacttgggcatgatgctccacaagccgtaggctaccccgatccccgccaccaggaactcttattttttccttataggttctacacatataatatgtttttaagtgttatatttttatagggtttctgtgtgtgtgaacacaagggtccctgtatctatatgtgtttcttgtgctttttttgcttttttgtttcattctattctaatttgtttttattttatcttatttttaaaaaatattagaaattattattaaaattattattagataagtgcttggttgtaatcagaaaggaagaaagaaagaaagaaagaaagaaagaaagaaagaaagaaagaaagaaagaaagaaagagggaaagggaaagggaaagggaaagggaaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgaggtggctcagcagttaaaggaccttgctgcaaagcctgtcagcttgagttggaatcctcagtaaccctcaaggtagaaggagaaagccaacatcagaggattgtcttctcacttctacatgtgcacttccacctaccaacacacgagaaaataacatttcttgaatggttttgttggctggtagactaggtttaagattatccccaaatgatggaatatttaatatatctgaaagacatcatagtatttttctgcttaggaaataaaatcatcagtaattctgccagggaggtggtcagagtcaggacatgcactagaggcagaggtaggcagatctatgagtttgaggccagccagcacaggctaaatagcgagtgccccgccccccaagaaaaactcaaaaaaacaaacaaaccaaatccaaaactcaatctcagctaggagatctttgctcccatctgtctaccaggacatccagcactgtctataaacaattttgattgccacaactcaaggagaagtgtgtaggttcacatgtgccacatatgtgtgtgtaggccagaaaacagcttacaggagccagttctttccttcaatacaataaaaaaatttttttcaagaacttgatattttaaattttcacattttgatctttttttacccatttgagttaattttgacatctttactgttaaatttatagaattttataaatgtatagaattttattatttctagattatatgtttaacttttttattttatcattttatgtgtggaagtgctttacctgtgtgcagtgtatgtgcagtgtcctcaaaagccagagcacagcatttgatcctctggaactggaggtacacagatggttgtgagctcctgtgtgatgggtactgggaatcgaacctaggttctctggaaagcatttagtgctcttaactgctaagccatcactccagccccaaattgtatcttaataactgtttatatagaaaatccagggaagccaaacatggaggatgattccagtaatgtccttctcttgcacatgaatatctagttgcctctggctcttgactgaaataacttctcttttctcctgacagtcttagcatctttgtcagaatcaattgaccataatggccctggtgtgaaactgctttaattgtgacatagtctcaccgtatttcccaggctggcctgcaacttgaaatcttactgctccagcctctgaagtgctgggattataggagtgaggtaccatgcctgaataaaaaatcttatatttgtttccttgtttgtttgacatgaggtttcatatagttcaggctggctgcaaactattcagccaagggtgatcttaaacttgtggtcctcccaccttgacctttcgggtttggggttaccaaagttctgtcacctggtttcctggctagaaaatcttgatgactttctactattacagctccctaaagactggattcagtgtttccatatgaatgctgctgtgcctgaggaagaacatgccaagctctaaggtgcccctaagacaactcttggcatacacttcggccactcacagcatgcacaaacctatatccccagctattaggtcattagtgattcagtaactacctcactgaactctgtatctagtactctgaattctagccagcattgttttttgatatggtaccagacatggaactcaaggccccagcaattgtctgtctgtcttctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcactgatttccccctacagaggacttagattcaattctcagcatccacatggtgctttataactgtcagtaattccagtcctagggggatacaatacccttttctggcctccatggcaccagccaaaatgctcttacacataatttttgaaaaagaaataagctaagttcaacatagtgatacatgcccttaatcaaagcactgggagtcagaagcaggtgtatctttgagttttaggccagtttggtctatagggcaagttccaggacagccagggctccacagagaaatcctctctcaataagttaaataaataaataaataaataaataaataaataagtactgattgtaaatatatacaaatagagcaccaagttttaggccagtatatacttgagggtagagttgtaagctacatttcagatttgacttttcctagtatatattacaacctagaaaggggtatatactgttttctgaatacttgctttacaactaatagcctcacaattatagtcattatcatatgagacttttgaagataaaatcatcggattgccaaaaatcagagtaaaaattatagctctgtatggtaacatacatctgtaattgcagccccagggagactgaagcaggactgtccacctgtatcacataatgagttaaagaccagcctcagccactgtgtgagaccctatctgaaaacaagaaacaaaacaaacaaaacccccaaattcctaaccaagaagaccttgcctgctgttgactactgatgggtgggggggtgtggtggcacacctttaatcctagcactcagaagcagaggcaggccaaaacagccagagctatacagacaaaacaaaaacaaaaaaagctggtcaggcagatgtgatccatgcctttaatctctgcattcttgagaaaccctgtctcaaaaatctaaaaaaaaaaatcaaaaaacacatacacaccgaccccacttcccccatcttgattactgtgtatggttccagttctagctagaaactttttgttttaacttgaaaaaattttttcttttaccttgaaaaattatgatctggcagtgtagctcagtgataaaagatttgcctagcatatgtttgattcctctgcaccacaacatttaaaaccctgaaaattttcagagaatcattacttccttttttttttttttttttttatatatgtaagtacactgtagctgtcttccgacactccagaagagaaagtcagatctcattacagatggttgtgagccaccatgtggttgctgggatttgaactccggaccttcggaagagcagtcgggtgctcttacccactgagccatctcaccagccctcagagaatcataagttttagaacattgtaattcaagatcatctttgtcgcatattttaatttttaaattatatggtgcagtggggtggggatggattgcatctcatggtatgaatataaaggtcacagttcccgccttctcccatgtggaccccagggtaactcaggtcatcaggtttgggagcgagcacctttatctgctgaaccttctcagcaacccagtatgggttttttttccctaaaatatttatttagttatttttatgtgtatgggtgtttgcttgcatgtatgtatgtgtaccatgtatgtacctggtatccttggaaatcagaaaagggttttagatcccacaaaactggaattacagactatttctatctgctatatggatgctgggaattgaacctggtcctttaagagaactccctaggccaccaatccagcccccaggcttatattcttgaattagatctaaagctagtcttgtttcttcatttagtaagtcactgacctgcaaactggaccacatgtctgaagtgtggacagcaggtaagtgctgacattttgatggccacatcatatttcaaggatctatgagaaggcctataatgaccacacaaaactagccaagactctccttgccatggacaaatgggagatgttactaagtttagctgacattaagctgtaaatgatttgagaggtggaagtggattctcctcccaggctgtgtagacttttcatttagtgtcaagcacatgtgctgtaggtggttttgtcctaggaaatgggttaccatctctcttcttttcttacatatttttctactatattggaaaatacatatgtataaaatatgttttccctatatagtagaaatatagaaaatatagctactatattttcccaatatagtagaaatacatagaaattatatatagtgtatagaaattatatgaaaatctaatatattttccaatatagctactatattataataatacagttgccatagctctatttggacctgtacattagtagttcctgttggtcttaggtatcaaagccttatttacccaaagtaatacatctgcttatgacaaagtctggtctgtaagctcagtacctcagatgtctttttaacatacctaatgacactcctcagttagtggttaaaacccttcacactgtgaatcaacctacatacttattcctctcttccactggtttcctaccttttacccatcctgagctattcagcccttaccagatgtgaatgtattggtgttccataaaacacccaaaaatgtctagcatataaaagattcaggtgttaaactgctgtttgaaaactagaattcaagcttcaggctggagagatggctcagtgggtaagagtactgactgcttttccaaaggtcatgagtttaaatcccagcaaccacatggtagctcacaaccatccttaataagatctgatgtcctnnnnnnnnnnnnnnnnnnnnatctgatgtcctcttctggtgtgtctgaagacagctacagtgtacttagatataataataaataaatctttaaaaaaaaaagaattcaagcttcatttgagtttgtatccagagtatgctaatatagcatatgagtataaaatatagcagttttgacttttgaggggaataggggaactgagagtatagtcaagtgttagagaacttgtgcagcattcagaggccctgggtttggtacccaaaactacaaaaaaatgaaaggagggtggaaatattgctcagtggttgatacttgactagcacgtgagcttgcgttcaatttccagcacagcaaagaagagagaagaccaggaggatgggagggatacagacagacagacagacagagcaggagactgaaacaggactgcaagttcccaggcagcctgcattgacttgaattgaaggatcatatggtgagaatctgtcctttaaagaaaggaacgaagagagggaggagagaaagaaagaaagagggaattctagtgacagtcacaaacttggtgttgtgtgacaaaacacacacacacacacacacacacacacacacacacacacacaccccaggtaggaatcccgtgacagtctggatatcatctgccctggctagttttatgtcaacttaacccaaactagagtcatctgaaaggagggaatctcaatagagaagatgcctccataaaatctggctgtagggtatttcttaattagtgattgatggggaagagaggggaggagaggggaaggcccaccccaccccattgtgggtggtaccattgtgggctggtagtcctgttcctctaagaaagcagtctgaacaagccatgatgagcaagccagtaagcagcacttcttcatggcctctgcatcatctactgcctccaagttcctgccctgtttgagtttctatcctgacttccttcattaatggactactatgtggaggtgtaagccaagtaaacgatccccaagttgcttttggtcgtggtatttcatcacagcaatggtaatcctaaactaagacaccagcaatgttcagtttggtgagccaatgagttttattggagttacttacaggatacgggtgagggggtacttataggagtagaaatgactcaaagacagctgcatcacaaatttcaacccagcatgggtgacagctcacaaactggagcacactccataccctgcaggagctcaacaggttggagatggttctttcttggtgcctcagttggtccaaacctcttgtaggcacctcagcaggtttctgcttcttccgggagctgccctggtctgagagtcttctctggagctttgctgctcagcttttctttcttttagagggactctccgcttctgttgcttactctggcagggagcggctgagtgaatgtggtcaggttcaggggcttcctgaagtttctgtgattagtttactatccttcaggaacttccccgcaggatgcaatgtttcaatctcataggaaactgttactatccccatagaaattatatttataccaatgttttttttgcactggagagatggctcaactgttaaaggctaggctcacagaaagtacaaacagtactaagtgataacagaatgtggatggccagctgagatgctcacattctgagggtgaattgtaaattggaaagtaaattgtaagttggctacttctgttagagatgaactgctatgagatgaattactttgaaccagcaaattctgtgtctaagagtatgcctaagagtaatttgtacatacgttcaccaaaagatgtgtatgaaaatgtttatagcagtattgtttataagagcttcaaaaaattatccaaatgtccatcagaaataaaagaaataaaatgcaatggattcttacagtacaatacttcacagcaataagaattaatatggactgtatcatataatacacatgaattttttctgtgttggtaaatgttttcagtatggagtgaaagaaaaccaaaccaaaaacaaattgtatgatactgttcacatagattagggctaaggatacagcttagtggtacaggtacgagtctgtgggttgaccctctaacgctaaacaaactgaagaactgtttatatagtgtagtcaaagatatcctgaggtgttagaagtcacaattgtttcttttagaggcttttcaagtagaagaaatcatgattaggtttttttggttcagtagtttaaatttgaaaagtaaaagtgaaaatttattgagcttaggacattatatacttcaacttaaacatgttcttaaaggaactggagcaacggctcaatggttaagagcactcactgctcttgcagaggacccaggtttggttccagcatcattgaacatggcagctcctaattgtctgtggtgccagttccagagaatccaatcctctagaggcacctaaacacacatgacacacacatgtacactcagattaaaatagaatccaatcctctagaggcacctaaacacacatgacacacacatgtacactcagattaaaatagaatccaatcctctagaggcacctaaacacacatgacacacacatgtacactcagattaaaattcccttttgagatagagtttctctgtgtagccttagctgccctgggttttgttctgtagaccatgctggctcagaggtccacctgcttcttcctcccacgggttgggattgcacccatgctccaccaccacctaggtgaatggagcttcctctgggtgttgtgggaccagcttcggagttcttgcccaaggtctgctcagggcatgggcccagaccggaaggaacctgtgtcactggttgggcggagttcctgggtgcctcagctcttatttttttatgtcagaataaaaagtgtcaatggctaaaaagaacgttgacaaagtgggaagaggtgtttttcatgctttctgttcccagagaggttacatttttaagctagctttctaagatgaaactgaagctgtacccgcctgcttgtttttcttagccctcatttttgttgttagatcttcttgttcataggatatgctgcgttaatatttcctgtctgccatgcctgtattagctgagattcctattaatctgtgttagctttctctggtgggtcatttctattactggcatcccccaaatagagatatgcatatcgatttgtgttcggtggtagagcaaagtttctgaggactggtaaacccctgcagcagtgttagtctcggggatgctggagatctggacagaactatgtggagctactgctcagctgtggtctttaaaccaaggcttttctttaatgacccagagccacatttgcagtgaggctgaggaaggagctgcttttctgtttattagaggtgacatgggcagcggggcagtggcaaagaggccatgttgctcttgttaaatatacatccctgacagttggataataggttccaggaagttcagtggaaaattaaaacaaagcaacatttatagctgattgaacttgaaaagccattttggtgttgaatggcaaatatgtggacttcagcattcctagagcctgatgcatcctgctggatggccctgtctcatgtacacgagggctgggcactcagcagtgtgcagggtgcttagggggaaaagaaagctttctgccagaagccttctttgcatagagttatggaacacaaatttccccctatcagggaacatggttcctctgatggttagaggcctatcttgttagaaggactggaatgtctggcaagagtcaggggatctcttatgtactataaatactcctagtctcctactgaggctggatcttcaagcagattattgtagtgtattcacatgactttagcgtggaaacactttgatattgtcccagttttgtcctaagatgttaagattagaaggctttggattcatgtgtgagatgattggtttacttagaagaaaaaaaagcagtaggagatgggaagtgaaggaagagtttcaggaaataagtgaagagagacttgagcctttttaactgtcaaggaaagtattttgctttcagttgcatccattataagggaatcatggtggctgacctgtagtctatgcatgtttaaggatcttatttggaataaacttattttgcctcccaaatgatgatgctggtgctgtaagtagagacaactgtttcagtttagctttcctggcagattcacctctgtccattcagctctgagcctggtatttgccccaaaatcacagaggaagacaggtcttccagtgatctgacttagttatatcctaatgctttctcaatctgcatattatactggcacttgaatttgcttctgagccagatcaaattttaagctatgccttgttctgtagggatctcaagcttgctttggtagtctctaagtggtgaaattaggatcagggtataaagaaaggctggttagctctgtcccttcttaccgatacagttcttcctagtgtgtgctcactttggcagaccaagaaagcagttatgaatgtggatcaaagagtcacagagctggcttagcattttgtgtacactaacaaagaactgagcagtgaacaacaggtttcataacttgaaagcacattccatgtatgatataagttgggttatttatccatttttatggaagggttactactgtgaaaagctttgtgttctgagtacacacaagtaaatccatattgcagttagtactcttctttccctgaaatgggaaagtgatttatgaggtgtgggctcttatgtgaaagaaaacagaactggttgctgtgtgggcccataaagttcctgtgccatctcagtggtgtggtttacaagaaagagaagatgagcaagctggctggccctccctcacttgggctcagctgccccaaatacttgtgatattgaaggttatttatgagctcttctggactggcattcagtactctccatcctggtaggtgaagatttgcaagcagaatgtagaaactcccattaatctttttggtcttgttgaggatttcttgccgactggagctaccattgaagaatggattggccttttccactgaactgcaatggctcagattaatattaatccctttaatgccgtagttcatgatatagtcattggtgacttggaactaatcctatcctcctaactagtgtgatttattaaatacacatagaaatcgagtctgaatacagctaggcagaatcagcagcaaataaatacctctgtgcatctgtattaatgctggatgattggggcacaattgcagtctggctggggagaaacagggcaaaaggaagctgaactctcagaatcagtagtatttacccatgcatagcccttaatttacatagcaaaactgatataaactcttatacaagagaataagtatcagtaacaatttaaaaaggaaaaaaaagtttatttattttatatgtgagtacactgttgctgtcttcagacataccagaagagggcatcagatctcattacagatggttgtgagccagcatgtggttgctgggatttgaactcaggacctgtggaagagcagtcattgctccatctctccagcccagtcacaagaatttttaattaattctgtggatgtgaaatcaaaaaagaaaaatcctacataaatacttgaaaattttgaagacaggcttaaattaagaaaaaaaattccttaaagttaattatttgaatgacgaatgatttctcttctatgttgctgctgcttttcctcctcctcctccctcccttccccttctctgtctctttctgtctgtctctgtctctgtctctgtctctgtctctgtctctgtgtgtgtgtgaagtggtctctgtagccctggctggcctcaaactcataatactcacaattttcctgcttaagtgctaggaaaaaaattaagaaaaataaattattatttgaatgatttctcttctatgttgctgctacttttccttcctcctccccctcctcctccttctctctctctccccccccccccaggtgtgggccatcacttttggcttcttttaatatttaagagtaactatttaagccagaactcaatactggtaatacaggactgtacctccagcataggaagcaagaaaaatcctgagtttgaggtcagcataagctacatagagagactagtgaggtggcatagtagttaagaacatttgctgttcttgaaaggatccctccaggcagtggtggcgcacgcctttaatcccagcacttgagaggcagaggcaggtggatttctgagtttgaggccagcctggtctacagagtgagttccaggacagccagggctatacagagaaaccctgtctcgaaacacacacacacacacacacacacacacacacacacacacacacacacacacacacaaatcccagttcaatttccaacaccatgtgttagctcacaagttttgaggttttgttggttgcgatgtactgtaatgctaaatacaggctctggttgcctcagagacaggggaatcctcatttatccctagtgaaactatgtaaccttgctccttaatttaaaactattggtcaagtaaagatgcctacagcctgaatctgggcagaggagaggtaggggcttggggtctgaggcaaagactaggagaagagagaggtgaagagaggagaagataacacagggtaggtgaattgtgagaacatggccgtgagggctggccagttggagtaagagcagcccaagtggaacatggcaaattatcacttgtggcaatagaggggaatagaaaaagtagcttagagggtagatatctgcccagcgctagtgcatttaaggctaattataaatataaaggttttgtgcctttcatttgggaactgaatgatcacaggtggggtagaaactccagttaactttcactattacattttggcgcccatgttaggcaccatttctagaagttatgcttggtgcttcccctagccccatgctcccagaaataagactcaggctcagaatatatttacaaataccttggccatattgctaggcttttctcttactaaatcattacttaaattatcccatttattctaatctatttatgcaatgtggctgattgcctctgctcaggtaccatgtgtctatcttctgtgtggatctcccgagcctggctatatcccacaattctctctgcctcctgatggcatactttctactctatcctttcctataggccatgcgtcttttaaattgccaggttatgcatccatacagatctctccacacaagtgtccataattccagttctagaagatctgaaaccatactcggaccttctcgagcaccaggcacatgcatggtgcacttagagatatccagataaaacacttatacacataaataaatctgaaaaaaaaaatcctttttttttttttttttttttttttttgctgttgttttgtttaccctggctggtctggaacttgctatgtagaccaacctagctttaaactcaataatctgcctgtttctgcctcccgagtgctggaatcaaaggtatgtgccactctacaatttctgagttcttagtagtagtaggcccaggcactggctgcactgggcttacatagtctctcaccttttatagcttcaaagcttacatttttttttcttcttgaaaggagcaagaaagtagaacaaccagtcctactttatgataacaattctctctgatatccttggccaagctagcagaatcataatttcttttgtaaataattgaggtttatcatttttctttctcaaacctccttttcttccccctctttgctctttcagcagagatggcattaatatggaaaacatctacctagctggcttcgtttaatcaggcaagtctgacatttgtgaaacctctcattaacattttccccaaagagcacaaaatggcctcctctcagtatacagccacctcaaagtttaggctgatttccatagccattggcaggcagctctcagagatgttacttcttcaaactctcatttctggccaacagccactggtcacatatgtggggaccttctgtttcggtgctgccctattccttgtaaacattgctttttaccagtttagcctgggaataaccaggtgtctatacatgaatgggaccagggtatagattcttcagggcgtccgtgcttcctttccgctaattcagaagctgttgaatgcttctcactctgttccacactgagctaacaaaagcagagtgctccttgtccctctctgtcctccaggagcttataaacatcaattaggtatacattagactatactgtagcattttagactaaagcaagagcactatatggaaatacaagaaaaaagagattagttctggaaataagatgtcaaggctggtcccttcattgaaactgagaacatgagctgtaggaaagccaggcttagattctgaggccatcagttttattaccatggaaacaagacctggtatgttactgactttttcatagcttgaccaagatacctaagagaagatcacagggggctggagagatggttcagtggttaagagcactgactgctcttctagaggtcctgagttcaattcccagcaaccacacggtggctcacaaccatctgtaatgggagccaatgccttcttctggtgtctgaagacagcgacagtgtactcatatataaaataaataaataaatcttttttttttttaaggagaagattatagaggggaaaaaggatttatttttattgtaaagatttctagcccttgtctttgagtccttagttaggtgaaaccttacagtagtggggagacatggaggcggaaaactattcacctaatagctgataggaagcagagaagggctaagagactgagaattagataaattcaaagcctcactgcttcctccagctatgtctcacctcctgagcttgtcaaagaagcactgtcctcaggagcaagcagtcaacagatgaaactgtgcttctcattcacaccattataaacctttgtaccatggactaatttacaataggggtgatggcacattatggtaacaataatatgtcctcttttactagaaggtagcgctagcctccttttcttcattccttttatctaattcattcaaagacaaagtcccttgtttctgtggttttatttatttttcttgaggcaagatctcatatagttcagtttggtggtgagattgtcattcagcctagattagacttgagcttctagtcttggtgccctctcccaagtgctgggattacaagtgtgcatcactgtaaccaacttgtgtgtttaggttatactcctaaaattaaattcaatcctcttttccttccctctggatttttgtttgtttttcagttctttagcttttgactaaagacatagacagcttatatgtagtaattttatctctttcttttacatttttatcacattgctagtgagtattcaaaaagtattagaaacagaaccatcagttaggttatgagtgagccagttttaaaactgtgagactggggatggcgctcagggttagggcacaagcaccaagcaaaatgccaaactttaattagccacatatggaggcacagccttcaccagatagttgtaagattgagacaagagagtcacgtgagtggagatccagcctgggcaacagttttaataaaactgtgagctcagggcccagtgaaagactgtctcaaaaacaaaacaaaacaaaacaatcaaggtggcagttcttccccatttatgtctatttctaattaagctttttcaaatatatgcctatgcttgtatgtatgagtgcaggcacagagtcggcagagggcatcagatctcatgaaattggagtgacaggctgttgtgagctatctgatgtgggggctgggaatcaaagtcaggtcctttggaagagcaggaagcacttgtaactgctgagccatccccccaatccctgtggtgtgtgtgtgtgtgtgtgtgtgtgtgtgtgtgtgtgtaattttggtggccaatacaaataacattttctccattataattttattttctttgtttactttgagatgattgcatccagctaaatttcttcttgctttactactactggctaccttctcctgtattcctgtagttgttttattatatgctcataatagttcagtctttggagctttttcccttatggtgtctttttccagcagggtcaactttgtacatgacaattcatatctccagactggggaaacaaaagcttcaaggcatttttagtacataggcatgaaatgctaaatcctgtcaattccagatccaaggtctgcttcctatcaggtagcataatatagattaggctttggaaactcccaaaatagcatttgctaatttgccctttccttcttccttttatttttcctggtatctgtgtagatcctaccatagtctagattcctgtaagactctgtcatctggtcaactgctactaccaaatagctatatttattgttatgagcaaaaatccgtttgaaaaaggcagcaaaggaagactttttagtgtatcattttcccattgctgtcctgggtgaagcataactcccatggacagaaatacagagttcatttgagtataaaatagcaggcaaggaaacaggtgtagatgggctttgttgtgagatctgcctactctccaggaagacagcctccccctcacctccccaacagaagtctctccccttccttcattacagatcatcgtaagacttccatcctatgctggtctacgtagaaatgagagagtacatactttttcttttaacacatcgtactttttcctcccctgagcttgctaaccttcagcttaagtgtgcaccaagtgcagatgtatagtcttcctcccttcctgtccctcacttattctgaaggaaggcagcaggtgaggggatgcggaaagcatggggtgggaggctgggagggaggagtttttctcacacgcactatggatgttgctcaaccaaatggtgtgaaattgagtcagagccacagcatgtgtttcaattttccagggaatttcctcttcctaactgtaggtttaaccctttcttttgtttaatgccaagagttacctaaaaacataaaatgagttaaatataagaagaaaaaaaaatgctaagattccacaaggcctctctttgagctctggagctccagctcatttgctgccagatggctgtagagaagggtatagactttgaagtcaggtagacgtaggttcaaatccaatctctagcaagcatgccttctatagttcttttgagagttaaatgagataatgtataaaatgcctaccatagtatatactttgcacatagtgcatacttgatacatgtttgtttcatctacaatctaccttctggaatttttgtcagatagtcttgctgtgtttcccaggctaatgttgaactttcagccttcctcagcctcccaaatgctgagagtataggtgtacatctcacttggctacttactacattttacagggaaaccaggtcacatcagtgcaggccagagcttgacatactcatcagtgtaagttaggggttttctttttttaaagatattctaactacattcgcttattatgtgtataggtcttaggcatgcatgctaaggtgagagggaagcttgctagggttgattcacccttacaagtatgttccaggggtagtactgaggtcattagtcttggcaagtacccttacccactgagcctatcgtcaggtggtacaggcacacaggcctgtaatcccagacactctagaggcagagactgaaggctcacagcttgggctcatgctaggccttaggcagctggaggcctcctgagctactttagattgtctcaaacaacaaacgataagttaagagtccaagggattcaaagctttcttctggacttcatgagtacctgtgttcataatacatacaattaaaaagaattaaaaattttttaacatttatttatttatttattatatataagtacactgtagctgtcttcagacattccagaagagggcatcagatttcgttatggatggttgtgagccactatgtggttgctggaatttgaactcaggacctttggaagagcagtcggcacttttaaccgctgagccatctcaccagccccaaaattaattttaaaaagaaagaaaatcacttattttccccaaaatgttaaaggggcagctattgaacctatgctaccaggatggtgggttgggaggcaaatttgtctctcttctgtctttattcttattccaactagggagactcaccccaatgctcctgatacttattaatgaattaattagttaacgaatttgttgttgttaggggaagggcaaaccaaaatctaacttgtgttagacaagttctctaccaacaacccccccacacacacacatacacacaaacacataccattctctttttgttttttttttaggtgtaattaacatacaatgaaatctacaaaatttcaacgttcagttaataagttttggtatcgtataaaccatataactactaaacagaagttaaaattttaagaaaagttacagctggacatgatgatgcagacctggcttggaattccaacacttggagactgaagtggcaggattccaagtttgagatgagcttaggctaatagtaaattcctggctaatcttggcaacataaagagactttgactcaaaaatggtatcagaaagaagacacagaacatgttcatcactccccaaggttccctcatgccctctttgagtcacactgtacaccctatattaaaacgatttatgtcctgtcacaatagattagttttgttttgagatttcatgcagatggaattcatgggtggcttgtatttcatttcttcaagtttagcatagttttggactttagatctgttactagatcagtatttcttttgcttttttgcccctagacagtatttaataattatatggctagatatatcaaaagaaagtatatctaatctcttactgaaagacttttccattgtttccagtttaggattatgaccactataaatatttctctttgttagctgttttagtttctcttggataaacaggtaagagtagaatcatcgcctcataaggagcatctgtttagttcaaaaaagaaacaattcttcatggctcctcccacccccaagctcttctttttcttcccagagggactgggctctttaatttgaggacttggcaggagagaagcagccacatcaccagggtccctgttgccagagcacagtggcctgaactggacacttaaaaaactgaaacaggtgtttgaaaccctactccagcttctgcatttgatgccaaccccctgagaggctgagactttgccaggagaactcagggcgaatcatatgtatgctggattagagacttttatgagtccaggatgctaagtgtgtatacatagtagcctgattatttaaagcagattaaaaaatgtttttatgtagcaaatactatttaatgaggggcaggaggctatgtgcaggtaaaaagtctttccttacagttgattctacctctctaccttttatcctccagcaattgagtcagtatgttccttagtaaagttaatattgccaaaggctctgagccaggtagatttggtaccctgtgtgtcaaacatggggctacattatgccctgtaaattttttattattattattttgttttgtcccggttttttgagactatatagctctggctgccctggaacttgctatgtagactaggctagccttcaacacacagttcctcctgctgtgcctcttgagtgctggattaattcttggcccagttctattttttggatacttttgttttaactaagccataggatttttaatcctcatatgctagcagctaaagcaggaaactgaaggtctgaatgtctgaagctagaggactcagtactctgtgttcagcccaattgaaaccaatacaagtataatcttacgttttctctctctccttccctccctttctcctctcatccctctcctttcaacagaatcttactgtgtatgtgtagccttggccgcctgcaacggaactctgtagataaggctggcctggaactcacagagactcagctgcctctgccttttaagtgctgactttgtaatctgcttgcttatgttttgttttgttttgtttgtttgtttgtttttccagacagggtctctttctctatctctgtctgtcctggaactcatcatgtagactaggatggcctcaaactcacagagatctacctgcctctgcctgccaagtgcttggattaaaggtgtatatcactacacccagctataatttgtttcttcaagggcagcttcaactgaagatttcaaaaggaagtttccaactctgaatcttttcttatacgtgatttaaaaagcccaagaaagagaggaatttagactttccatgcatgccagcttggcctttccacaaactcttgagagaaaaagcatttttgaattgagttccactttcatattcagacattcaccttagagcttgctactgggccatatcacgtggatgctggccttggacactaggcaagagttaaaaggctaagattatctcaacctgaccttttttttcatttaatttagtaaaaaaaaaatttgtataattcaaaaaaaattttttgatacatacatacagctgtgaaatttaacaatggatttatgtaactgccactacagacgggatctaaaatagcagacttcctctgccttccctcttcagccactagtctgctgtccttcacgtggttttatcaataagctcatatgaagggaatcatatacagtgtgtaatcttctgaacctgcttcattatttaccatgatgcccttgggatttacatgggctactgtgtgtcagcagttccctttttactgctgagtcatagtccactctgtgtatgcagcatactttatccacccaacaaggatacttggacgctccagtttactactagaattgctatgaacattggtgtgggtttgtatttgaaacaaggtcttgccatgtatcccagcctagcgtggatgaaacctaacatcctcctgccttagcactcttgaatgctgacattacaaacgtgctccaccatacctagcttgattgttcttgttgggtttttttttttttttttttaaatacagggtcccttgtaactacagctggcttcaaacttctttataaccagagattaaattgaatttccttttaaaaattataaacttgatatgtacaggtattttgcctgcatgtatatctgtgtaccatgttcatgtagtgcccttggcatccagatgagagtattagatcccctgggactgaagtcacagatggttgtgagctgccatgtgggtgctgaaaatgcaacctaaggtctatagcagagtagccaatgagttctcttaaccactgagcaagcaatggcttcagctcattactttgaacttctaatccccctgcctctacctcttgagtgagtattaggattacaagtgtgcaacaccacaccttgtttatgtgatactgaggatcaaacccagggctgtatgcatggtaggcaagtattctaccaattgggctacatcccctatgtctaatttatgtatgtctctgtgtgatgtgcttgtataagcatgtttattcatatgtatgagcacatgtgtgtggacgccaaaggctgacgtcaggtaaagacagcttcttgagttgctctccaccttatatgttagggcaggtctctcactagaacccagaatttgctgatttggctaggctagccagccagcttggtctggggatcccctgtggttgactcctgagtattgtgactacaggcagacttccacactcgcccgaagtgctgatgtccaaactcaggttctcacccttatataggaagtgttttactaacggagccatctctttatcctttgtgtttgtctggttttggttttgtgtttgtttgtttgtttgttttgagacagggtcttatagcctcagtaaagctggaatttactgtatagactgggctggtcccagacttacggacccttgcttgcctctgcctcctaagtcctgttatacaaatgagcaccatcacatccagctgttacacaagtgagctctatcacatccagctgttacacaagtgagcaccatcacatccagctgtacacaagtgagcaccatcacatccagctgttacacaagtgagctccatcacatccatctgttacacaagtgagctccatcacatccatctgttacacaagtgagctccatcacatccagctgttacacaagtgagctccatcacatccagctgttacactagtgagcaccatcacatccagctgttacacaagtgagcaccatcacatccagctgttacacaagtgagctccatcacatccagctgttacacaagtgagcaccatcacatccagctgtacacaagtgagctccatcacatccatctgttacacaagtgagcaccatcacatccagctgttacacaagtgagcaccatcacatccagctgttacacaagtgagcaccatcacatccagctgtacacaagtgagctccatcacatccagctgtacacaagtgagcaccatcacatccagctgttacacaagtgagcaccatcacatccagctgtttttatttttgaacaagtttagtttatgaatatttatctgtgtgtttgtttgtttccttgtttcaagacaaggtcttactatgtagctttgttagacctggatctcactatatagaccagctggtcttgaactcagaaattaaaggcacagattatgttttgatttaatatctgagttcacttgaccttttccccatcccattttcttttttttttttttttgaaatatttatagatgtgtagtttttaacttctgatctttttgttgttttgagacaagatcttgtcatgtagtctgcgctgtccttaacctggctatgtagcctatgctgtctagactgtgctgcctctgcctcccaagtgctggaattatagccatgagtcatcatgctcagttcttaccaagatctctgcttaactggtgttggttggaatggaaggtttaaatattttgtatttggatgttctgttccaacatttctcattgaggggtttttttgtaatgtaacataatctttttattaatcattttattcctttacatttaaaatgatgttctcctccttgggttacccctccacaccccccccccatctcattcctctctccctcctcctctttgcctctatgagggtgcacctccacccattcatctaccccacctcacccctctagcatccccttatgcaggggcatcacgcctccacaggaccaagggcctcccctcccgtcgatgctagctaaggccatcctctactacacatgcatctggagccatgtatactctttggttggtggtttagtccctgggagctctggggagttcagttagttgatattgttcttcttgtggggttgcgatccccttcagctccttcagtccttgccctagttcttccattggggtccccaggctcagtctgatggttgggtataactgtctgcatctgtacttgtcaggctctggcagagcctctcagggaacagccataccatgctcctgtcagcaagtgcttcttagtgtcagcaatagtgtgggggtttggtgtctgcagatgaggtggatcccaaggtggggccgatcagtctctattccatttttttgtccctgtctttcctttgcaaacaggaacatttctgggtttaagattttgagatgagtgggtggccccatccctcaactgggagccgtgcctatctactggagatggtcactacaggttctttctcctcattgttgggtatttctgcttaagtcatcaccattaggtcctgggagcctcctgcttccctggcatctgggactttctagtggctacctccagttccccatcccccactgctacatatttctattcagtagtataattaactttttcttttttagtattactcagtattctaattctttagtctttctatttcaattttaatatgcccttgtctatattacaaataatctgttttggaattttaaagaaatacactggctgtgcagatgagtttaggggaatagcatctttcctatgctgtgccttctcatctttgagcatggtgtggctgctcatgtgtttagaatcttatttcctttatcaggctattgtgggttcagcattcagattttatgagtgtttttggactcacacttactattagacttccacttaaataattgctgtttcttttcttttccttttttttttaaagacaaagtcttaccatatagccctggctgtcttacaggtattgagacaaaaggtgtgtactaccacaactggctctaagtgtttattttggagtagttagttaattgttagcatgtaaaaacaaggtccagttttgttatgttgatcttatgtcctgtcaccatgctcaacttgcttattctgagagatatggggacgtgtgtgtgtgtggggggggtgtatgtgtgcacacacactaaaagagttttatttcttttcttttaaattatattttcttttttcttttttttttttttcggtttttcgagacagggtttctctgtgcagctctggctatcctggaactcactctgtagaccaggctggcctcgaactcagaaatccacctgcctctgcctcccaagtgctgggattaaaggcgtgtaccaccactgcccggcttatttacttttcttgttgcataggccagtacttctagatctatgagaatggacaagtttctattctcacctactaggccgaatatattcagtactttaaagtatagtaaatatcaactttttgtgggtgttaattataatgaatggaggttatgctttgtcagttaccttccttcatcagttgacataatcaggtatttttcttctcgagaatgttgatatgataaaatgattttcagatactgactccaccttgtagtctcaggatagcctcagttaatcttggcatagtgtttttgtggaatattgttacattgagttggctaaccttaaatgaaagctcagagtgacattgaaagaagcaagagtggtactgtccagaggcttagacaagtcctgggacattcaggaagctctggatatgctcctgaggaagaccacagatagttatcaaatcagagatgaagtagtatacttttaacacattcctcatctgtcaaatgaagtagttaaactctatgactgctaaaatatatttattccagcattttattctgtaaatcatggcttcataggaacttagacagtagaaaaatataaaggctagattttatttgtttgtttggttttagtttttccagacagggtttctctgtgtagccttggctgtcctagaactcaccttgtagactctgtttcccaagtgctgaactaaaggcataagctgctgctaccaccaataccaccaccggcaattttattttttttaatgagcccacaggaatcttcactgtcacccagctccatcgctttctacaagacaaagaagaatcctggtgtgtgcagttaactttcccacaggagcttctccttgatggaagtggaggtgtaagcgccagattcaggtcctgatggccaggggcatcggagaggcttagcaggggcaccgtctgccactggatgtgcagggcggggtgtcagggaggacttcactgattgaaaggttacatctttgtacatgtgcaattaatagacagattagaacatcaataattaatcccagtgaagtgttcagatgaacttccaaagtagagcttcttaaagtatctgctgaagggctagtggttctgtcttcatggttttttgtcaatgcattgcacctgcagagttttaaaaaacataataatattaattatgagatttaaatcatatttttaaaaatataaacttggtttggtttaagacaggaccttcctgtgtaattcaaaatacacaattatgccttacctaggattatagacataaaccatcatacctagcctattactaaatgctaatctgtcaaattgttaataccatctctcaatttctgtctttctcattgtataacaagcaatagtttgtagcctgtactggtttataatatgctagaaaaaaatataattttcaattgacattgtagtaaatattccaaatcctataatattataggaaaactaggccctaaaatatttttaaaatgagataactgagatggagtaacttgtataatgacacaagcctgttagtgttagaactaagactagaataaggatctggtagagtcagggtaggacgtagccttaagttctgcaacttagtagatgtgtcacttcagttatttaacttctctaagtgtctcattttatcaaatgaataaatgaagacagatgtggttgtgtaaacctttaattctagcactcaggaggcaagagcagatggatctctgaattagaggccagcctggtctacatagtgtattccaagccagccaaggatctataatgagactatctaaaaaaacatttcaaattcatggggctggaaaggcggctcagtggttaagggcacttgctgctcttcgagaggactcaagtttgggttctaacatccaaatcaggcagcttagaacaacctggagatagatagatagatagatagatagatagatagatagatagatagatagatagatagatagatagatagatagatgtatgtgtgtgtgtgtacatatgtgtgtacatatacacacatgtactcacacataaacaaaagtaaaaacatggattgttttaaatacacaaacacacacagatttaggaaaggtagaaagggctactttttaaaaaaaaatgtttgttttggtttggtttggtttttttcaaggcagaatttctctgtgtagctctggctgtcctggtaagaggccaaacctactccatcttgggatgggcctccaccttaagagaaagttcacctataactgaacccaggctgtacccaagtaccaggaaggaccccataacttgtcctttgcccatatgccagagttactccctagctactttctagcaactgtcaaagatagtttgtttctgaaatacattcagaccatctgtgatcattcagggttttacttcaggataccccctgtcgcatacagtagtcacacaactaggtgcttgccaggcttacagtagtcacacaactggatgcctgccaggctggaaccccccacttgctcaccatttcctataagcctgtcccactgagagcttgggcctgcaccctcccattctactgtgttagagacagctgtgtggcccaagctgtagcttgtaaacaaaggccctagattgcatcagagtcggctccttggtgatcttttgggattcatgagcacttcctggcacaacactggaacttactttgtaaatcaggctggacttgaacttggagatctgcctgcctctgcctcccaagtgatgagactaaaggcatgtgccaccaccatcctgctaataataaattttaaaaatttatttatttacttatttattttgtttttttgagacaaggtttctttgtgtagcaccgagtgacctggaactagcactatagactagactggcctcaaattcacagagatctgtctacctctgcttcctgagtgccgggattaaggtgtatactaccactgcccactttttttatatttacttaaaacttaaaaaataagttctttaacagtatagagaactttggactcggactctagggttaaaaacccctaaataataatatcttattgtacttactgtatactttatttcatgcattatgccctgtatatacacaaaatgagaaaatgggtataagtcgcctatcatagggcctagtacatagtagtatttataataaatgttagctggtattattgatgtttagttaactttaatactgtgtttgttagccgggcgtggtggcacacgcctttaatcccagtactctgtaggcagaggcaggtggatttctgagtacgaggccagcctggtctacagagtgagtgccaggacagccagggctacacagagaaaccctgtctgggaaaaaaaatactgtgtctgtttcttattttgttatatagggttttactatgcagctcattctggttctgaactccatgttctcctgtctcatccatgatcttaaaaggaatagaagttaaagataaattccaagataccagataacttgtggcccttttaattcctatccacttcaaggtatccatatagcagagaaaggagctgggcgtttgtttcttgtctagatcgttagtcttgcgagaatactgatttctcactccttggcgggattgtatttaacttgagggctgtatccagggcactccagagctgttcatggtacgtaacttcttgattggactgttcatggcctttttagaggagagaaagataataagaacagccactatttagtactttgtgccatgccacacaccctatacctacccaataacctatctttttctctttgtaagcttcatttttgtagattaaaaatgaaactccaaaaaaatacggagacatacttatagttaagattataaaactaatgagtgccaaaagctggagtcaagtcctggtccatctgactccaagagctctctatgccacttagtcactcaactttattgcttcctatgaaactacagcagaaagaaaggtttctggtgatctactctcaacattggccttcctcaagactagatttacttagatacttttcagagtccttctgaagacaagtatcatgacgctgctcatagtaggcgtactgaataatttcacaaccaaggagatacgtgacaccatagaggagcagacagagttccagccctggaaagtggcaacgtaaggcacaaacagtccagtaaacaaagcgtgctacggattaggtgtagggttctctgaaggtgactggtgcgtgttcttggattggagaaacagttttaaggaggaaaatcctagccctgctggtgaaagaagtagtggggttctcttaaaatcaactgcaggttcaatttctgactagtcaaggccacagattgtagagtctctaaggtcagattaatccagggcagaaggcaaccttcttgaggtgacttattacattgtccttagcacttgctcaacactagtgaacaggaagcttggctccctgtattaggacgttaaaacagagaagtcacactttgcccccctagtataaatctgagaactgcccgtgcccaccaactctcctgtcctctcaaatgatgggtgacctgaccaaaggggagatgaatctgacagtcttctcaggtcagagcctgcatgtgacttcaagcattgccctttgacaaaagaggacagacactcctagcctgctctcctagtgcatactaccctcccaggaagggtgttctcagctgcagtagccttttctcatgtggccagcatcgggctgacacattcctgaactgaaatgcacacataagctgctttccctggtctcgaagctcttcactcctgagtgactcttatcaggggcagttgggcattctcaatgggattacgctgacaaggaaaaaggcctgggggatgttatttcaacaccatttagcttcagaaatgcctgcctcaacccttttgccctcggagtctacttctctcttcctgctttctatagggtcatcagcctgccttcatcatagctcttcatcctacagagattgactaaggtttctagaggcggaatcattcacaagatggatcacactgacgacatcatgtaaatcaccccatgatagaaacacacgttgttcatttaaccctctttaatcatgtgttcatttcatgtatgtgagtacactgtagctgtcttcagacacaccagaagagggcatcagatcccattactgatggttgtgagccaccatgtggttgctgggaattgaactcaggacctgtggaagagcagtcagtgctcttagcctctgagccatctctgcagcccctcccccctgacatttctatatccagaggcatagggcaaaattatttgagcacaattcctgtttggtttttctgtctctcctgacatactcaaacttagcagggattgttaggtcaccatattctacttttcgcactattgtatatactttttattcaagattatatttcttctgaaagtcagagcttgagagtattctacaaaagaaatttctgaagtgctggaagtttagtagttaggagctatgaggtttttgatcaccaggggacataaagagtagtgggacaagcctggtatgatgacacacacctttaatcccaatgcttgggaagcaaaggcaggcagatctgtgaatttcaagtcagccagggctatatagtaaaacaatatctttttaaaaaaagaggtgtggggacaggcaccaggcagtggtgacgtatgcctttatcccagcactgggaggcagnnnnnnnnnnnnnnnnnnnntgcatatgaatattttgcttgcatgcatatatgtgtgtaccaccatgtgtgcctggtacctgtggggtttagaggagagcatcgaatcccctggaactggagttacaggtggttgggagccactatgtgggtgctgagactagaacctggtaacaacgtatgctctcaacctccgagccatcgctccagcccccaaatataaataaattttattattatttttgtgcgtgtctgcatgtacatgatgggtacagataggtacagaggccacagtgtgtgagcagcagcagaggaccagtttgtgggggttggtcctcacctttaacatttatgtgggtttgggggatcagacacaggttgccagtcttgtgaagcaagcgtctttacccactgagccacctcagcagcccacgggatgggtcttaaagctaaacatgtaagactatgatttctagagactacaaagtagctgagccagtttagagagttggtgtatagagacagacaaataggtacatatttgtataatactggtgcagaattcatctaaaatactgttcaatgtatcagtcacttcggggttttggttctgtgcctgctaggtcagtattctgccgctgagctgattcccagccaaggttttgagatcaacctagaagggtatttggatattgttaaaaatcggtaagaccgggctggtgagatggctcagtgggtaagagcacccgactgctcttctgaaggtccagagttcaaatcccagcaaccacatggtggctcacaaccatccgtaacgaaatctgactccctcttctggagtgtctgaagacagcgacagtgtgcttacatataataaataaataaataaataaataaataaatctttaaaaaaaaaaaaaaaagaggtgtggggacaggcaccaggcagtggtgacgtatgcctttaatcccagcactgggaggcagaggagatggatctatgtgaccttggtctataaagtaagttccaggacagccagggctatacagaggaaccctgtctcaaaaacaaacagagttgtgtttgaaagctggccatgataacacgtacctgagatagcagattgccatgagatcaaggccaacaagtgcgccaacctggatgacataacatttaaaaaaaaagtgatccactcttaacattcaggaggctgaaacaggagaatctgcaagttggaccctatcttgtggtggtccataacaagtgtaaggccagccttagccatatgggatgcccctgtcttcagaatgtatgctgctaaagcaagcacaggagcaactctgtctttaaaacaaaacaaaacaaacaacaacaacaaaaacacccaaaccatcatggtaaaggaggagccatgcagtgtcttttcctctgattgttagctttaaagttatccagacctgtgaatggtcacgtgggcacataggcttggttttacaaactagttaatttcagggggaaaaaattgccagaggcaacttccactaacctgtaattcctgatcctaaactgatggatcaaagctagataggcctggcaactgtgctctagtctatgagagaaatgaaataaagaaacgcactaggccaagtcttggttcaggtactaaccctgtgaccaggtacaaaaatgctttacttttctgatccatagtgtcttcatcgacagggatttcctaatgaagggcagaggagagctggtgattatctttgctattgtgattatttaggagtgaagccatggaactggagacatgacttagtggttagaacacttgctctttcagaggacccaagcttggttctcaccagtcacatcaggcagctcacaactatctgtaactccaattccagttgctccaacacctctggcccagaagacagctgtgctcagacatgctcacatgtcgccacgcataccttcacagaattaataataagaaaataagcctgctggcatatgcctttaatcccagcactggggaggcagaggcaagtggatctatgactttgaggccagcctggtctacagagtgagttccaggacagccaaggctacacagagaaaccctgtcttgaaaaggaaaataataataataattttttaagaatgaagataagtcaggtggtggtggtgcatgctggttctctatgagtttgaagccagcctgtccatagagcgagtttcaggacagccagggctacatagagaaatcttgactcaaaaagaaaaaaaaaaaagagtgaagccattgtgatggtgtatgtctttatctcagcactcaggaggtggaggcaaacagttctcgatgagtctgagagctgacctggtatatgtagggagtccagacaatgtagggctatataaagaaactgtttctcaaaacacatatataatgattaatgtttttattaaattaaaatttaaaaaatgatttcagggctggagagatggctcagtagttcagagcatgagcatcaggcacacatatggtacacagacatacatgcagacaaatatacatgtaaaatagaactaaataaatcttttaacaggaaattaaaagagaggcaagttaggggcttgccctcagacctacacgagagcatgtgtacacacacacactcgtgcatgcacatttgcttgggtgtaaatgctacctgtgtgcatttatactcatagaagccagaagaggacatcagaacccctggagctggagttacatctcttaagcctccaaggcaaatatttttataaagtgaaaataaaaatattttggaaagtattcacttattagtccgccaactgacccaacttgggttttgtttttaaacacttatgttattttaggaattctactttttagttaagataatgtgtttattggttggtactgggggttgaagccaggaccttgcaggtattaggtaagggctctaccactgagcttcatcagccttaactcagtgttgaaacggggtctcactaaattcctctggctgatcttgaactccatctgtagctcaaccaggctttgaatctataaacctcttacctccgtctcttaagcaactgagatgacaggcatgagctacacagctgcctctaatttggttgagtggctagactctgattaaacacgagtgattcatcagcttgcacatttaagggttaatgtccaaaagcctgaggattagaaatcataaacttacatttccttctaactgtcttgatagtttgcaggccatgttcacaagtacccagagatgatagagtcaaaaatgacataaaaactcatccttcgtagatatctgccacaaaaagtttcaagaccaccagtgaagaaaggggctcttgtatgtgctctctggctggaccaccttgtcaaacaaagtctccaccatctttctgtccttgcagcacagtttcccctatgggggagattagaaggatgtgaaacacagcccaaccacacatgggccaataaccgactgctttccataaacctctgtgcctgaggggcttgaactgttttctgcagttaagtagggttaacctgtcttgcttgagatcacatttcacttcccctttaaaaaggtaaaacgtgctggagagatggctctatggttagaagtacttgtttctcttgcagaagacccagattcagtttccataacccacatagtggatctaagccatctgtaattccagtggcaggggatctgacaccctcttcagacctctgagggcatcaggctcacacatggtatgcagtcatacatgtaggcaaaacacttatacataaagtgagattagcttaagggtagggtacagaaggaaaatcctttactgtctgtcagtacagtgcgtggctcctggttggaacagcagtaaaggttggctcacttagggcatccctgctagatggctagggtagcttgctactaaaggtgctacctattacttcatgcaaatcctattgctattgtgttgcctgggaaaagaacttgaatgcctctctcctcaacagtaaactgcatggtaattgtggtgcggtatatcctgtaatctgagcttcaggaggttgagaccagcctgggcaacattagtgagacaggccatacttagaccattttattctctcagtaactctaagaaaccataccaccatcttcatttttcactaataaagaagtgaagacttccacaaattctgatactcaaggtcatacaataaaaggaaaacagaatttgaatgtaggtcttgttaactccaaagccagggtgtataaactctgcattacattctttaaaaatataccaaactatttctttttctttaaggagcaagtttaaagggtttgtttatttatttattttttttatgtacattgatgttttgcctccatgtcttactgtgtttgggtgccagatcccctggaactggagttacagacagttgtaacctgctttgtggatgctgggaattgaacccagatccactggaagaacaggcagtagtcctaactgctaagctctctctccagcctcagtaccaagttatttctatagggtgactaactatgactaaaatgacaaataaaatgttatagctcaactatcctaggatttagtttcttctgttcctcttctcctgccagtggctcaacactgtattgattggaatactgccctctaaattaagccttaggtttgtccaggttcgctcctaatccaggagggagagccaggcccctttaacaaggccagcagtctaaatgaggcccgtagggactgtcctcaaatatcggcttgaggacagactgagccatcttcctccctggagcacaagtttgatgtgtgagctttaaacactaggttttttggtttttttttttttttttttcctagagggaaccggtgagcaattcgtctgtagcatacaggcaagctaaatctgctgtagttcttactctgcatgcactattaccaccaagcccagactcaagcaggcagtttcaaagcccaggagaaattaaaaactagtgttgccctactttatagcatgttggtgcaccccagcttcacgcagccattgcacttggagcagctttttcaatcagaattcctcttatccagtaaaaagtttcattctccaatagcatcaagaagagaagatactttataagttcattatcaattaatgccctgtcaggtatctacagaggacttaaatagaaaatacaaaaagaaaactccaaactgatattagtaaaatttctagctaatgagcctaagaggtcagtagccaaagccaagaatctccacatcccgtaagcatcaacaaccagaaccgttactacagctccttgtgctgccagtactgaggggtcttgagtgcttctgctaccctcttgtaagacctttgtgatacagggacatttccattttacctgtggagggcaaaagcatcagacctgtgctgcaggagctcaccgactctgcctgcgaggaaacaggaaactccacaggaaacagtccacggagcaacagtcctttgaatggtcacatgtcactctgcaaagtgctcagaaaagtgcccaaggcagctgaacctaaatatacaatcttgaaaggtttgaagaacaatgccacaaaacaaggagcagtagccaggctgctagcacatgtcctatcaacagtgtccatctgtctgtctctcttatcccaactctgtcggcaatacagagctgcatttctggtaatgttgcattctaggccaaagtgaatggttaatatttttgacagttacattcgagagataatgagtttttaagaaaattctttatgtttgggtcttgagagatggctcagagcaaagagcacttgtgtctctgcagaggacccagttctgtcccagcacctacatggtggctcacagtcatccctaactccagtttcaaggaacttgatccctgcttcttacctccacaggcaccaggcatgcacatggtgcacgtacatacacaggcaaaacacccatacactaaaataaataaataaatccaaaaaatattaaaaagtatttttagttccagtttgcttaatgagacctgtcccctctctctctctctctctctctctctccctctctctctttctctctctctctcacacacacacacacatacacacacacacacacacacacacacacacgacaaaaaagagcccgatatggttccacacccccatcattctagcacttaggagttagaaacaagaggataaggagttcaagaatagtctaagctacataaaatcttgtttcaaaggggggggggggaatctaaaaatgcctaaggttcaataaagtgactctaagcatcaaaccaaaatacaatagataaaataaatattgataattgggtttcacaggaaggtggtgatacacacctttaactccaactctcagaagtcagaggcaggtggagctctgagtgagtttgaggccagcctagtctacagagtgaattctagaatagtcaggattttacagagaaaccctgcttaaaataaataaataaaaagaaaatatgtctgctgtataatatataaaggatggaaaagactgaattcagatgagataagaagtgtcttatagcgggcggtggtggcgcacacctttgatcccagcacttgggaggtagaggcaggcggatttctgagtttgaggccagcctggtctacagagcgagttccaggacagccagggctacacagagaaaccctgtctcgaaaaacaaaaaacaaaacaaaaagaagtgtcatagagcagaggtgctcagccttcctaacacctcgtccgttaacacagttgcattcctcgtgccatgctgaccccaaccacaaagtgattttctgtgttactttataactgtaattatgaattgtaatataaatatcattgttttctaatggttgtaggcaacccctgtaaaagggttgttttacctataaaggggtcacgacctacaggctgagaaccattgcttaaatggacaggtgatagtaaactggagaaactgatgtccttcagccagtggatggctacagaaactatagaacatacaaggagaatagaatagtattcagcagtaagtagggacaaaccattgatatgcagcagctcgggtaaatatctcaagtatacctaccaaacatggtcatgttttagatgactgacagacatggtacattgttttcctaaagcagcaagagaagatggttttaatttttgtgtgtgtggtcacttgttcatgcagatgtgcatacagaacatcagacattttcctccattgctgtctaccttatttttggggacggaatttctcattgaacctggaattcaccttgtcagctaggagcccccccacacacacacacacacacacacacacacacaggagttagagactttttttacccaggtgctggaggtctgaacccaggcccacgttcttatgcagcaagcaccttactcagccattccccggtctcatggtacatttcttaatgagcctttaaaaagtgttatgtatttcacccttcctaactgtattctctctaccttaatgtctgttaacacacatgtgcatgctctcacacacgcacacatttctctttattttttttctgtaagtcatcaatctctaggtggatccagtggggaatgagaagcaggttttgtacagctgatgtgatcactatacagacagccttggaaaatactacccaatctgccagttaattaaagcgttaatctgggaagcagccggcccagaaaatgtttactcagagaggaggaaaggtagggactgagtagggagtgccctacatttgcatgaaaatgaagcgctcgctcacgcactcagccctacagccctactttccctcccctcagtctctaaggtgggatagccttgatcatatccctgaaagattctggcctgtttgggaaaactcaaaaggaaactagctctgaaaactcaaaccacagtagagtagaaagaagcaatttaactgtcagcaaagtcaggtaggcaggaagtccagagtagtgtgtcttaccctggactgagatctgctacagtagacatatgtgctggcagtgaggtagggtagatgtgtggtttgggaattgtaaaaccatgtaaatctcagctctgcttattgtgtgattcaaggccaatcatgatcttatctaaaccatactttttctcaaagactgtgatgctccttcatctcaggacagttagctacctgtgtgctctgggaaagaggggggaaagagggagggaagaaggtgggttaagaccttgcaagattacaaactgtcgctatgactggaggctgctcagcctttgcttattccaggcttcctttccatcagggaactaaaatcaggtttccctctctcccaggaatgtctttagttaacaaggtaaagatcacctgtgtatcactaaagaaatgatgaaatgagtgtagaaaattgactaaataagtattgttggtttctttccttttttatttttgtttgtattttgaagcaagagtagcctgctatgtagtcctggttgccctggaactagctctgtagataaggctcccttcaaacatgtagtgattttcctactgctgcctcctgaaaactggggttagaatatgaactgtcacacctgatgtccagctttgttaatttttttgattgtgctcaagggctgagaatgtagctcattggaagaatagttgcatatgcagtgtcctgaactcaatctcaagcatacagacaacagtaatgaaacaatattctgtatgacaaaaaaactcacccttttaataatcttactattaactttctaaatgttctttttaaaaaatattaatcttttagagctaaatcctaaaccttttacagataaaaaggttgtgtcaggaacttaattcaaggtattttagggggaagaagattgacccaaacaaggagccctctaacttcattcaacagacaaaaatgaccttttgccaggattaatttttgttagtgtcttttcatttttgatttgtgggtcttttttttttcttcttgttttacttgcagaactctcagagattgagccaaatgtattccttcgtccatttctggaagtcattcgctctgaagacaccactggtcctatcaccggcctggcactcacctctgtcaacaagttcctgtcctacgcactcataggtaagcacttaggctttggtggcatctgcagcactccatctcctgctgcacaggccttaaaccagctggtttgcccagctgtccctttcctagtagagacataggcctacttattctcaggatgctgattggctgggttatccatggagggagagaagagagaagattgcctgggactctagtttccaccacactttggagagttaagagtgtggttcccttgtaggtttagtttgccttttttgaaaactacctttatttatttatatgcaaaggaacaagcatgtttctaaaattacacaaaacaggaagcagggaaaagggacatgcacacagacaggtccccaatggaggtcagaggacagtctgtggcataggttttcttctcccatcatgtgggtcccaagaataaaactcagtcattaagcttgacagcaagttcctttatgcactgagctatctctccctctggctggtttgccttattttccaattttgtgctgattttaagaaaactatgtagagacgtctgaaagaaaagaagtctctcctctctgtcttagcgccaaaatctcttctttaagtaaatggtgttagtgacatggcttgactgcttttatctttttcttgatgcatataaatatgaacacacgcacacccctccacatttacacactcatcttaagacaggtctttctgtgtagcttggaagttgaagtcctcctgcctcagcctcccaagtactggatatagacagtattatcttttttaaaaaatatttatttagccaggcatggtggcacacccctttgatcccagcacttgagaggcagaggcaggcagatttctgagttcgaggccaacctggtctacaaagtgagttccaggacagccagggctatacagagaaaccctgtccaaaaaaaaaaaaaaaaaagatttatttattcattttattttatgtgaatatgcgtgtccctatatatatagatagatagatatagatgtgatctatctctctctctctctctctctctatatatatatatatatatatatgtatatgtatatatacaccacatgcatgcagatacccacagaagccagaagagggcgtcagactctcctaacactgtagttactgcgtttatgagcaatcccagctaggtgctaggaactgaacctgagttttctagaagagcagagtattcttaactgatgagccatctcgtcagcctgattatcccccctttttttttaggtgggagggaggggatttgtattatatattttctgtatttcacataatagtgtttatttgatgtatacacataattatatagttgatttattcctttctttgtaggaaaacacacacacatacccctataattttaccttttaacctttttttttttttttaagatagagcacaaggtggcctcagattcattatatagaatggatactgtggatttcaggtcttcctgcctttcccttccatactgggataataacccttttgctcccacatccagttttatgaagtgttaggatcaaaacagtgacttcatgcattctaggcaagcagcctacatccacagccccctttaatcaattgaagaaaataatttcatagttttagtcatgtccacagcattgtacaactattcctaacaaatgtttctcaaactttttcatgccccaacagaaatttaattatgaaataattccccattttcctcctcattcctccttgatataatggtgtatttttatttaatgtttacattattctctttttaaagccattataaataagctgaaataaacccctgtgttcctacggccatatttactaattttatctctgtgtgaagtgttataggttacattttatagatggcttccctagtaggttagagcattttcatccctaccagcaatgccctgggcgtttccatttctccttgctgtcttcagcccttaggattaccagttttctgttttatgtgtgtgccactttggtgggcaaaaatctgaatgttgttttatttccttgaggttgaagcattgagtttcttttgtctctattttggatttgttttaacagttgtaaaatctctttgtataggcagctacagtaaggcatgaagctgaggctcccgtgcctggagaagtggagaccttacccactcacgacctggatgctaggaggtcgcagaaactcagggttccttagcttgagctcatcagaccttgtatcctgccaaactccctcaggtcctcgtcttctagtcagccagcttcagagagacttgccagcctcggtgtctgttgagagcccattatctatttattgtattgtaaagttctgttctcagtttatacctcttattgcactcagtctagagtggatctctggtttttgtttgtttgtctgtctgtcctcactagaagggcttgaagccagggcctcacacctgctaagcagggagtccacctccgagttgtgtctccctcagtcagtttgagaaggtgtgtatttgggttcctttttagttggtcttgtcacttagaattttaaatttatccccctattacaacccatgtaaaaagtgaagagcaaagaaaacaggcagctgtttttgttccaaaatggagagacaaggtgagatgaggctcaggttcgagccagccaaaagcaaatgaatgaatgacctttaagttcaggaagagaaaactctttatcttctctagaaaattggatttgtttagctaatgcattcaggattctgagcaggagtcttgggtgtcagccaggtcgtgagtgggtaaggtctccacttctccaggcacgggagcctcagcttcatgtcttactgtagctgccagcctcgacctgagcaccacctgcaggtcatgtctcttcacagcctcccgcagctgcccttctgcgtctttccctttgatcttttctccttcctctgtccccttcctggacttggcaaagaggctggtcattggagacctgaggccagctggtcaatggggtttcctgtggtgggaaaggagaatgttgggggtgatgatcattataggcatgcgaaacagacactgaggctgccaagtctctctgaagctggctgactagaagacgaggacctgagggagtttggcaggatacaaggtctgatgagctcaagctaaggaaccctgagtttctgcgacctcctagcagaaaccaccccctgccctctggatcctgcagcccaaggcttctgagattattttctgctccacaaactgacctttagtttcgtcccatgtacctgcaggtcatgagttgtagcactgactggcagtagcttgctggcaggctctacctgtgattctaaggacccatcactattacctgccttcttgaaaaatggactttgctactttgttcaagttaaaggaatgaaaatacaaaaagatcaaaataatttaaaccactttatcactaaattactgaaagagagaaagaaacagactcccaggatccttgagatgtgagcaaggctgctattcactgaaatctgacatgtcttctaacacaagaaagacctagctttcctgtggccctgaaggcctcaataaggactttcaagcagggctgcaagagtgtttagacaggggccataaagaataggatttcccctgctgattgagggagccgggagggtgataggggagagagagagaggctggatcatcactggctctgagtcctcaaactcctcccctttgcatgtctctctagaagccacttagtacttaaaataagacagagtcttggacatgtcagaggctagtgccaagaagacagtagagaaaagacaacagaagtactcacagttaacagaagtcttctggctcattgttgaaagagaaatgctcaggtttcttggcaatcccccaagctttaggctcaggaactctgttaatttcaggtaccaaaaaggggaaaattgccaggtgtggtggcacagaccttgaaagcccagcactctggagcagaggcagagggacgaaggttagcctggtctagtgagtttcaggcaagccagggaccttgtctcacaaatgaaaaaaaggagggaggggtggcaagagctgactcctaccaccccgtcgggagggctcttgctctccgcgctgcctcagcctcagcacagcctgagcttcatcaggcctttcttcctgcttttctccgtgagctcacttttcaagactaagcagcagaatggactcttgagagcaagcagccttctgcaggactctcagcatcgctggaggcagcttcttagcctgcttctggtggctatttgccacaagagtaaaagcagagtttctctctccacagaacttaccatcagcttctcacctcttttccacagctgaaatcctgcctgctcccagtccccagcctccagccccattccgattgtttcgttttcctcctacagcctggttagttaaaggacaagagttttgtttaagctgggtgtgttcagcacatgctttataattccagcacttgggaggcagaggaaggaggataaggaattcagggccacacttagcttcatagtgagttcaagacatacctagacttcgtcctgtcttaagaaacaaatctaagtaagtagatgaaaacaagttaattggagtaggtggcaaggtctttctatattatagtcctggttggcttcaaactcctaattctcctgcctcagcctggcaagttctgggattccaagtgtatagcactacacctggccttagtaccatgattcttgctgagtgttgttttcaatgagaatgaatatacagagccttggatctgctatagtatgccacccaaagagcagcactggtagctcaaaccatctgtttcccctcattcccttaattcaattgcaccagaacacacaaccaaaacaaccaaagagaagtcatgttaaagatgagaagagaaaagctgtaaccttggcattcaaaggtctgactcagcctgctcctttttcaagacccttatactacaaaatgagtagcttaccactagtgattcctcaggtgtgtccctagaccagcagaatcaactacctgagatcttagaaatgcaggctcttaggcctcactgtaccctacaaaatcaaagcttctagggcctcagttggtaaagcatttgccacacaaacatgaggggcttgagtttggagccctactacctacccagagaaaagctgagcactgtaacaccagctctggagagctgaagaaagggggctcactgtggctggatggcctcatcactgcgctccacggggtgtgtgtgtgtgtgtgtgtgtgtgtgtgagagagagagagagagagagagagagagagacacaagagcagcagaagaagcttctagaagtgagccaggctgtgtgtgtgcttaacaaacactacaggtaattttgatacataggaagtgcttttttgagttggtggagaatttctctttttcttttctttcttttttttttttttttctttttgtgacaagttttctctgcataaccctggctgtcctggaacttgctctgtagaccaggatggccttgaactcacagagacccacctgcctctacctcctaagtgctgggcttaaagacatgtactaccaccactagtataatgggtaaaatttttaggttgctaaaaaaaatcataaaagcaaatcaaaacaataggttaggagactcatgagaaggccagggtcttctccaagcaattatagacaggctatcttccctttcctgtcttcttgacataatttaatctgttcttttgccggagcagatccaactcatgagggcacagcagagggcatggagaacatggcagatgctgtcactcacgcccgttttgtgggcacagatcctgccagtgatgaagttgtcctgatgaaaatccttcaggtaagtgggaggggagaacaaccaggctaatggccaagagctcgtaggccggctctacttgctgggtcagccggcagcagtgtgaagctcgtaggccggctctacttgctgggtcagccggcagcagcgtgaagctgtgctttgattccactgaggctttagagactcactgtttccaaacaaggagctcggtacccaaagtaaaagctttttctaagggaaatagttaagagctttaaatgaattggtatcaaataccagaaacccttactccatcttgtgcctctggtagactgtgtctgtgtcgtttatctgttaggcctgtgggctagagatccagtgagttatgaactatgtcaggactgtgcgaagcaaagagaggactcccaggtcaggtacatgggagtagctattttgagtttttgttttggggtttttgttgttgttgttgttgttgttgctgttgttttgactcagggtttctctgtgtagccctggctgtccaggaactcactctgtagaataggctgccctcaaactcaagatctgcctgcttctgcctccagagtgctgggattaaaggtgtgcaccaccacacttgttttaatttttttaattttttgtttttgttttggtggggcagggtctcatataactaaggatgaccttgaattcttattcctgttttgacttcccaagtgcttgtgacattttacctagctttaaggtcagcttacttcttgctaacttaaaaaagaaaaagaaaaagaaaccctgaaattgggcatggtcatgcatacttgtaattggaactcgtaggagactgaagctggagaccacaagttcaacctaacctggactaaatagcgtgatcttatctcagacaaaacaggcagtaaggagaacctcacccctaagctgggcatgttgctcactggtagagcactggcctagcatatgtgagtttgatctcctgagaagttagctcagttagtgaactttgtgccttataggcatgaagagaagtgtgagattccccaatacttatgtaaatccccaggcatagtggtgagagtcccagagaagcatagccaagaggatcctgggtattgctggtcaaccagtctagcctaatcaatgagttctaggtcagtgagagacccagccttaagggaagttggtccacatttctgatgttgatatccatgtactagtgtatcctccacatccccaaactacacacataaacacacatgaacatgcacatagcacaagcaatgatgatgacgatgaggaggaggaagaggaagggaggggaggagaaagggaggaagaggaggaggaggaggannnnnnnnnnnnnnnnnnnnaatttacttttccatttttgttgttttttcgttggttggttgatttttcaaaacaagatttctctgtgtagctgtcctaaaactcgctctgtagaccagacagtcttccaagtcagagatccacttgcctctgcttcccaaggaaagcccagctctctaggtgtgtttacaaatcagctgtactcaccctgctttgttcatcagtgtcttctttcttccttgtaggttctccgaactctgttgctaaccccagtgggtacccacttaacaaatgaatctgtatgtgagattatgcagtcttgcttccggatttgctttgaaatgagactcagtggtaggtccttgaatactatgtctttcatcctcctggggtatatggggatgctgtctctgaagcccagagaaacaggatttatccatcgtccaccttgggtaaccttaggggggttgttctgaagctagaatagagttctcaacccactattgtagggcaggagttgggatgaatcttagtcagactcgcttccagaaccaaatcttctcccttagggtttctggaattgacaccaattgataacccaagaaaacccttctagtgtgtcccctttttcctgactccgtagtaccacctagtggtctggtaacgttatagctccaggctgagctcgagctggttttaataagtttggcataatccttggtaaacacagtttggaggggagtctgctctgagaggtctcctgataatagcacagcaagtaatgacacctgtgttatttgtttttgcctgtgcagagttattgagaaaatccgcagagcacactctggtagacatggtgcagctgctcttcacaaggtaaacctgctgctgtttgcttctgcccggctgcccaggcctcctgagtctgcctgcttccacacagccactttagggacctggccaaccccacaaccacatcagaggccactgggactgtagatagcaatagttctctgggcccagggttactgagcaagggagaaggaagagagaactcccgtggcctcagggaagcggagggttatttaatctctgcttcccaaacttgtgtctgtttctgtgcaggtagcatctgggaaagggagcacagagaagatgccaaatttaagcagcctagaacaggttgctgagctccctaaacttagcctgattttgtacaagaaggccaaggcttgggtaaccaacaattgtaaaagctgacttaattggcctttatcttggcttgcctgggacttcctgatgttagcactcaaaagttccatatcctggcagaccctttagttccagggaaaccttgatctttgatttccctaagaaggactccctcatttggagcccaggaaacctttctgtcctagatcacattgcctattctatacttcctttccaaagatacactgagggaagaatcaaagccatgacttttcaaccaatgagatttctttttgctttcagacttaatccctattatctgtacattaaactgttctcggattctgctactgagagtttcttacaccacggattcaatgcctttgaaacaccaacctgcttttactttctaggcctgactacctcttggcttttagcagcgcttttcagtgatgaaaagagccttcgaactccaagggtgcttagtcactctgtcccagtgactactttgtcaatatcttacatattacaattcctatagctccaaagttccaaagggggtgaaattagctcttataagaagcttgtttctaactaagagacaagatactgtgtgccaatgcaccattactggatcaggtctagagaagaacattgtcattatccccagtgacggtcatactattctctgtcttataggttacctcagtttaaagaagaacccaagagctatgtgggaaccaacatgaagaaggtggggtctgaaagttcgtctgctgtcccctgtccaaaccaccttaacttctgaacttcagtactactattgcttagtagcaaagacatgctttcacttagatgggtctacttgtaatctacaaataactgtcactcctttaagtcagaaatacacctcctgtgtgcgtctcctttctccacctttcctctctgacctacctgtctttgttgaccaaccacatttgctagtgagtcaatccttaaggaaactggacacagcttaccaagctggggtaaagatgcatgttgacaaaatgaaaatctggccatcccatttggctcagtcttgtcagcaagtaagagtcctagagaggctgtgccccaaatcccctcctcgtgctgattaagactcggcttgtgcttacgatggtctctgttgaagagaccaaatcaagctgtgctttggatcaaagggttcccagatttctgagaaaagaatggtgatcgggatggcctttttctttcttgagctgaaactctggacatctcagacctctgatgaggttctgcccatggcaatgacccttggctatttggtgcatgcacctgacctgcccgtgttccctcccattcatccccattcccgccctgtgccctgctggcgcgtgtctgagtttgttttactctgtttaaatcgtgcatttgcctgtctttcacagatgtctccatgtctcctcagcaaactggagctaagtagtggggagcagaccaaagccctgaaccagttagagagggtactactctttaagaacctcaaggtctctctccctctccctttcctccccccttttggtttatttatttaaatttttttttatatgtaacactgggttccatttctgttgttcagagcacaacttacccgctctataacagcttggcttttgaaagttgcatgtgtttatagttttgcagtactgggaattctcctgggatttctggttgcttggaagcagcatgaagccttaaacatcacaaaatgagcctagaaaacgtgggtcctgctgttatcgtgtgggaaagacccaccatttctggggaaactacagggacctcaagcgagatccttctcccctcccttgtctcagagctggagtagagagcgtgatagtccttgtgtaaatctgaatacatggctatgttggtgggaaaaggtgtttcatcctgtgagaagtgttgttgttgttgttacataaaagggatcattgcaaagtttagatctctaggtcgatagtaaggaactagggaccaggacactgggaattttctagaatctgtcctttaaaattcaaaatgtaggtgagtttagggaaggagtgtgagctcaagattgcctggcccttaagatacccttgcctttaaaagatgagacaagtaggggataaaggacgtccacgtgaccatgacaaggctgtacacgccagaggtgatttcgagcattcagtcactgcggatgaattaactctgtgagtcagggttccctagcaaggggtctctgtcctatttgattgcattgtctcaattttttgtgtttgcgtagttaccaatttcagctctcttcactgactgattagcctgcatgttgtcatgactattagcctaagatctgcgctattcttataaagccactgttgtctttcagaatgtagaattgtacagataaagtggtatagggttctgtggacacctgctgcctactatgcaccttagagccttgggacacagaacatagcagcagtgaaaccttcatgaaaactaccggccttcaggctcctggaccagtcaaaaggccaggaacactcactgaaataacctagttgaagctagatttgcaaaacgtaaagtagaagataggcgataccaactcgtatttggaaaggatgcccattactgactgtcattcttactagaagtggggctcatagagtggaaaggagaggtagcttatgaagctttagtcgtttagactttttgaagcttagtgataatcaccaataaagccaaatggtcctcgttttctttccttggtcttttgggtttcttgcctcctgtttggcttgttctcttagatctttttctaccatgagtgtgatctacctgaactcctaggttacttactgacgagagcatcctggtccctgtctagtcacagaagctcatatttaggcataggactccaggtgttttagagatgggagaacaagaatatgaatccaataagaagctggtaccgtgttaaaaactgggagaaagttcagtttgggggcctcctttattatgaggagatttggggaaggaaggaagaattatcctagcaggtgatcagaggctatcaaagctttgagagagagagagcttgaagaaggaattttatcaccaaatatcagaagaaaatgaatagatccttttaaattgtatctagtggtgctaggaatgtaactcagttgcaagagtctttgcctagcatatacaaagccctgaggttgaaccccagtaccacgtaagtggagtggaggggggaggggcacatacctgtaatcccagctcttgggaagtagaagcagaatgcaaagctcaaggtcatccttggctacacagtgagtttgagacctgctcagggtacatgaggctctgtctacgaaaggaataacataataaagtaaaataacgtgtacctaggaagaacaactgtaagaagagcaagacgttttattgctgtatcaaaattaggagtagcagcatggcaaagcctccattcttaactcaacaaatcaattggcgtgtcactcttttctctaaaaaaataactttgaccatccattttaatacaggatttccagaaaaagagttatccttatggtctaagtcccagtctgtaccttagtgggaaagctttgaatctttcttgatagggaggggtaggtaggtgctcatacctagacaagaactggaactaggagctgccctgcagctgactgtggaagaaagtccgtgcacaggtctgtagtctgaggctctgggcaaagcctgccttacgttttcagcaagaggttcgtgcatcatatacagcaccagggacccaggaagcagagtgataagtgtgccagctggctatgtcaatgactagtcaaaatgcaaggtgtaaccttccatgtggaagcctctgtgtccatccgaaaagctgtaaatggaaaggactaagtgtatattctgatggtttagattatttagtactgatgtggggtgtaagtggttttttagggaccagcggactgaataatgagatattttaggagtaacatcttagtttaaatactcttttagtctggatactaattatacatgatatttccagctgaaaatgagagcaggaggcatgagtgactcgtccaagtggaagaaacagaaaagatctcctcgacctccacgtcatacaaccaaagtcacaccaggttcagagctgcccaccccaaatggagccacattaccctctaaccttactggtgagtgccctgggtcacttcttattaaaacacacagagaagatcctttctttatcagggatttgaaatggagagctggttaactgaggggttttggtctttctgcagagaacagaaagggtaacgccaaatcaaatcagactatgaccatttaatgaccctgcatcaaacaacttcagttcattcacttttcatagattcttattactctagaggcgtttatacatgagcattcagtctgagcaagaccctggtactgtagaggatgtgttactcacaaacggtctctttgccttcaagtttcatgcttttctttgtcaggtggtgtgcccttcattgatgcacccacatccatctcctctgcaagttcagaagctgcctcgacagtagtcagtccctgtacagatagtggcctggaattatcctcccagactacctccaaggaggacctcactgacctggagcaagctggctccccaagggagatcaccaccagtgagcctgggagcagtgagatgggcgcttctgatcagcttgaccctcaggtaggactgactcctgaaggcccctcttcagatctacatgtcactgtaggaacctgagcctgggccaagtatggtggtacatatctttaatcccagcactcaggaggcaaagactgatggatcaaggccagcctaatctacagagagagttccaaggcagctagagctacatagtgaaaccctgtctatttaaaaaaaaaaaaatgaagaaggaaggttggtaaaggtagttcttccctgtgtcatagttagagtttccatctttgtgaagagacaccaggaccaaggcagctcttatgaaggacaacattaaattgggctggcttacaggtttagaatttgagtctattatcttcaaggcaggcaacatgcatccaggcagccatgtcactggaggacctgagagttctacatcttgttctgaaagcaacgaaaagactgtcataggcagctagaaggagggtctcaaagcaaaccccacagtgacacacttcctccaacaaggccacacctactctagtgccactccctgggccaagtatattcaaaccactgcatactgtttcctagaattatttttgctgaccagaaaacctacagtatgactgtgaagaggagctcaggagatttatcattgtcattataggcagcatctgaaaaaaaagggaggtggcgacttttgcaggatggtaatcatctaaattctaagccttgtgagagttttgcacccatagagtctgtcatcttagacaatggttcctcaggtggccctgggccatcttctattgatgtataaatcaatgagctgtagtccatttgaagacagcttggaagccataaaattcaggggaataaattttaagtggttttttgcctcctttttgttcatctgtctgactgctcttggtcctagcaggaaggggcccatgtagagaaggcccagtcagcatcggtggagtccatccctgaagtgttagaggaatgcacatcccctgctgaccactctgactcggcctctgtccatgatatggactacgtcaatcctcggggcgtgcgctttacccagtcctcccagaaagaaggtaggtactctctggaaggctctgcctattcatctcccccatcctaccagatagatattctgtctgagcctagagcagcttagatgaagtcatctgtcacctgtgaatccattttctagacagaaaatggaatcaagccataaaactcttagcatatatagaacttttccctaagtcattcagagagctagagcgacaattggaggagagcgggagcaatataaagcttaggacttttaagaaaaatccttggttctgattttatccattaagagataggtagtagagccttttccttggaggaaattaatatcctgaaattgccacagataagggctggagatgactcagtgggtgagattgcttctctgcaagtgtgaggaccagaactcaaatccctcgtacccatgtaaagagtcaggcatggctgcaggtgcctgtaatcccatttttggggttttcagacatgtgagtcgggagagtttgctgaaacaatgagtttccaggtcagtgagagacctgtttaaggcaataaaacagagcaataagaggaaggcatttgacatcctttgtgtcttccatgtgcacatgttcgggcacatacatttgtacaccataccacacctacacatgcatgcaccaaacacatataacacacaaacacaacaaacaagtttttgccatagacaacacagacctatgtggtatcaaacagctggggtatgtcttcccaccttttcaggcacagctttggttccttatggtcttccttgcatccgtgagctcttccgcttccttatctccctcacaaatccacacgaccgccataactctgaggtgatgatccacatgggactgcatttgctgacagtggctcttgagtcagcgcctgtggcccagtgccagaccctcttgggtctcattaaggatgagatgtgccgacacttattccaggtaagactagacttggttgttttttgagattgagaagccaccagaattccatgacctgcacactttaagttggccagaagccacagtaaaagctcagtaagctaaggacttgaggaaggaatggctaaatcaaaatccagttgtggtggtacatacctgtaatccagcacttgggaggtagaggcaggaagataaggaatccgaggtaactttcatctacgtagtgaggtcaagaccaacctgaacgacatgagctcctagctcagaaaaacaaaaccaagacagcaagacagctcagtgggtaaaagtatgtccatcaagcctggcgtgctgggtttgatccctggcacccagaaggcagagagagaggaacgtctctcttgggacacaccttttcatatgtgtccctgctcccctcctacacacaaataaacaaatgtaaaataaagtttgcttttaaaacaaatgacaagaaaaaaaaagagttcccttagaatgtaggccttctgaagcagccttactggtctgctctcctgtatcttcgttggttgagttacactcgacctcagaaacctaatggcttcctactctctgaccccagctactcagcgtagagcgcctgaacctttatgctgcttccctacgagtgtgcttcttactcttcgagagcatgcgggaacacctcaagttccagttagaggtaagtgtttgaccttggaaagtaaaacaagaaacaggagactacatggcattatcaatggggccagctcaatgaatcatgcttaagatagacttttttaaatttttatttattattctttcatacaatacatctcaaccacagcttcccctccttcatgcctcccagtgcccctcactttccctctccccacctccccactcccatctcagaaagagcaggcctcccagggacatcaactgaacgtggtacaataagacacaataagagcagatacaaggctgggcgaggcaacccactaggaggaaaagggtcccaaaagcagacagaagagtcagagacgcccccgctcccactctcaggagtcatcctaaaataccatatatgcagactctctaatgcagacctatacaggccttaagattgccacttcagtctctgtgagcccctgtgtgtcctgctgagttctgctttccaggtatcctctacccctctggctcccacagttcctcctctagtcttccactgcatttcccatctcagggagggacccagtggaaaacctgggctctctctccacccatttggctgtgggtctctgtatctgctctgagccagggacagaactgtgctaggtaccagtcaatgatatctgcgtatagattatcaataggagtcatttcattgactttttttggctagtgtttagttccaccataggtctctggactatccagcctccagttcctaatcatccaggcagtattaggcatgggctccctctcatgggataggcctcaaattaaataagtcattggtaggccatttccacaagttctttgtcaccattgcccctgcatatcttgcaggcaggacagattgtaggtagaaggttttatggctgggttggtatcccagtcccgccactagaagccttgcctggtaagagaagatggacagttcaggatctgtgccccccattactaggagtcctcactagggtcactctcatagattccagggagtttttgctacactgggtttccatatcaccaccaccaccaccaccccccatgccctactgctccagtcatctctccctgtactgtctccatctacccccacatgatccctcctattcccatccccacctacccccaatccacacacaaactctatttccacttcccagagagagccagttgcaccctcccttccccgcacccccaccccagcgccctctttgttacttagcctctctgggtctgtagattgtagcatgagtatcctttacttaacagctaatactcacaagtgattactgccagagttatggactggacttctggcagctggcatgacctctggtccaagtggaggcgggacaaggagaggtggggggttggggagaggatgggaggagtaccgggaaagtttgtgggaggatccaggaataggcagcctacctggctttctggtggctggagcatcctccggttgagcaaggctctgcccacattgggagttgcaatgccatgttgaggaagggaaggattattgggcataaggtgggggactctgagagagtgggggaggtctaccagtgggtggtctatcacaagatagagatttttatgagcttcctatagaaggcatttttggcctccctactttgtatcattgcctagccttcatagtagaatagttaagaggatcccagacaaaagtgtttgactataatgtaggagagcccataactgggcatgacagctcatgccagtaatccaagcacttagaggctgagacaagaagattcctgtgaattgaaggccagtctgggctacagagcaaaagtgtctccaaaaaaggggtagtggggggaatccaaatatgaggactggcagatcttaccacaaatagggcagcttttctgcctaggagttcttctaagtcaaaccagcattgctgctaaattgccaaaaagaagtctcaataagactagggtaggctttatagacaacacatttttaaaaggacagtagacaacttctttgagactggaaataggaatgagagccttatgggagacaaagcggggaatatattactgagaaggggctctttcggtatctcccaatacatgcctcctgagtgggcttttgcctcctgtttggtgttgttcctatccaattttctgttgccgtctttcctcaaccaaatggctgtcgctggattgctgttgacagatgtacatcaaaaagctcatggagatcatcactgttgaaaaccccaagatgccttatgagatgaaggagatggcgctggaggccgttgttcagctctggcgtatccccagcttcgtcactgagctctacatcaactatgattgtgactactattgctccaacctctttgaagacctcaccaagctgctgtccaaggtgctgagcactattgctacctctaggaactgtgaagaaatctctattgatagtagagaaagtggggcgcttcagcggtgggaacaggactgaggaaggcatttgtaagggcgatgagaaatcattagtgtttgggtttggggggaaaataatcaggtgaagtatattcctacctcaagtctaatggctctgttttctttccagaatgcctttcctgtgtctggtcagctttatacaacacacctgctgtctcttgatgcccttttgacagttattgacagcactgagtctcattgtcaggccaaagtcctcaacaccctcaaccagcaagagaagaaagagacagccagacctggctttgaggcagtggatggcaacccagaaactaacaagtgtgagaagcgtcttatattgttctttttctctttttcttttttgtctttcctcccaccccttcacttgccctccttactctctcttgaatttttcctatcagagctagctagtgtcctatataagaacatgcagctcttttttggcttgggactcaacctctttgacaatactgcttgacttcctgcccataagtcttcatatctttccctgttaccagctgagagagcaaccagtgatgggaaatccacaggtgtggccttagatgcccgaggccttcattttccaagtggaggatggttgtcaacagaacatggaaagccagggtgcagagatctgga

SEQ ID NO: 38 - DNA, 912 bp, Mus musculus
gactgaggctagttaccacgtcagtgagctgacagggaaggtagccggcaccaccgagcgtcccggcccacttactccagcctgcagtgaggtctcaccctgaagttagggttgccttccagaagacaggatccttcccttctctcactcgccgccggcgccgggagagcggccgggagacgcctccggggccaggctggacatgagctgcggctgccgccggttctgggactaggccccgccattttggatccgctgacaggtttgtcaggatggtggataagaatatttacatcattcaaggaagaaattaacattgttgttggtgccatcaaacgaaatgcccgatggagcacccatataccactggatgaagaacgggatccccttctgcacagtttcagtaacctgaaagaggtcttaaacagtgtgacagaactctcagagattgagccaaatgtattccttcgtccatttctggaagtcattcgctctgaagacaccactggtcctatcaccggcctggcactcacctctgtcaacaagttcctgtcctacgcactcatagatccaactcatgagggcacagcagagggcatggagaacatggcagatgctgtcactcacgcccgttttgtgggcacagatcctgccagtgatgaagttgtcctgatgaaaatccttcaggttctccgaactctgttgctaaccccagtgggtacccacttaacaaatgaatctgtatgtgagattatgcagtcttgcttccggatttgctttgaaatgagactcagtgagttattgagaaaatccgcagagcacactctggtagacatggtgcagctgctcttcacaaggttacctcagtttaaagaagaacccaagagctatgtgggaaccaacatgaagaag

SEQ ID NO: 39 - protein, 274 aa, Mus musculus
GLTLKLGLPSRRQDPSLLSLAAGAGRAAGRRLRGQAGHELRLPPVLGLGPAILDPLTGLSGWWIRIFTSFKEEINIVVGAIKRNARWSTHIPLDEERDPLLHSFSNLKEVLNSVTELSEIEPNVFLRPFLEVIRSEDTTGPITGLALTSVNKFLSYALIDPTHEGTAEGMENMADAVTHARFVGTDPASDEVVLMKILQVLRTLLLTPVGTHLTNESVCEIMQSCFRICFEMRLSELLRKSAEHTLVDMVQLLFTRLPQFKEEPKSYVGTNMKK

SEQ ID NO: 40 - DNA, 58845 bp, Homo sapiens
gtgaatgatggcattctgtctccaggaacatgggccaatatttgcagggtaaagaacatgcatgggagcaggctggtgaccctctagaaagcaagaagagagaagtagactctgagggcaaaaaggtcgagacaggcatttctgaagccaaatggtgttgaaataacataccgcaggcctttttccttgtcagcgtaatccaattgagaatgcccaactgcccctgataagagtcactcaggagtgaagagctttgctaccagggaaagcagcttatgtgtgcattttggctcaggaatgtgccagcccaatgctggccaaatgagaaaaggctgctgcggcctggagaacacagcctcctgggaggatggtggctgttcccttgtagcttaggagagtattctgttttgtccaagggcagtgcttgaggccacatgttgaggcctttgacatagattatcagagatggtagcagctctgacatgagaagagaaaataatgtcaagattcagctgggcgcagtggttcatccctgtaatcccagcactttgggaggccgaggcgggcacatcacgaggtcaggagatcgagaccatcctagctaataacggtgaaaccccgtctctactgaaaatacaaaaaattagccaggcgtggtggcttgcgcctgtagtcccagctactcgggaggctgtggcaggagaattgcttgaaccggagaggcggaggttacagtgagccaaaattgcaccattgcactccaggctgggtgacagagcgagacttcgtctcaaaaaaaaaaaaaaaagtcaagattcatccccattttggagaggtcacctcatcatttgggaagacaagaggtgtgggacatctgcagattctcagacagacattgggccaaattgacacttctgttttaatgtcataatatggggagtgaagcaccctgcccagtcgtattgagtacagtatgagcagaccaccaccaagacatctccaaagggcttcactttgctttgggttgaagtgactcatgagcctctccagaaataatttaataattcttgttgtaatttgtcactgactgtccagaaattggatccggatttgattctggaaggatccgaagtgttttctccaatggggggttagatttcccctccttgtgccctttttcccccagatgactggctcatcttagaacatggaccagtcaccttcagagcacctctctacctaatctgcactctgtgtttactggactgtttgtgccttgaggttgacagtcttccagggcgggaattttggctgcttggctggggtgtcagatgtctccttggttgtgaaattattcagcctgcttactatgagcagaatcatggcacttttctcctgaaggactcaggcagttttcactcttctggagaagatccagacaattgaatctcagttcccagccaggctgaaccgtgagataggacaccagaaacctttctgttctagccttgtaggaagcagtaaagtcggatggctacgagcagagcttttggagttggatggacctggatttgattcctgtttccactactagctagtgctatgatcttagctggtggggacatctcgttatcctttccaagcctcatttttatcttcaaaatggggttaattatgaagagtgaaggtatgtaaagtgcatagcacttggcatggcgcaggtaataaatgttaatgagtactttaataattcattttattaaaaggaagcctgttctttctctgataccttggagaaagctgaagccctcagaaattaaaagtgctatcccaaattgtaccgtaaatatcaaccacccgttatctcagtatttatccttaacttgtgtttgttttatggtttaggagtcaaaggtagaatttttatatatatatttacttaaatcttaagaaatgaactggtggccaggtgcagtggctcatgcctgtaatcccagcactttgggaggccgaggcaggcagatcacaaggtcaggagatcaaaaccatcttggccaacatggtgaaatcccatctctactagaaaatacaaaaattagctgggtgtggtggcatgtgcctgtagtcccagctactcgggaggctgagccaggagaattacttgaaccggggaggtggaggttgcagtgagccaagatcactccactgcactctagcctggtgacagagcgagactttgtctcaaaaaaaaaaaaaaagaaaaaaaaaaaagaaagaaatgaactggtatacaatatagagaacactggactgctgtgactctagagctaaaaactagaacaatatcttagttatctttattatacactttattccatgcattgtaccaagtgttttacatgcatcaaatgagatagtgtgtaaattgcttaataccatgcctggcacatagtatacgctcagtgaatgttagttgctattattatttattttaaatgtaatttatttaaattatctaatacccatttacaagtaataaaattagagacccagaacacttaagtaattaaagtcacatagctattaagttgcagaactgggatttgaatcgtccacgaaagcccatgattctacctagagcccttagcttctagtcctggttccaatactaactggccttgtacaaattacttaacttccctaaatctcagttacctcattataaattattttcaggccctattttagctgtaatatcctaggatttggaggattttcctgaacagtcaaaaattatgacttatttttgtagggtatggtttaatctctgagtaacagttccctagaaaactgatgcagcctacaaactgctgcttatacacaaagagatatatacagaagttgaaagtattttaaaaattttataacaatgtgacagtagttacatgtatgttgattctagtaataaaaaaattggactttatgtttttaaaatttttctagtaattaactgtattttataaaactatgggtctgcacgggctgggcgaggtggctcacgtctgtaatcccagcactttgggaggccgaggtgggcggatcacgaggtcaggaggtcgagaccatcctggctaacgcggcgaaaccccatctctactaaaaatacaaaaagttagccgggcatggtggtgggcgcctgtagtcccaggtactcggggggctgaggtggaagaatggtgcgaacccacgaggcggagcttgcagtgagccaagatctcgccactgcactccagcctgggcgacagagcgagactccgcctcaaaaaaaaaaaaaaaaactatgggtctgcagtggattgacataaagaagaaaaaactgctcttcatcacagataatttgacaagcactattctagataaccatctgaacatctcaccaggattataaattcaaatttgtttgtttttaaattacatgtttacaaaaagttaccccttaaattagaaatatccttactaaaggctggacgtggagactcacgcctgtaatcacagcactttgggaggctgagacaggtggaccacctgaggtcaggagtgcagtttgagaccagcctggccaacatgaagaaaccccatctctactaaaaatataaaaattagctgggcctggtggtacatgcctgtaatcccagctacctgggaggctgaggcaggagaatcgcttgaacccaggaggcagaggttgcagtgaaccgagatcacaccactgcactccagcctgggtgacagagcaagactctgtctcaaaaagaaagaaagaaagaaagaaatatccttactagtgatgccccactaggagttcaacttgcccccaaccccacttgttgcagagttgctcctgttagagcttctcttatgctcctggcaatcaacagttgaacctagagagcaaaactcttgttctccctagacaaaactctttaaggaaagttaactttatatatcatgattctcttttttggaagaggtagggaagtgacatgataatgaaggttcctggtgggctcattaaaaagtttaacccttctagtttttcatcagtaggtttctataaagcactgacttaccaaatgaaagtactggaatgaacatatcttagcagtcatagattccaacaaccttcttctttttttttttttttttttttgagacagagtctccttctgtcacccaggctggagtgcagtggtgcagtctcggctcactgtagcctctgcctcccaggttgaagcaattctcatgcctcagcctccaaagtagctgagattacaggcacgtgccaccacaccaggctaattttttttgtatttttattagagacatggtttcactatgttggccaggctgatctgaaactcgtgacctcaagtgatccactcacctcggcctcccaaagtgctgggattagaggtgtgagccactgcgcccagccgatttcaactatctaatttgacagatgaaggtcttgggtatcatatatctggctattgataggagtgagactagtccattgactgaattgtatgctgtgtgagggttacacacagagcctcggctgggtgcggtggcttacacctgtaatcccagcactttggtaggccaaggcaggcggattacctgaggttgggagtttgagaccagcctgacaaacatggagataccccgtctctactaaaaatacaaaattagctgggcgtggtggcgctcatcagtacagtgatgagagaaaccaagaagatctgaataatggagagacataccaagttcatgaattggtaggcacaacatagcaaagatatcatgtctccccaaattgatctatagactcaatgcaattcctttcaaacttccaacaaggcaagtttgtcttaaattgaaatggaaaggcaaaggaattggaacactgaatgatattggaaaaaaaaatgaagttggaggaatcacaccactgttattaagacttagtataagccgggcatggtggctcacgcctataatcccagcactttggaaggccgagacgggtggatcacctgaggtcaggagttcaagaccagcctggccaacatggcaaaatctcgtctatactaaaaatacaaaaattagccagacgaggtggtgtgtgcctgtaatcccaactactcaggaggctgaggcatgagaatcacttgaacccgggaggtagaggttgcagtgagccgagatcatgccactgcactccagcctgggtgacagagcgagactctgtctcaaaaaaagacttagtatatatcggcagggcacagtggcttatgcctgtaatgccagcactttgggaggctgaggcggacagatcacagggtcaagagatcgagaccatcctggccaacatggtgaaaccccgtctctactaaaagtacaaaaaaattaactgggcgtggtggcacgttcctgtagtcccagctactcaggaggctgaggcaggagaatcgcttgaacccaggaggcaaggttgcagtgagccaagatcgagccactgcactctagcctgggtaacagagcaagactccgtctcaaaaaaaaaaagacttagtatatatttataataattaacacagtgtcgtgttgtcagacttagacacatagatcaatgaaacagaacagaacccagaagagactcacaaaaatatggccaatttaatttttattttttggaacagggtcttactctgtcaccccaggctggagtgcagtggtatgatcacagttcactgcagcctcagcctcccaggctcaagcaatcctctcacctcagcctcctgagtcgctgggactacaggcacatgccatcatacctggttaatttttttttttttttttttgagacaggatctcactttgtcacccaggctggagtgcagtggcacgatctcagctcactgcagcctctacctcctgggttcaagatattctttcacctcagcctccccagtagctgggactacaggtgcgcgccaccatgccccactaatttttgtattttttggtagagatggggtttcaccatgtttgccaggctggtcttgaactcctgacctcaggtgatccacccacctcagcctcccaaagtgctgggattataggcatgaggcatgagccactgctcctggtccatgcctttttttttttttttttttttttgagacagagtctcgctgtgttgcccaggctggagtgcagtggcacgatctccgctcactgcaagctctgcctcccaggttcacgccattctcctgcctcagccttcctgagtagctgggactacaggctcccgccaccacgcctggctaattttttgtatttttagtagagacggggtttcaccgtgttagccaggatggtctcgatctcctgaccttgtgatccgcctgcctcggcctcccaaagtgctgggattacaggcgtgagccaccacgcctggccgtttttttaattattttctgtagagatgatctcactatgttgcccaggctggtctcgaactcctagactcaagggatccacccacctcagtcttccaaagtgctgggaccagtgcccaacctggtcaatttatttttgacaaaggtgcaaagacaacttaatgagatatgttggaaacagtaggaaattcttaggcaaaggaaaaatgagcctcaatctaaacctcacaccttatgcaaaaattaactgaaaatagatcataggtgaaaaacataaatctgtaaacattttaggagaaaatgggagggtggaaatctttgtgacttggaattaggcagagtcaatttagacattaaaccaaaacacaatccataaaatattaataagttggacttcatcaagagtaaaagtgtctgttctatgaaagatgttaagggaatgaaaaaataagcttaagactgggagaaaatacttagaaataactgtatcactactgaaggacttgaattcagaataaagaagtctccaaactcaatagtaagaaaacaatttagtttaataatggataaaagacttgagcagacatgtcacccaaaaggatatacagacggcaaataagcacatgaaaagatgttcaacataattagtcattagagaaatgcaaatttaaaccacatggagctactattacatacatacttgaatcgcttaagtaaaaacactgaaatacaaagtactgaagaggatgtggagaaactagaattcttattgctagtgggaatacaaagtgataaaatgacattggaaaagagtttgacagtaaagctaaccacacctttaccttttgacccaggaatcctacccctgggtacttaccctaaagaagtggaaacctgtgttcacacaaacactgatacacaaatgtttatagcagctccattcataattgccccaaactggagatcccacatgtccttcaaccagtgaatggataaagaaactgatacatacaggcaatgaatactactcagcagtaaaaagaaacaagctattgatatatgcaatagcttggaaaaatttcagtcatcatgttgaatgaaggaagccagtctgaaaattggctgtaaaattacatgctgtataaatcattcatttaaagaaaagaattaattttaccaaattagcaaaaagaggctgaatgcacatcaccctagaagtgtggaccccatatataaaactgccctactcttttaccgtgaaggaagacatgaagcaagtatatagttgtagcaactaaatgaaatcacagaaaatctgtacctgtcccgattctcaaagatttttttcctctagacttttatatgtcaaatatacctcatgaccacttttaagataacaaaccaaattgtacataattcatgctcctaaagcagcaagactagatgactttacatttttttatgtacttttttttttttttttgagtcggagtcttgttctgtcacccaggctggagtgcagtggcgtgacctcagctcactgaaagctctgcctcctgggttcacaccattctcctgcctcagcctcccgagtagctgggactacaggtgcccaccaccacacccagctaatttttttgtatttttagtagagaccaggtttcaccatgttagccaggatggtctcgatctcctgacctcgtgatgcgcccgcctcggcctcccaaagtgctaggattacaggcatgagccaccgtgcccggcccttttatgtgctttttaaaagtacgttatgtatttcagtttttcacacacacgcacacacacacacacacactcacacacagacacacacacacgttcttctctaggttttttctgtaaattttacatctctaggtgggggtagtaggggaagagaagcaggttttttttacagctgatgtgatcactgtacagacaagcttggaaaatgctacccaatctgccaattaattaaagcgttaatctgaggagcagccgggcccagggaatgtttacccagggaggagtgggggtggtaggaactgagtaggcagctccctatatttgcatgaaaatgaaggtgcttaggaaaccctgcttccttttgtctctaaaggtggggcagcctagatcacatccctaaacacttttggtctctttaggaagccttttagggagctggtctctgaaagatgaaagcacagcacaatctagaaaaacaaatttaaattctggtcagagtaaggtagggagtaagtacagtgtagtattctttgacctagaatggaatcttctaaattcaggagtaaaatttcatctatttaggtagaatagatgaaggggttttacaagttttaaaaccacataggctgggttcaaatcccagctctgcatattagttgtgtgatttgggactaatcatgtatcttatctgagccttttctcatctgtaaaataaagattatcaattgccccttcatctcagagcagttagttctctgctaactctaggcaggaaacaggccggacagtggttacgaacttccaagattacagactgcctccatgactaagagactgctcagccttttgttcttgttaaacttttttctcagcaagggattataaacctcagagtttcctctcaccctcctggaatatgctgcactctttctctaagagaagtgaccctgaccataacagcaaaggacataaagacaggagcccaccttgggacctaagggtcgcattggctctacccaagatgacgttacctatttatatcacaggggagggtggtgaaatgggcatggaaaattgactcacaatatttgatgatattgaaaaattattgttaatttttaaaaattgtgataaaatacatataatgcaaaatttaccattttaactgtttgttaactctttaagcataatattgtgggccaggcacggtggctcgcgcctgtaatcctagctctttgggagggcaaggcagggacaattgcttgagctcaggagttcgagaccaacctgggcaacatggtgtaaccccatctctactaaaaatacaaaattagccgggcatggtgacagacgcctatagtcccagctactgaggaggctgaggggcttgagccctggaggtggaggtttgcagtgagctgagatcatgccactgcactccaaagcaggactctgtctgacaaaaaaaaaaaaaaaaagataatattgtgtttttgttctttttttaagattcctaatcttttagatctacatgctgaaaattttacagataaaatgatacagtgtctgggatttgattcaaggtaatccagagggaagaagattgacccaacaacaaagacctctagcctcatggcacaaacaagaaactttttccagggtttagttttctcttagatgatacctcttcatttctgtgtattttcttgcagaactctcagaaattgagcccaatgtattccttcgaccttttctggaagtgattcgctctgaagataccactggccctatcactggactggcactcacctctgtcaacaagttcctgtcctatgcactcataggtaagagctcaggctttgttgcatgaccacagcacttcatttcccacctttcctggggtgcccaggccttaggcaatgagctggtgatagtgggaaattttttccagtcacctcttttcttgtagaagagaaataggattgttgttggttattcatcatgctagctgactcacgttgtacagggtgggaagggcaagagaagaagttttccttggcactctggcttctctatgctttggaaagagttaagggtatggtaccttactcttggaagtttggttaggtttgtttgtttgtttgtttgtttgtttagttagagatggagtctcactctgtcgcccaggctggagtgcagtggtgtgatctcggctcactgcaagctccacctcccgggttcatgccagtctcctgcctcagcctcccgaggagctgggactacaggcgcccaccaccacgcccagctaattttttgtatttttagtaaagacggggtttcaccatgttagccaggatggtttcgatctcctgacctcatgatctgcccgccttggcctcccaaagtgctgggattacaggtgtgagccactgtgcctggcctggttaggtttatttttaaagttattttttcaaacataatgcatgcacattataagaagacagacaatagagatgttcaaaagaaaagttaattgtccttcctgtactttctcaatgttcctcctccttctttaggcaaatagtgtgaacagcctagtttgaatctttatgtttttctatgtctttataaatgaagtaccattcctttttaaaatgaaataaggccgggtgcggtggctcacgcctgtaagcctagcactttgggtggccaaggcgggtggatcacgaggtcaggagtttgagaccagcctggccaacatggtgaaaccccgtatctactaaaaatacaaatattagccaggcgtggtggcgggcttctgtaaccccagctactggggaggctgaggcaggtgaatcgcttgaacccgggaggcggagtttgcagagagcagagatcgcgccactgtactctaacctgagcaacagagcgagactctgtctcaaaaaaaaaaaaaaaagaatagaataaaatgaaataaaaataggattatgtgctacatattttcttttttcatttaatggtattaacttgaccaggcacagtggctcatgcctgtaatcccagcactttttgaggccgaggcggacggatcatgaggtcaggagtttgagaccagcctaacatggtgaaaccccatctctactaaaaatacaaaaattagccaggcagggtggtacgtgcctgtaatcccagctactcaggaggctgaggcaggagaatcacttgaacccgggaggcggaagttacagtgagccaagatcacaccattgcactccagcctgggtgacagagcaagactccgtctcaaaaaaaaaaaaaaaaaaaaaaaaaagcagatagtattaacttaaatgtacatgatataactattcatctgatttattcttttatattgtagaaaatatatataaaacttgctatttccatcagtttcagtttacaattcattggcattaattacactcacaatgttgtgcagccgtcaccaccatctatttcccaaacatttttattaccccaaatagaaacttaacataatggggagttaacattaaccaataactccccatttctctctcccctcagccccttgtatgattttttttactagctctataatttccatagtgtaatatagatataacacaattcatgtgctcattcttaatatttaagattgtttcctattgaagtcataaataatgctaatataagcatccttgatcacatgtccttattaataatttttttaatttttatttttagtagagacggggtttcaccattttgtgccaccacgcccggctaatttttgtatttttagtagagacagggtttcaccatattggccaggctggtctcaaactcctgaccttgtgatccacccgcctcggcttcccaaagtgctgggattataggcatgagccaccatgcccggccccttattgctaattttactcttgtatgaaagatttctgaacttggaatttctggattaaagaccacgtgcatattgcatttttatagctattaccaggttgcttccccaaaaggttacatcatttatacttccaccagcagtgattgagaatttctacttccttaccctgtcatcagcactgaatattatcagttttatttgtgccaacttggtaagtaaaaaatgatattttgtttttattttttgagacagggtcttgctctgtcacccagactggagtgcagtggcacaatcacggctcactgcagccttgaccttcgggctcaggtgatcctcccacctccgcctcccaagtagctgggactataggcacacgccaccacacccagctagtttttgtacttttagtagaagtggagtttctccatgttgcccaggctggtcttgaactcctgagctcaagaaatccaccaccttggcctcccaaagtgctaggattacggatgtgagccattgcactcagccttttgttgcttttatttcctggaggctgaacatttgaatttcctgtccttcacttctttttttaattgagttgggtttgtttttcatgtcaatttgtaggagttctttgtatggtaggaatattaacccattgcctttcatagcattacaattatttgctcctaatctaggccaaatatttcccttaatctgtagtttatctctaaatttcttcatggtgtctttctttggatttcttttttagttggtcttgacactcaatttgggaattcattttccctgattggcagcccatgtacaaggatgaagaatatagaaaacaggcagctgtctttgtttcttaagcagggagacaagaaaagataaggctcaggctttagctagccagaaaagaaaatagtcttcagttcagagcaagaaaaccctttattctagaaatgttggatttgcttagctgatgcattcaggatcctgagcaggaatcctgggtaccaactagcttctgaacaggtgcatcagcctctccgacaccctagtcccagcttcatacttttcctaaacaaaatcaggcccagccacttccagccttgccctgagcaccacctgcaggtcatctttcttcacagcctccagtggctgccgctgctgtgccttttccctctgctgtcttgttggtgttactctttcctcttcctggacttggcagacaggctggtcattggagacctcaggccacctggtcattggagtttcctgtggtgggaaaggagaatgctggaggtggttattgcagtgggcatgagaaaaggagcaggaaggagtgtatgaaagccaagaaagcaaaggagatgggattggcagatttccctgaagttggttccagagtagccagaagaggaggacattttaaagaagggtttaggctgctcttctagaagaaaactcctgtctcttgctcctatgatccaaggtttcagggattattttagatcctccaaggactagccttttgtttggccccatacagctgccagaccagaatttttgtgccatggatttcatgggttgctagcaagccttgcctatggttcttgtcaaagacctgtcactctagtctgcctttttatttttattttttattggtttttattgagacagttcgctctgttgcccaggttggagtgcactggtgtgatcttggctcactgcaacctccatttcctgagttcaagcaattctcatgcctcagcctcccaagtagctgggaccacaggcatgcaccaccacgcccggctaatttttgtatttttagtagagatggggtctcgctgtattggccaggctggtctcgaactcctgagctccggcaatctgcccacctcagcctcccaaaatgctgggattacaggcatgagccaccgtgcccagcccataactgcctgtttagaaaattaactttgctacttcattcaacctcaggggacaagaactacaaagagatcagtagagcttaaaccccattaatggagtctctctgaatctattctggttgggggatggaaggagtgtctgattcaaagtaataatttaaaagacaccttaacaagagagattactgaaagagaggaagaaatggatccccaggagccttgtgagatgggaacaaggctactattcacttatctctgaaatgctacacaacactgagaaggacctgggtttcctatgtgggccctggtggcctgggtagggactgtcaggcagggctatgagatagaggccctgagagtatgggatttttttgtgctgatcgggagaaacgtggagaggtggtgtgataggaggagctgggtcaccccattttattatatgtcatgaaactggcttccttctgcatgacctctaaagtaactactcccagtgctgagtagaaggacactgtaaataggacaaagaaagtcttgatgtggtgtcggaggctaatgaggacagaagaaaaagaggaaacattcacaattagtaaaagacttctggcttatcattgcaagagaaatgtttgggggccaggcacagtggctcacacctgtaatcccagcactttgggggtccaggcaggcagatcacttgagcccaggagttcaagaccagcctggacaatatggggaaaccccatgtctataaaaaatacaaaaattctcctggcatgttagcacacatctgtagtcctagctactaaggaggcttaggtaggaggatcacttgagccccagaggtcgaggcagcagtgagccatgattgcaccactgcaccccagcctgggcgatagagcaagaccctgtctatttaaaaacaaaaaaagaaaaaaaaaagtttaggttctcagccatcccctgagctttaggctcaggaactctctgatttcaggtaccaagaaagagaaaatgggctgggcacagtggcccaagcctgtaatcccagtactttgggaggccaaggtgggtgaatcacctgaggtcaggagtttgtgaccagcctggccaacatggtgaaaccccatctctactaaaaatacaaaaattgctgggtgtggtggcaggcacctgtaatcccagctactcaggaggctgaggcaggagaattgcttgaacccaggaggcagaggttgcagtgatccgagatcatgccactggactccatctggcctggatgacagagtgagactctgtctcaattcaaaagaaagagagagaaaaaataacaacaatcttataattcctgtgactaaaattagggggtgttcctgcattacaccatgccacctctggagcaactttctctgtcactcacaaagctttttcatatgcctgccctttccccctacttaggctccccctttagaactaaacagctctggaaaggatccttcagagcagacctagggcaggagctaggcaagacccttgatggtgacaacttatttggctatttctcgtggctatttaatacatgaatgggagctgagttccctgcttaatagcatttgtgttcatttccagcgtggtgccggttgtctgacctctagcttctcccctcttattctgtacagctgaaattctccctcctgcctaccccccagctagtcagcctccagtcctgtttagtttatcttttttctctcctaatgcctgttaagctggaaacaggattcttgctcgtcgtcatattattttaaataagaatgaaactaaagaagaggtctttgggccaggcatggtagctcacacctgtaatcccagcactttgggaggccgaggctggcagatacctgaggtcgggagttcgagaccagcctgaccaacatggagaaaccctgtctctactaaaaatacaaaattagccaggcgtggcggcgcatgcctgtaatcccagctactcgggaagcctcaggcaggagaatcgcttgaacctaggagacggaggttgcagtgagccaggatctcaccatagcactccagcctgccaacaagagcgaaactccatctccaaaaaaaaaaaaaaagtcttcaatctgctgtaatgtggcactcagatatgagtattggcggcagtgagtgttcatttcctcctcctgctcccctaattcagttgcgcctgaacacaaaactccaaaagcaaccagagagagaagctgtgttgaaagatgaaaggagaaaaggccacaagctttggccctacctggttcttgttctgagtcaaaaactcttgtttccaggcccctcgtctatgaaattagtagatttatactagtgattcccagagtatggtcccctgctcggtggtgtttaacttcaactggggtcttgttagaaacacaaattctcaggccccactctgggcatacaaaatcaaaactttgtggtatgggtccagcaattgagaaccacagttttacccagtggattttgtgttgaggagctcattaaaaccagttatggggccgggtgcagtggctcacatctgtaatcccagcactttgggaggccgaggcaggtggatcacctgaggtcaggagttcaagaccagcctagccaacatggcaaaaccccatctctactaaaagtacaaaaaaaattagctgggcatggtggtgggcgcctgtaatgccagctactcgggaggctaaggcaggaaaatcgcttgaacccaagaggcggaggttgcagtaagctgagatcacgtcattgcactccagcctgggccacaaagtgagactctgtctcaaaaaaaaaaaaaaaaaatcagttgtgggcaaaaattctcaggtagctcaaggagccacgggttagggaactgaagaggaaaaactgtctctcaaagctagacaggctgccttaccttttatctctctcctctccacatcacttaatctttcctttttcgctggagcagatcccacccatgagggcacagcagagggcatggagaacatggcagatgctgtcacccatgctcgttttgtgggcacggatcctgccagtgatgaagttgtcctgatgaaaatccttcaggtaagcgagagggaaatagcaattaggctaatggccaggggctggtgccgcagactctacttactctgcccacagcatgaaactgtgttttgactccactggggcttaggggagctactttgtttccagacaagcagctggggtacccaaagtaaaagctttttctaaggaaaatcagtaaaagctttatatgaagtgatgtcaaataccagaagccttaaatacacttgtacctctggccgactgtatttgtgccgtccatctcttgggctcatgggctagggctagaatcagttctgaaatatgtcagggtcataaaaagtgaagaaacaattccaaggacaagcttcttggagacctctctaccaagctgaggtgaggtcagcattcttgctaacccctctctcttacccttgagtacctctcagtaccttgtttatcacagtaattcctttttcttcctgataggttctacggactctgctgctaaccccagtgggtgcccacctaaccaatgaatctgtgtgtgagattatgcagtcttgcttccggatctgctttgaaatgaggctcagtggtaggtgcttggatattagccccttcaccattcctggggccagtgtctgagtatgaatacaggaggctgtcttcccagagagatggaaaattcaggacttctccatcatctatctcatgcgatcataggggtctagaagaaatgtctgtacttggctattgtgaagctagaatagagacctcagcccattatgccagggcaggagttgggatggatcccagattgacttagcccaggcaccaaatcaccctctcttggggtttctgggattgacaccaacctgcaaccccctagaacacatctatacctccccttttttccctgactcagtagtgccacctagtgggccagtgaagttctggctgccaggctgagctggagctggttttaataagtttggcataatccttggtaaacaaggtttggaggggagtctgctctgagaaccctcttgataatagcacagcaagtaatgacacctgtgttatttgtttttgcctgtgcagagttattgagaaaatccgcagagcacactctcgtagacatggtgcagctgctcttcacaaggtaaacctgctgctgtttgcttcagcccggctgcccaggcctcttgagtctgcctgcttccacacagccacgtcagggacctggccaaccccacagccgcatcagaggccactgggattatggatggggggtagttctctgggcccagggttactgagcaagggagaaggaggagggagctgatttggcctcacggggaggcagagggttatttaatataggccagcagacctcattctgcttcccaaatttgtgtctgtttctgtgcaggtagcagctgggaaagggaacccagagaggaagccaaactcaagggatcatgatttctgtgggagagggccaaaattagggtgactagcaattgtgaattgcctgggactgtcctgatttcagcactaaaagttctgcatcctggcaaacccccctcagtcccaggcaaaccaagatggttggttaccctttggtaaggcccttagcctagggcctaggaggccttttcatactaggcctgtttcctgcacctcctttcaacagactcacagaagagctgaggcaatggctttaaaccttcctctgggatttctttttgctctcaaatctatagataataatccttattatctacagactagactgcccttggatcctgctgcaaagaattttttgctcctcaggctcaaatttactggtttcaaaacttcaacctgcctgttaattcttctcttttgcccactctcctagggttttgatagactgccctccccccatctcttggcagcagtatttgccaagtaaatataagcaggaaggaatcagtctcaggataaaaagagcctccacactccaagggcacttaccttgctctcacaactacctccttttgtccatgtcacacatcccccgattcctgtggctctttgatgaagctctgaaaaggatgaaattagtctgcttctcttttgtagccttttctaagacacagggcatgctctggctcagagcacctttggtttgtggctggcatggagggagacatttgtcattatccctaatgacagttgatggattttctatcttataggttacctcagtttaaagaagaacccaagaactatgtggggaccaacatgaagaaggtatgatctgagagctgatctgctgtccctcatccaaaccttaatctcccaacttcagtgccttggggtaaccttgcttagcaaagatatgcttttgcctaaacaggtctgcttggaatctagaagtagctctcactcctttcgtgagaaatgtattctcttccagatatatcccttcctcagcttttctgctctggcctatctttgaaccaccatgtaagctggtgagccagttcttcatggaaactgcatggtacccatcagtcttggctaaaaatgtctgttgacaaagatgaaagtcctgccatcccctcaagacttagccttatccgcaggtagaaggcctagagaggctatgtcccaaatcctacctcaatgctgaattagactgggctcttgcttgtgctagtctgtattgaagagattagtcaagttaagaaccaaagggttcttaaactgctaggagaagaatagtggtcaaaagaatggcttctttctatcttgaactgaagccctggacttcacgggcctctgatgaggattccgcttgcagccctaagagggtctacctatggagatgacccttagctgtgtgatgcatgcacctgaccttctcctctcccctgtcatccatccccattcctgccctgttccctgttggtatgtgtctgagtttatttcactgttaaatcgtgcgtttgcctgtctttcgcagatatctccatgtctcctcaacaaactggagctaagtagtggggagcagaccaaagccctgaaccagttagagagggtactactctttaagaacctcaaggtctctctccctctctttcccttcccctttttatttctttcaatgtttattttttatatataacacctgggtcccatttccattgtgtagagcacaacttactcctccctagtaacacagcacggctttggaagagttgcacgtgattgtagctttgcagtgttgggaattctcctggggcatctggttgcctggatacaggagaaggaagacttgaacatcacatagttagcctagaaagcctggggtctgctgttaccttgtggggaggcttaagatctaccatttctagggaaaccgtgagggaccttcaagcaagacccttcccccttctaccttatccttgtctcagagctggcatagagagcttaagcacagtcctcagctctatctggattacctggactgggtttggagggaaagggtagtccatctagttgggatcttttttttttttttttttcttggttaccattaaagaggtcattccaaggattagaactctagattgatggaaagaagccaggtgccaggatagcccaggacactgggaatactttgggatctgtgaagatgccctctgtcctctaaaagtcaaggtataggggagcttaggggagggatccaagctaaagattaccctaatctgcatatacctgccttaggaagaaaggggagagaaggaggtgtgggctgtctgggctgtccatcacaagagtgtgcatgctgaaggtgtggttgtggacatacaggtcactgaaagtaaaaaactctgtgtatgtacacctagctagatagtccattggcccgtgttctctttgaatgcattgtgtcatttcatttgtgtgcttgcacagtctcaagctgcagctctcattagtggctatccagcatgttgccatgattattaacctgggacctgctccttttttgtaaagcttacactgtcctttggagtacagagtcatacagataaggtggcgtagaattccatgaatacctactgcccaccccacaccttcagaccttaggagagggagaatagctataccttttaagggctgaggcattcgtgagaactggcagcctcttggcccctactccagccagcaggctgagaacactaattgaaatgatcaggttggagcaagctttgcagaagatagagaaggaaacgtgaaaaactgatcctcgtatgggaaggaatctcaatgactgactggcttctcagtggaagtaggactgcctggagtccctgaaatgggggagcctcctggagagaaaggctacctcataaaagtagatccagttcttagtacttttgggagctcaatgataactgccagtagagccaggaggtctctcattgatctcttggcctcttgcccttttgcatgtttggcggactcttctcccataacattttttactatgaacttgatccagttgagctccagtggttcctggggagagaatccttttgcttcctccttagctatagcggtcagtacgcctgaagctcagttctaagcatatgactgcaggcattttggagatggatcatctagaagtataaatccagtatgaggctgttgctatgttactaagagctgggggaaggaagggctcagctgttcagcctcatctttattggaaggagctatgggtaggaatggaagaattgtgtggtttctaagcaaggaatcaaagattacccaggttctgagagcttgggggagcttgaggaagggagtcaatccctcactatcaaaaggaattgaacaggccatggacaataggatatattcagcctttaggaagaggcagagagaaaaagtgcttctgctctctttagagtcattctaatggtttctggaagagtgttgccattgcccaatccaggaatggtccaatccaagaatggtctatcagtctaggaatagtttagaatgactttgtagagggactgagttcaaacccaactgagaaaacatcagggcttaaaaaacaaattgggccgggcacagtggctcacacctgtaatcccagtactttgggaggccaaggcgggcggatcacgaggtcaggagatcgagaccatcctggctagcacggtgaaaccccgtctctactaaaaatacaaaaagaattagccaggcttggtggcgggcgcctgtagtcccagctactcaggagactgaggcaggagaatggcgtgaacccaggaggcggagcttgcagtgagccaagatcacgccactgcactccagcctgggtggcacagtgagactctgtctcaaaaaaaaaaaaaaaaaaaatggggcctaaacaaagtaactttgaacttagaatggaggaaatacataaaaacacagatcctagggaatagttaacaaacaggtgatagagattgtcccttgccactaaaagtaagctataggaagaacagaaatacagcaagaggggagtgcaacagagcaaggagtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggctggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaaaaaaaaaatatgtttatggcttaggcccagctcacataccagtaagaaaaccaggacaggaaggaataggctcttatagttggataaaactacaagtaggaggctgctctacaagctagttgaggaggaaagccgagagaccatgcacctgcagaactgagtgtcagggcaaaggaaaccctgcccttacactttctgcaagagggtcatgcatcatccatagggctcgggatttcctgcttaatgtaacactcaggacccagagaagcagagtgataagtgtgaggactggccctaccaatgaccagcccagaaacagaatgtcaccttctacatggaggctgccatgccaacctgtgaagtggtaaatgtagaagccaagttagaagagtaggaatgtgaactgatggtctagagtcttactttagcaaagatatggggtatagcttgttttctagagatcagtaggactaaatgaagggagattaatagggatagagtcttagtttgaataccattgctaatggggtatgatatttccagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtgagtgccctggactacttcctctgattagacaaaagaagagctcctttctctcttagggattttgaaattgaagaccaaccaactgaggggctttggtcttggcgctgagaacaaaaagggaaactccaggtcaaatcagagtgtgaccattcagcaactatgcagtgacttaaggttgttctctgacaactttagagaccaatatatgcaaagataagcatgtaatctgggaaacagagaccctagtaccatagagggtttgttttgcccacagcctctttcttctccttcaagcgtcacatacttttcttggcaggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggtatggctttgatttttaatgtccctcttcagtattccactgtgggaaatggcttgatcctttggatcctttatgcaggacttggctcgaaagaagcttggggtaacttcaaaagaagctctgatctttcctgcttctcagaattggttgtactgccttgaaaacccacagcatgactcactgtgagagatagctcatgagatttatcaagttatgcatataggtagtacttgacaaaagggaaggagctggccattgctttttctggaaggtaatgatccaaatcctaagcctgtgagaggctctgtgtctctaaggttctagtcattgtaggtcagtgaagcctcaggagatgtttttctgagtccttcatcatactcctacctgagccatcttgcggtgattcataaaccactgagttggccctacatctgtagcccattagagacagcttggaagacagctacttcaggggagtaagttccaagttgctcttgcctcatccctcttcccatatctccctgctactggtcatagcaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggtgggtattctggtaggctctgccaattcacctcccccatcctacctactaagctgcctgagcctagaccgtcttaaaccaagatattggactactgcctgttgctccaagttctaggctattttctagtcaggaaatggagtcaagccatagactgttggcatggagggagcccttccctaacttatactacagggaggaagtttgatgggcaataggaagcaagaaggaagggaaaaaagcttaggacttttaacagaaaggtaggatcatcaattctgatttcctccagaagtagactagtcccctcatgtccccaggaaaaaaaaaaaaatccttttcctttttttttttttttcctgtcgcccaggctggattgctgcagtggcacaatcacagctcactatatcctcgacttcctgggttcaagcaatcctcccacctcagcctcccaagtatttgagactataggcatgcaccactgcacttggctacttttaaaaaatcttctgtagagatggggtctctctgtgttgcctgggctggtctcaaactcctggcctcaaacagtcctcccaccttagcctcccaaagcactaggattacaggcatgagccatcacgcccagcccttttcttcaaagagaatcacttacctaaaattgccttgtgtaatgcagagcaggctaggcaaagccagcagactagttgttttatagcagtctcactctcctcctggccttccccaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccaggtaagacaagattgctagagggtctcagagcctctttcaagggccaggggaacacagggaggtctggctgattacgcaaagagtataggacctaggaaagcatctccctcccagttggctagtagttttagtaagagggttccagtagttccccagggactctggcagccagagagaaatataggaatggctagatgtagagttccctggaagcaatggacctcagtgacaccttcactcagtttgcctcttctgcctctcttggttgagccatagtcagcttcagaaacctcacagccgggctgggtgcagtggctcacgcctgtaatcccagcactttgggaggccaaggcgggcggatcacgaggtcaggagattgagaccagcctgaccaatgtggtgaaacccagtctctactaaaaatatcaaattagctgggcatggtgacgtgcgcctgtaatcccagcttcttgggaggctgaggaaggagaatatcttaaacccaggaggcagaggttgcagtgagctgagattgcgccactgcactccagcgtgggcaacagagtgaaactccgcctcaaaaaaaaaaaaaaaaaactcatggcctaccctgctctcatctccagctactcagcatagagcgactaaacctttatgctgcttccctgcgagtatgcttcctactgtttgagagcatgcgagagcacctcaagttccaaatggaggtgagtttcttgatgtggaaagaaaagggggaaaaaaaatagggagatatatggcatcttcagtggggccagctctatcatgctacaggggtaggatttagggacttcctataggagagtccttttagcctccagagttcggttcaatcaactggcctcttttgtggaaaagttaaaaggagaccaaaggaaactggctgaccccaaatatgagaactgccaggtaaccttaccatgaatagggacagctcttctgcccagcagttactctgcaacacaggtaggtaagtcaagccagcattgtcactaaattgctaaaaggaactctaaataggaccaggtcatgttcacatagcacaaaagggcaagaggcaacttgtctgggaccaggtatgtggtagagagccaggccttatcccccaacatggaggccaaagaagagatatatttaggggatggaatacctttgggtgtctcttaatacatgcctctaggctgggcttctgcatcctgtttaatgtttttcctgtctaattttttctcttcctatcttgaatcctttccccacccaaatggcaattactgggttattgccagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaaggtgctgagcactataactggcttctaggaaaaaacgcattataaaggaaatctccctggtggtagtgaggatgttacatacagagaggggaacacttgagagctgggaaatagaagaaaggcattttcttttcttttcttttttttttttttttttttttttgagatggagtctcactctgttgcccaggctggagtgcagtggcgcgatctcggctcactgcaagctccacctcccgggttcacaccattctcctgcctcagcctcccgagtagctgggactacaggtgcccaccaccacgcccggctaattttttgtatttttagcagagacggggtttcaccatgttagccaggatggtctcgatctcctgaccttgtgatccacccgcctcggcctcccaaagtgctgggattacaggcatgagccaccacgcccggccagaaagacgttttctaagggcaatgtacaagttagaagaagttttggaaattttagaaaatgatcaaagtgtaaagtgttctcctaactacaagtccaattgatctgtttactttccagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatagtgagaggcatttctttctttgatgaacccagtgttctatgcttatcccttctctactctctgagtcgtttttcctgtccccatatcacttcccctgggatgctcccaattctgtttctgggctttggcagtttaaatcacaggccagtcaggcagattagtagaactcatagccttctccctttttcctcctccccactttggttttttacagaattattatttctttatggcaagagaagagaacagagattaaagaatataggatttctgtctctgaaagctccaggtcccaccatccctcatccccaatatctgcctccactctaattagtcctctctagctcccccttgaaatttgaggttgcagaagatcagggaaagtgactgggtaatctcttcattaaattagagaatctaatgcttggctgggacagggactacttattttggcttgggtttgtcctgctcagggctggcgccctgtgcaggaaccatgcaggtcttctgggcttgggatttgatctatcctgcagctctgcttggcttcataccctataagtcttcacgtatcttcttctctcttaccagctgagagaactgccagcgatgggaaagctgtaggcatggcctcagacatcccaggcctgcatctgccaggtggagggcggctgccaccagaacatgggaaatcaggatgcagtgatctggaggaagctgttgactctgggggtgggtactgggtgtccatgaccctaagctcctcacctggagggcctggtgaagagcagagggagggagcagacacctaggatagtaactaagcaagccttggtagcccgcctcgccttcagactcagagagagggaagcaaacatatggaccctcagttgataggacttccagggaagtggaagactggtgaggacaagatttctgaggctccttcttgaaactggggagtatattggtgaccttccaaaagtccttatctgggtaaaaaaaggtgttacagatatttcccccctcttcttcctactcctagctgacaaaaagtttgcccggaagccaccccgattttcctgtctcctgccagatccacgggaactaattgaaattaaaaacaaaaagaaggtacatacatgtattccccagcctctgtccacctctgtctgggtgtccagtgttgtagggtttccatctcagaagatgaaggagagtctagcacctcattgtacagcttcctgaggccagtctttgggcttgttgggacttcagcaactcccatttgaagcccttcccttactcctaagctatgtagttgagcataccctatgtatgcccctgcgcaaatgctgtaccagttgagagccaagtgtcactagtggcagtgacaggagccttgggagttggtgtcttgtgggtcattgaaggttactgtcatctccagctcttgcaagatgattggcaataaagggaaattgatattcattctggtgctttagtaaggttcaaatagtaaggttcaaataactgtttgtactttggatttctttttttttttttttttttttttttcagacggagtctctctctgttgcctaggctggagtgcagtggcatgatctcagctcactgcaacctccacctaccgggttcaagcaattcttctgcctcaggctcccaagtagctgggactacaggcgtgtgccaccatgcctggctaattttttgtatttttagtagagacggggtttcaccgtgttagccagggtggtcttgatctcctgacctcgtgatctgcccaccttggcctcccaaagtgctgggattacagtcgtgagccaccatgtctggcctgtactttgggtttcttaacacaaagaaaacctaaccctttctggccgggcgcagtggctcacgcctgtaatcccagcactttgggagatcgaggtgggcagatcacctgaggtcaggagtttgagaccagcctggctaacacgatgaaaccccgtctctactaaaaatacaaaaattagctgggcatggtggtgcatgcctgtaatcccagctactcgggagactgaggcaggagaatcagttgaacctgggaggcagaggttgcagtgagctgagatcacgccactgcactccagcctgggcaacagagtgaaactccatctcggaaaaagaaaaaaaaaacctaaccctttctttctcttattgccagcttaaatgactttggttcatgtgtgcccttgagtacctggccgtgactggacatacagaaatatgagttgcctccacagttagtccactttgtctttcaaacccagggcattaagctaggcaaccaaagaagctaagctaggctaaaaacaagaggctggctatcaacaaatgtcagggatggatataaaactggagagaagaattacctagtttctttcttctacttttcccccgatcctaagttagagaagaggaactgttttatgtatcttgagcactcaggaaaggagtaaaaaagagctcgtaagccaattcaattagacatgaagatgggggaagctaaggccattatgatctagccttagttctgtaatcactaagaaccacatcctaggagctttttagctgaccaactgtgggtgggctatggtggactccaggctggccttgtctaatttagaggcaaagtagcttctatacctctagtttttctcatgcagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgaggtgaggaagctgtaagaaatgtgggatatagccaggtatggtggctcatgcctgtaatcctgacactttgggaggctgaggcaggcagatcactcgagctcaggagttcaagaccagcctgggcaacatggtgaaaccctgtctctacaaaaaatacaaaaattagctgggcatggtggcatgtgcctgtagtcccagctgttcaggaggctgaggcaggaagatcacttgagtctgggagttcgaggctgcagtgagctgtgatcatgccactgtgatagagtgagatagagtgagatagagtgagatcatgccactgtgatagagctgtgatagagtgagaccttggctcaaaaaaaaaaaaggtgggacatggttagtgatcagtttaaagggacagaacatccctacctcaaagcggtctctataaatttcttctggagaccctagccaatgttcttcctctacccatcatttatatctattggacctgaaagggactccaacgagatagtttggggagccccctccattctgcatggagtccattccaaaggggtagagcagggttccagggggtgagggttctaggcaagagtccgtggatgtgaaaagtattaaggctaggggttgtgttagggatgaacaggagatactgcccctttactagagacctcagcctcctctcttccagtaagagtaggttaggaggacagtgactaaaagagcctgacatgtgcagcttacacattttcagcctcttcttcctttctttccctatagcaccttcagttttcagggtctgcgactggacgaagccctccgcctctacctggaagccttccgtttgcctggggaagcaccagtcatccagaggttgctggaggcattcacagagcgttggatggtgagtttgagtgtcaggggctgagcccaggatccaaggtcagtttgactgagggctgaagaatccagctgctgtctcttttttttttttttttttttgagacagagtctcgctctgtcacccaggctggagtgcagtagcgcagtctcagcacactgcaacctccaccccccgggttcaagcaattctcctgccttagcctcctgagtagctgggatttcaggcacctgccaccaagcctggctaatttttgtatttttagtagagatgggttttgccatgttggtcaggctggtctcgaactcctgatctcgggtgatccgcccacctcggcctccctgagtgctgggattacaagcgtgaaccaccgcacccagcctgctgtctcttaaaaagtcagagagcaaaattagtgacctttccacaaagagatcagcttctgttaaggagttggcaagagactggccactttctggatggtacctctcctctgtactagcactgaccagtgggttggtagtgagggtttaattggccagagaagggcattgacacaggcgggatctttgctttttcagaattgtaatggctccccatttgccaatagcgatgcctgcttttccctggcctatgctgtcatcatgcttaatactgaccagcacaaccacaatgttcgtaaacagaatgcacccatgaccctggaggtaagcttgggtcccagtcaaggcaaagaagacccagcacagcttgggaggtagcaggaaggacataggatttccagtgggcatgatggatggggttctgtccaagggaatcaggaagggctggccaacctagaaaagggactggggtggggaagtgggttttttcgcttaccttttcctaagtcctatttactgaaaacccaagagttccttaggtggggcttcagtgttgacacaaggggaaaaaacttactggcctgtctctaggagtttcgcaaaaatctgaaaggtgtgaatggaggcaaggactttgagcaagacatcctggaggacatgtaccatgccatcaagtgagtatacatagagaatagtgcagtatctctgttaagaagaagcacattgcttcctttcccagtttttagagtcatgtcagactgcagtgactcacatgccctggatttagcctcaggacttagttgggcagccccctctctgccaactgtttcttccttaaagaagcccaaatgatattgggactctagtactctaagccagggtccaaagtgctgctcttaagtaggatatcatggccccattttctgaacttaaaacaggtacattttcctgtatagattacaagatgctggctggtagagaacccaagatgggcactggagtgtgaggcccaggttacaggtcagaaatgggccacttagttttttactgtaaatcagaaaaggtagaattgttcattttatcacacctagtaagaatgtgtgatcttactatagaactaaaggcctcacttacagatagggctttgagattatgggacacttcctttctttctgtctgctcccactggtgggtggaaagcagaccactgagctgcagttctgatgacctctcatcagtggagagtgctagtatggatgaactcctagtcttggtttggaactagtcaggttcaaagcagtgcaactgctccttcccttacctcctgacaggaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggtagcccagctttggccttggtcttcacctcccactagctctgtgagctaacatggttttctccatgcctctctgactcctactgttacttcattagaatggggttccccctgagtttttggagggaggctgaagcttgggtaggctcagtcttaaacagaaacaaaattaaaaggtttcttcctgggactgactggggaagagccccatgcaagctcagggacttggaagggctgcttggccttccagtgactctgtttctgggatggggggtaacattacaggaagtgcgccatgatctccgcccactatggcctcagcgatgtgtttgacaatctcatcatctctctatgcaaattcacagctctcagcagtgaggtgagcaggtgcaggaactgtgtacttggagctccaaaggaggacctctcttttagccatggatctacccttatcaacagacctggttgccctcagcgtcttccctcactgcccccacttgaatataccagagcttaggccatttctgtcttgcacactctgggataaaactagtgttacttcatgtaatggggatgggaaaggagatacaggagtggggaaggccttaactaggttaacccactcccaccagtattatgggggattgaagcagagccaacaaaaggacctgagggaaccatcataggcagagacctaagagattttcctttccagacattagctcggccttaagtctgttctcatcctcttttccagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtaattcttagtaggagactagtgagcgataacaaggcaagagctgcaacattgtatgctacctgtacatagaagtaagtggttgagagtaatgttgggcctgatgcctgccacagctcaccaggaatgcctcaaatgtaagaccacagatcttgggggatagctgtaaaagaaggctggtagatgccattgccagtcaccaattggcacaatagcataggggcagaagactagaggaggaaatccagagaactttggtgggtggaggcgggcacaaatgcaaaggacacatggaaagaaattattttgacttacttttccaggtagaagatttcgtggatcccaatggcaagatctctctacagcgggaagagacaccatcaaaccggtaagagcagaccagaggctcaggggcttggggagggagagtcagaactttggggctcaccaggccatgtgccctttttctacagaggagagtcaacagtgctgagctttgtgagctggctaacactgagtggtcctgagcagtctagtgttcggggcccatccactgaaaaccaagaggccaagagagtggccttagagtgtataaaggtaactgcccatccacccctggtgagaaagcctaaacaccttcctattagatgctacttggtgaactgaagaataaatcatccaggatttgtaaccagggctgactctgccctctccccctggctcttggggacattctgttctcttcagcctttgtcaaagaccccctctctcttttgccctctctagcaatgtgacccagaaaaaatgatcacagaaagcaagttcctccagctggagtcactacaggagctcatgaaggtaaaggatgaagaaaggaaacatggaacaactggctgaatctgggaggggtgacagggacagtattatttctgtcagggcagggccagtggttggcttcttttccatgcctactttcctgctgctgttccccttcaggctctggtctcagtgacaccagatgaagagacatatgatgaggaagatgctgctttctgcctagagatgctgctaaggattgtgttggagaacaggtaagatgagcgtagtctttaggcagaccccatgctgggcttgtgccaaagggatggaagccatcttgctgagtgggctctggggaactgtaggcagcaggggagaagcttactcatcatacctgtctacttagggtataataccaatgagtcctgaaaggcctaggggacctgttgcccagtggcccctctggctgagactatcttcattcctttatgtctacacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtaagcagaatgcatcttggagagtgggcaggtatgcaagggattaaggccacagttgtcaattatgaatatggcctgagacagagagtacatttagtgccccatagcatgagtccagtgaccaaccacagggctggtgcagtctagcgggtggtactgggagtgagcctggaatggcctcaggcatggagcttgtgtttggcacctcagcctcctatgaatctgctttgtaggactggcctgctactgccttataatagtctcagccctatacctggtttcctgtcatgcttatgaccctcttgagatctctttgcttaactacaaaaaacaacaagcatagaactaataagtggattcaacaaggtcacaggatgtgagatcaatacacaaaaagtaattatatctctacatgctaacaatgaacaatatggaaactgaaatttaaaatacaataccatttacaagggttccaaataaagtgaaatacttaatatatagctgacaaaacatgtataagatttgtatgatgaaaactacaaaactacaaaataaattgaagaagatgtaaataaatgaagaggcatactatgttcatggattggaaggctcaacatagtaactttgtcacttctccccaaattgatctgtaaattcaacataactcctataaaaatcccagaaaggttcttgtagacataggtaagcttattctaaaatttagatggaaaggcacaagctctagaatagctagaaagaataaagtggaaagaatcactctctctgggccggttgctgtggttcatgcctgtaatctcagcactgcgggaggccacagcgggcagatcacttgaggtcaggagttcgaggccagcctggccaacatggtgaaaccccatctctactaaaaacacaaaaattagcagggtgtggtggcacacacctgtaatcctagctacttgggaggctgaggcaggagaatcgcttgaactcaaggcggaggttgcagtgagctgagatcgcgccactgcactccagctgggtgacagagtgagattctgtctcaaaaaaaaaaaaaaagaatcactctggtattaagacttactgtccactttggggggctgaggcgggtggatcacgaggtcaggagatcaagaccagcctgactaacgtggtgaaaccccgtctctactaaaaatagaaaaattagctgggcgtgatggtgagcgcctgattgctactcgggaggctgaggcaggagaatcgcttgaacctgggaggcggaggttgcagtgagccaagattgcgccactgcactccagcctgggcaacacagcgagactccatctcaaaaaaaaaaaaagacttactctcggctggacacagtggctcacgtctgtaatcccaacactttgtgaggccaaggcaggcaatcacctgaggttgggagttcgagaccagcctgaccaacatggagaaacctcgtctctactaaaaatacagaattagccaggcatggtggggcatgcctgtaatcccagctactcaggaggctgaggcaggagaatcacttgaacctgggaggcagaggttgtagtaagccaagatcacaccattgcactccagcctggacagcgaaactctgtctcaaaaaaaagacttactgtatagctatagtagtcaagattatgtggtgtcgatggagggacagacacgtagatcaatggaaaagaatagagagaccagaaataagctcaacacaaatatgttcagtggattttttgaccaagatgtaagaacaattcagtggaggaggaatagccttttcaataagtggtggagtgattaaaatccataggaggaaaaaccaaatgaaccttgacctaaacctcataccttacaggaaaattaactccaatggatcatagatttaaatgtaaagctataaaaactttagaaacaggagaaaatcttcaggatctagagctaagcaaagaatttttagcatgtttggcagtcctgtggatctgtctcttgcctcaacactgtctggatggaacagatccgggggagactctctttcaaaaaaagtaataatttttagacttgacattaaaagcacaatctagaaaaggaaaaattgataagttgggctacattaatatttttaaaagttttgttctatgagagcctatgtgaagaggatgaaaagacaagctgtagacgaggaggaaatatttgcaaatcacatatttgaagaaaggtatctgtaatataaaaactctcaaaacacaacagtgataaaacaatccaattattaatagaaaatggacaaaacataggaacagatgtttcaccaaagaacacatacagatggcagataggcacatgaaatgaagatagcatcattaaccatcagagtactgcaaactaaaaccacaatgaggctcacacctgtaagcccagcactttgggaggctgaggtgggtggatcacctgaggtcaggagtttgagcccagcctggccaacatggtgaaaccatgtctctaccaataaatacaaaaattagctgggcgtggtcacacacacctgtagtctcacctactgaggagattgaggtgggaggatcgcttgaacgcaggaggttgcagtgagctgagatcgtgccactgcactcctgcctgggtgacagagcaagactccaaaaaataaaaacacaatgagacatcactacccacttttcagaatggctgaaataaaaagtagtgacaataccaaatgctgaaaggacgtggagaaactgggtcattcatatattgctgggtgggaatgtaaaatggtacagctactctgctggcagtttcttataaaatgaaacatataattaccatacaacccagcaattgcacccttggacatttatcccagaaaagtgaaagcttactttctcataaaaacctgtacatgaatgtttatagaagccttagttgtaatagccaaaaactggaatcggcccagatgactttcaataggtgaataaactgtggtacatacacaccatggaatactattcagcaatttaaagcaacagacatctccagggaactatgctgagtgaaagaaaagccaatctaaaaaggttatgtaatatataattccacttatataacatttttgaaatgacagaactttagaatttgaagacaggctgggcgcagtggctcacacctgtaatcccagcactttgggaaactgaggctggtgaatcacttgaggtcaggagttcgagaccagcctggccaacatggtgaaaccccatctctactaaaaatacaaaaattagccaggcgtggtggctcgcacctgtaatcccatctacttgggaggctgaggcaggagaatcacttgaacatgggaagcagaggttgcagtgagctgagatcctgcctgcactctagcctgggcaacagagtaagactccatctcaaaaaaaaaaagaatttgaagacagattgctaaggattagggatgggggcaggaaggaggaggtgggtgtggttataaaagggcaacatgagctgggcatggtggtgcatgcctgtagttccagctactctggaggctgagacaggaggatcacttgcgcccaggagtttgaggctgctgtgagctatgatcataccactgcactccagcctgggtgacagagcaaaacctgtctctaaaaaaagaaaaaggcaacatgagggatactgttgtggtggaactgttcagtatgttgttttgtggtggatacccaaacctacacaggtaataaaattgtatagaaattaatacacacaaaaatgcaagtaaaacaggaaatctgaataagatcagatagtatcttgattatgatattatactatagttttgcataatgttaccattgggataaactgggcaaagtgtataagggacctttttgtattatttctttacaactgcatatgagcctataattttctcaataaaaatttgtatttgaggctgggtgcagtggctcatgcctataatcccagcacttcaggaggctgagacgggaagatcgcttgagcctgggagttcaagaccagcctgggcaacatagcgagaccccatctttccaaaaaagaaaaaaaaaattagccaggtgtggtcacatgcacctgtagtcccagctactccagagactgaggcaggaggatcacttgagcccaggagtttcaggttgcagtgagctgtgattgtgctactgtgctccagcctgggagacagaccaagaccctgtctcaaataatataattaatatatttctatttgaaaaaaaaaaaaaagaccagagcagtatcctaaattgggtcctagccaaactgtcttcactggcctaaggagactggtgggaaagaaaactagacaggaagctgtgtgcccacacagctccccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggtaagccctttcccagggagactcaggctggcagataaacagttacaccccaggagttgggacaggaaaacaaaacacaggttactgtgttcagcagattaaacagccctggctcctgccatcacttccagagcttccagtgcccgctggctagtacccataagttaaatagcatgagggcaaataagcaatgcagacggctgtgaagccaggcttcctactgtcctgaggactgatttgtcctgaggactgtttcccagtttctgtttctgagctgtcccgaggactgttttcccagaattctgggaaaatagaattctgtgagcagactttatatcactaaatcgatacatcactaaatcccagaaactgggaaaacagtcctcaggacagtggaaagcctggcttcatagccttctgcattgcttatttgtccttgccaccactccctagagtggtgctacagctgccactagatgccatcaggaacccagattagcctgccaccttatttggtcaacagagaaactgttccggccatcctttggccctctggtgacagaaattaaactatgccagagagaggggaggccaggcctcagcatcttttttctgagagcctgatttatccctcatcccagtgccccatccccaccctgactctgcccttctccctgcctaccataggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggtgggtcagctgatgagggggcagctggggagtagccatgcaattatgcaggggagaggctgagaggggagaaaaggcagggtatctatgcctatatagacacagaaatgtgacctgagtctggctctgctcaggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacgtaagtatggcaccctttacttcctctcctcccctgcacctgatactgggagcctggggcggccagggaaagccagggctgaggggaagggcccatgtgtgccagcccaggccctggaccaccatcttcacaatattcccttacccaaaaccttacctgtaagtctttatttgcttaaatttatttatttatttatttttatttttatttatttatttatttatttattttttgagatgtagtctctctgtcacccaggctggagtgcagtggcgtgatctcggctcactgcaacctccacctcccgggttcaagcgattctcctgcctcagccttccaagtagctaggactacaggcgcgtgccaccatgcctggctaattttttgtatttttagtagaaacggggtttcaccatgttggccaggatggccttgatctcctgacctcgtgatccgcctgcctcggcctctcaaagtgctaggattacaggcatgagccaccacacctggcctttaaatttatttttaaactaagatttacttattttttgagtaggttcaaaatatacaaaagggtaaactgataaaactaagtttccaatccattcctgtccccagcttctgagttcccctcactagaggcagccactgtcaccagtttcttgtctatccttccagagttaccctgtgtctattcaaaggcatataaaattaattatgtgagcagagtttatatcactaaattgatggagaaccaattgccttaaatagaataaccatacaaaaatgacaaaagtggctgggcttggtggctcctgcctgtaatcccagcactttgggaggccgaggcgggtggatcatgaggtcaggagatggagaccaccctggctaacacggtgaaaccccgtctctactaaaaatagaaaaaatagctgtgcatggtggcaggcgcctgtagtcccagctactcgggaggctgagacaggagaatggcgtgaacccgggaggcagagcttgcagtgagccgagattatgccactgcactccagcctgggcgacagagcaagactccatctcaaaaaaaaaaaaaagaaagaaaagaaaaataacgaaagtaaaaatgtattaaatctggccagacactattgcccaatcaaagcctctgagcctgaggttttctgttttaaaaatgagattaacagccaggtacagtggctcacacctgtaattccagcactttgggaggctgaggcgggaggatcacttgaggccaggagttcgagaccagcctgggaaaaatagcgagaccctgcctctacaaaaataaaaatgcaaaaattatctgggcatggtggcacacattgtagtcccagctactggggaggctgagtagctgagtaggtgggaggatttcttgagcctaggagatccaggaggcagtgagccatgatggtgccatgcactccagttttgcacagagcaagaccctgtctcaaaaaataaaataagaaataaaattaggccgggcatggtataatcacacctgtaatcctaaaactttgggaggactattgcttgggcccaggagctcaagatcagcctgggcaacatggcaaaaccccatctctacaaaaatacaaaaaattagctggctgtggcagcgcacagctgtagttccatctactcataaggctgaggtgggaggatcacctgagcccaggagttcgaggctgcagcgagccgtgattgtgccactgcactccagcctgggtgacagagtgagaccctgcctcaaaaaataaaattaaattaacaacatgaggctttctctgtcatcagcaggtgtgaaatagaattgaaaagaaagtatctttctcactgtgagtaaggattgtgaaatactcagtccacacacctcctaaggctctctctctcatgagtaatctctgacttggagagtcctttacaaggactggaacaaccaggaagtcaagtcaagggaaagagtagcgagggggtgaggtatggcatgattggtgctagggacaccttgaggacttagttagggacagtgagtggggagggggaaagggatccacgagacctaaccccactcacatcctgccccctcctgtgatcctagttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtaaaccaggaggggcagaggtagggagtttggggagcatcaggatcaagatgcctgaaggatcctgaccctgctcttgctctcaggtattgcctgcctgtgctgcgatgcccggcgccaggtacggatgcaggcactgacctatctgcagcgagcactacttgtacatgatctgcaaaagctagatgccctggaatgggagtcctgttttaacaaggtgggacttcctactggtcttaagataaagttcaaatcctaagaaaaggaaagccaggcagcctgaagagcccctaatgtgagtcttcagcctgcatcataccttcccttcagctctatgcccatccagttcctggcttccttggggcaaggctgcctagctgaacctcatagggagacattgcacatttacccccaccaggtgctgtttcctctacttaccaagctcttggagaacatcagccctgcagatgtgggtgggatggaggagacccggatgagggcttccacattgctctctaaggtactgctcaccaccctatacccaccctctctcccatacctgccttttcccgaggagggaagccagggcttctggcaggacctagagatgcactgtaggtgctcacaaccccccagctatggacactaagcaggacctagggacctgagaggattctgaatcttaaatcagagattcctccatctctgatctaagattctcatgcaagataggacaggcttagctacccagcctcagagaggggtccagaggctcctacagtcccctcagctgaagggggctggtgggccataggtcttcctgcagcacctgtctccactgctgtcactctctacctttgcggccctctggctcaccatcttggacttcatggacaagtacatgcacgcaggctccagcgacttactggtatgttctacctcagctctgctgcctgcctcctgtcccacctgttggaaggacttgccctttcccccttggtagctacctccctttaccatactccccccatgccctctttcctattctcatggtcccactgccacctgcagtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccagggtagggggctcagcccagctttatcaaaaagagtctcctgcctgggcacaatggctcacacctctaatcccagcactttgagaggccgaggtgggtggatcacccgagggcaggaatttgagaccagcctgaccaacatagtgaaaccccatgtctacgaaaaatacaaaaattagccaggtgtggcggtgggtgcctgtagtcccagctactcaggaggctgaaacaggagaatcacttgaacccgggaagtggaggttgcagtgagccgagatcacagcctgagtgacagaacgagattccatctcaaaaaaaaaaagtccccaaagctgaatttattgtctgtgccctgggtgggtagaaaggctgttgggtagctagggctctgctggagagagaaagcactaagaggtgccatctcaattctctaccgtctccagaccccatgcccatggagcctcaaggccaaaagcctctcgcctcagcccacctgacttccgctgctggcgacactaggacacctggccatccaccgcccccagagattccatctgagctgggggcctgtggtgagtctctctagcctagcctgataggcactgagtagcaagcagggggcctaagaggaggcccaagggggcgtgggaatgctgctgagcagggtctgtgagccgagggaagaaggccactagagagaactgttgccgctcttcccatgggaaatgacaggaccataagctatgaggaactagctgcttgcagtcttcaggcttgggaagagaaggctgggtcagggacttggaatgaatttgcagaggtttcctttcagggattctagtagagagtaacctggcggccaggcgcagtggctcatacctgtaatcccagcactttgggaggctgaggcaggtagatcacctgaggtcaggagtttgaaaccagcctggccaacatggtgaaaccccgcctgtaccaaaaaaatataaaaattagctgggcgtggtagtgcacacctataatcccagctactggggaggctgaggtggaaggatcgcttgaacccgggaggcagaggttgcagtgagctgagatcatgccactgcactccaacctgggtgatagtgagaccctgtcgcgaaaaaaaaaaaaaaaaaaaaaaaaaagagtagcctggcaaaggagatagaaggtagctgaacattgaaatgagttttgaggggagactcccaactttttaggctggtggggggccgtgttgcttactggaacaaggaggaacagagactctataagcagccagctgggcaatgtgagagttgtcttgtaccaacaagggaatctgactgtaaccaccttgctttccctacagactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagcatcattgtctctccctccggtttccttcttgagcttgtgggtcagggcaccatgttatcgggtgcgcagggcttggacttggtgtgagcagaggctgagcctacctaacaccaccacccccctcccccaccccgccagatgctaggccgggggtcaggattccttcactgctgctgacccctgccctgccacagggtgtacccttgtcatcacaggtgtgcccaggggcttgggcagtggctcgggcagttgtcgtaatcttccctaacaactgtaacaagggagacacgtgagacaacctggcctaggtgagagggaagaggagtgagggctgagttgtagttattcagaagtcttctctcagatgtgtctcaccatccaagagaccaaaacagctgttggggtttcagaggagcccaagagttcgaggctgcagtgagctatgattgtgccactgcactggagcccccctctgtcacccagcctggagtgcagtggcacaatcatagctcactgcagcctcaaactcttgggttcaagcagtcctctcacatcagcctcccaagtatctgagactaaggtgtgcaccaccacacttggctaattttttgtgtaatttttataaagacagggtctcactatgttgcccagactggtctggaactcctgggctaaaatgatcttcctgcctaggcctcccaaagtgctgagattacaggcatgagccactgcacccagccctgggaagggtatcttgcccacagctgcagtcatgggtttggagcccagggcattcattttgaccccaaactgaaaaggggtaacttttcccagccccacaaacctcaaacctcactcactgcagcatgattagaggacccctcttctcctttcccttggcatcagggtaagacaggtgggaagtgtgtatggggcaggctgtgtggcccctgcagggtggaggtgctatgggtgtgtgatactgtgaaatagatatttggtcttcaccccgtttcctggcataactcttaaaatccttagaatctccaaagtgatgtcctttaatatatgattgactgatagctggcagcccctatgtagctgctggatgggggctggtcaccaaagcagaattaaagggttgggactttcaggctcagcccccaacctccagggagggaagagggactgaaggttaagttgatcaccactgtccaatggtttaatcaaccgtgcctatgtaaggaagcttctctaagaacccaaaagggcagggtttggtgagcttccagagagctgaacatgtaggcttacaggaagccaaacgagtgcatccttgtgcccagagggtggcgcaccacaactccacggggacatcactcccgggctctggaccctttcagacctcaccctatgtatgtcttcatggctggttatttgtatcctttataatattccctgtagtaaactggtaagtgtgtttccttgagttctgtgagctactctagcaaactagttgaacccaaacccaagaagggggtcatgcgaagcccaatttatagctggtcagtaagaaatacaggaaaaaccacctgaaacttaacaattggcatcagaagtggaggcaatgaccgggcaccatggcacacacctgtaatcccagcactttcagaggcgaggcagaaggatcccttgaggccaagagttcaagaccaacctgggcaacatagcgagaccctgtctctatttaaaaaaaaaaaaaaagcatttttgtaaagaagtagagtacagtcctggggaatgagccctcaacctatgggacctggcactatttccaattagatagtgtcagaattgaattggaggccacccagctggtgtctactatagagctgattgcttgcctggtgtgtgggggttttcccacacacacacatttggtcacagaagtcttctgtgttgattgtttttgagtgagaaaatagaaacactttgaaggtgttttcccctctcatggtgggatacaaaatgctgggtattaagctttcccaagtgaagcatccacatcatcttggtttccacctccgcaatggtgccttcccttccctggggcacagagaacagtgtggccctgttgtacttccagctggcctccatcacagagagttaggggcactcaccccctgcactggggcccagctggcagtatgattctccagcaccaggcttccctttgctcagcacatgcacatggctgggcatttggacctctgcaacgcctccctcagtgtagaaaaaggcacctcagagtgggaacaacctgaagtggaaaaatactgatatgaaaccggaagctcttaggctaatttctccctcttcccttccttcttcctgaagtccaggccatgcctggtttgcatactaaccagaagtcttgcccaaccctgcccctgggaaaattaggaggggcagaaagctctatgtgtgtgcagaaaagcctggatctacagccagctagatactggggcatttggcttcaactgtggtgtctctgttctcccatctgagccccacaagctctgcctttagaagcttccatgtgtttccctatgggagaaatagtgttaactgctgcaaataagtctgaaggccatcctatgaacaaagaaataggacagctctaatgttccttataaaaccaatctcaaaaattaggaaagaagtgggaacaggagtggggtggggtgcggtggctcacgcctgtaatcccagcactttgggagactgaggcaggaggatcgcttgcccaggagttcaagaccatgtatctgtggcctagctacttgggaagctgaggcaggaggagtgcttgagcctgggaggttgaggctgcagtgagctatgatggtgccgctgtactccagcctggcaacagagcaagactctgtctcaaaaaaaaaaaaaaaaagctggagcaattgcaaactggccgtctccctgctgggaagcaaagaaaaacatttgctggaagttgcattctgttattaaaaagtagctgaggcccggtgctgtggctcacatctgtaatcccagtactttgggaggctgaggtgggaggatcacttgaggccaggagtttgagatcagcctgggcaacatagtgagacccccatctctatttttaaaaatatttcaaaaatatatttaaaaaacaaaagaccagctgatatgcgtgatttgtattatggacaatcttgtctcagaaagcaaaggaagctgcaagaggaactaataagtaagccttaatcctgaccaacaaagaagaatggcttggtgatgtggaagtaaccaaaccttggggaaaagtaataacatagtctggagggaaatgctggtcttaatgacatctcccaccagaaatccaggatagcagataaagtcaggaggaaaggtagagatggttccatgacctaagaccctaacatagagcactggcatcgctagagcgcctatatgtgtcagtactgagtgccttgctcaaacattttatttttatttaatgtggggagggggattttttgttttttgttttttgtttttttctgagacagagtctcactgtgtcactcaggctagagtgcagtggtgcaatcttggctcactgcaacctccgcctcctgggttcaagcaattcttgtgcttcagcctcccaagaagctgggattacaggtgtgcaccaccacaactgactaatgtttttgtttatttgtttgtttgtttttagacagagtcttgctctgtcacccaggctggagtgcagtggcgcgatatcggctcactgcaacctccaccacccgggttcaagcaattctcctgcctcagtctcctgagtagctgggattacaggtgcgtgctaccacgtccaagtaatttttgtatttttagtaaagatagggtttcaccatgttggtcaggctggtctcgaactcctgacctcatgatctgcccgcctcggcctcccaaagtgctaggattacaggcctgagccaccgcaactggcactggctaatgttttgtacttttagtagaaatggggtgtcaccatgttggccaggctggtctgaaactcctggcctcaggtaacccacccaccttggcctcccgaagtgctgggattacaggtgtgagccactgcacccggctgtttttgttttgttttttgagatagggtctccccctgttgcccaggctggagtgtagtggcacaatcacagctcactgcagccttgacccccaggctcaagtgatcctcccacctcaaccttcaaacaacattttagaggcattttctcctcttacagatgaggctataggttcagaggccaagtcatggaatttagggagctgggaatcaaacccaagtcagtgtcactctaaaccttgtgttctttggtatgacactttttccattcagaagtagtgatggtgaggccaggtgcagtggctcacacacgtaatcccaacactttgggaggctgaggtgggcggatcacctgaggtcaggagtttgacaccagcctggctaatatggcaaaaccctatctccactaataatacaaaaataagccgggtgtggtggctcacacctgtgatcccaacactttgggaggccgaggcagggggatcacgaggtcaggagatcgagaccatccgggctaacatggtgaaacctatctctactaaaaatacaaaaaaaaaaaaaattagccgggcacggtggcacacgcctgtagtcccagctactcaggaggctgaggcaggagaatcgcttgaacccaggaggtggaggttgcagtgagctgagattgtgccactgcactctagcctggacaacagagcgagactccctctcaaaaaaaaaaaaaatttagccaggagtggtggtgggcacctgtaatctcagctactcgggaggctgaggcaggagaatcgcttaaacctgggaggcacaggttgcagtaagccgagatggcaccaccgcactccagtctgagcaagagcgcgagactctgtctcagacaaataaataaataaataaataaataaataaataaataaataaataaaagtagtggtggtggtggtatagaaaccctccaaagctaaacacattttctgtagcttctcatgtgaaataaaaggctaagtacctgaggaaacaggttattacctagtgagctcagagtttagtaggagtttataaaaactggaaacagatgcccacaaccaagaaaaatatgtgaattttctacacacataatgatatgagaaagaacaaaatatagaatgagctacaatgggcattcctccctgccccgccaccaaatagaaaaaaatactaggaacaacaaaagctgtggttattggagccatgggtatttacctttgttgagggctcactggttggaagacaagtggctgtgaatgagcagagtcactcagccccagggctcccattgagaggggcctgtaatcccagctactcaggagggtgaggcaggagaatcgcttgaacccgggaggcagaggttgctgtgagctaagattgtgccactgcactccagcctgggcaacagagtgagactgtctcaaaaaaaaaaaaaaaaaaaggctgggcacggcggctcacgcctgtaatcccagcactgtgggaggccaaggcgggcagatcacgaggtcaggagttcaagaccagcctgaccaacatggtgaaaccctgtctctactaaaaatacaaaaattagccgggcgtggtggcgggtgcctgtaatcccagctactcgggaggctgaggcaggagaatcacttgaaaccggaaagcggagattgcagtgagccgagatggcgccgccgcactccagcctgggcaacacagtgagactctgtctcaaaaaaaaataataataataattaaagagaaataaaaataagtaaaaggaaaaattcttgataccccctacaaatctgctcctctctcagtgtgccccacatcactaaaggacaattccattctttttatgccaaaaccccctcttttctcacatcctgcatctaatcttcagcaagtcttgttacttctatctttaaatctatctagaattgcgattacttcccaccaccttcatcatccactagcacccaagcctcagccgctgtctgttggactcctggtctccctccttcctcctaggtccttgcattcgatagtctttacacagcagccaaacggatccttttctgtttgtttgagacggtctcgctctgttgcccaggccggagtacagtggcacaatctaggctcactgcaatcttcacctcctgggctcatgcagttctctgacctcagactcctgagtagctgggaatataggtgcatgccaccacacccagctaatctttgcatcttttgtagagaaggggtttaaccatgttacccaggctggtctcgaactcatgggctcaagcaatcctcctgcctcggcctttcaaagtgctgggattacaggcatgcagcccaaatggatccttttaagacacattataccccagcctggacaacacagcaagaccttgtctctaaaaaaaaaaaaaaaaactaaaaaataaaaatttaggctgggcatggtggctcacacccataatcccaacaccttgagaggtcaatgtgggcaggtcacttgagcgcaggagttggataccagcctgagcaacatggtgaaacccatctctacaaaaaaatgcaaaaattagctgcacatggtggcatgtgcctgtagtcctagctactcaggaggctaaggtgggaggatcgcttgagcccaagagtttgaggccgcagtgagctatgatcacgccactgcacaccaccctgagtaacagaatgagagcctctctcaaaaaaaaaaaaaaaaaaaaaaggatacattatacaattttcactccactgctcagaactctctaacggctttccatcttgatcagaacaaaacccaaagttattactttattccacctactaactttcttgctgttcctcaaatatgccaaacacttgtatcagagcttggccctactgttccctccacctggaacactcttcctccagatattccccatgactcactccctcactttttcaagtcactgtttaattgttaccttatcagagagtcctgctttgactgatacctagaaaatccttgtcactctcaatcctttacctacttaatttttctttgtagcacttattaccaactgatatatatctgtttgagttttgcctgcaagcagcggtgttgtttaatggagtgggctctcactatttatcggtaaatgaatggaataaattagtggtgcatctgctctgggctaggcattgtgctagagctgggtgcggaaacagatgacgattaggatgaaaattagtgtaacatgcaatgaagaactttctttctttctttctttcttctttgttttgagatggagtctcactttgttttccaggctgaagtgcagtggcatgatctcggctcactgcaacctccacctcccagattcaaacgattctcctgcctcagcctccctagtagctgggactacaggcgcccaccaccacaccctgctaatttttgtacttttagtagggacagggtttcaccatgttggccaggctggtctcgaactcctgacctcaagtgatccacccgccttagcctcccaaagtgctgggattacaggtatgagtcactgtgcccagcctaacaaagaggtttcttaagcccagatagatgaggctctagcaagtgacaagctattttgagttagtttaaatctccaggctaacatgcattaggaattgttgaatctgacagaggggcacacgagggctcattatactattctctccactcttctttttttgagacagcgtctgtctgtcacctaggctggatggaatgcagtggcacgaacatggctcacagcagcctcaacttcctgggctcaagcaatcctcccaccttagccttccgagtagctgggactacaggcactcaccatcacatgtggctaacttaagtagacatgaggtctccctatgttgcccaggctgttctcaaactcctgaggtcaagtgatctgcctgcctcagcctcccaaagtgaaaatctttgtatgtttgaaatgttctctaataaaggtcttgttttgttcatctttagataaattacgccttagactgttgtaactaaaatagctcaacccttaggggtgcttttagagatgttgtggagactcaaagaatccgtgctgattttggtggcaatttatgagcactttgaaaggatagatgtgatcagtggtaaccagcacgggtttactaagctagagtataccaagatgaatttactccattatacatttaatttttaatttttaatttatttatttagagacctagttatgagacaggctaatttttgtatttttgtggggaaaagcaagagagatcagattgttactgtgtctgtatagaaagaagtagacataggagactccattttgttctgtactaagaaaaattcttctgccttgagattctgttaatctatgaccttacccccaaccccgtgctctctgaaacatgtgctgtgtcaaactcagggttaaatggattaagggttgtgcaagatgtgctttgttaaacagatgcttgaaggcagcatgctcgttaagagtcatcaccactccctaatctcaagtacccagggacacaaacactgcggaaggccgcagggacctctgtctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcccgtccctgggcaatggaatgtctcggtataaaacccgattgtacgttccatctactgagatagggaaaaaccgccttagggctggaggtgggacatgcaggcagcaatactgctttgtaaagcattgagatgtttatgtgtatgcatatctaaaagcacagcacttaatcctttaccttgtctatgatgcaaagacctttgtttgtctgctgaccctctccccactattgtcttgtgaccatgacacatccccctctcagagaaacacccatgaatgatcaataaatactaagggaactcagaggctggcgggatcctccatatgctgaatgctggttcctcgagtcctttctctatactttgtctctgtgtctttttcttttccaagtctctcattccacctcacgagaaacacccacaggtgtggaggggcaacccaccccttcaattttttgagacggggtttcaccatgttgccaaggctggtctcgaactcctgggctcaagtgatccaccagccttggcttcctgaagtgctgaaattacaggtgtgagtcaccatgcccggccttagtccattttaatttaaggttaggaatctgacttaccagagaaacgtagtagacaacatatctggatttcagcaaattgtttggcagaatcttatgatatttgtttgagaggcccacagtaaggtggaaagggctgctttgttttatataaacttaggggagaaagcttcatcctggagtcaacagattgggtttgaatcctggctctgtccctttctagctgtgtgtttggttgttactccacctctctgagccttaatttcttcatcagtaaaagtaatattcacctcctagggttgttgggagggagaataagaacttctaaagtacccgaacctagcaactaggacactatatttgcaggcaagatgaag

SEQ ID NO: 41 - DNA, 5976 bp, Homo sapiens
cagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtacc

SEQ ID NO: 42 - protein, 1805 aa, Homo sapiens
ELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQVSQDLLDLMHTLHTRAASIYSSWAEEQRHLETGGQKIEADSRTLWAHCWCPLLQGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHSADARGGGPSALWEITWERIDCFLPHLRDELFKQTVIQDPMPMEPQGQKPLASAHLTSAAGDTRTPGHPPPPEIPSELGACDFEKPESPRAASSSSPGSPVASSPSRLSPTPDGPPPLAQPPLILQPLASPLQVGVPPMTLPIILNPALIEATSPVPLLATPRPTDPIPTSEVN

SEQ ID NO: 43 - DNA, 24316 bp, Mus musculus
  misc_feature (1)...(24316): n = A,T,C or G
aaaatgtgccaccattcccttccctgagacagggtttcactgtgtagctctggctgtcctggaactcaatatgtagatcaggctggcttcaaactcagagatccactagcctctatttcctgactgctgagattaaaggcatgaagcaccacacacattctctctctctctcctcactccctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatttttgatagctgatgacagtagtcatgtctcctgagtaaatttagtttcttcaagcatccccctattgatagtgtccagggaatttttttttttaagttgggggaggcaacccaacagatgaagtgaagtttttgcttagggaacaatttcaggcatccacggtgcaattctttgtgaaacacagattgagtgttgggcttgctactgggtttaaaaccacctccggggctggagagatggctcagtggttgagagcagtgtgcatttcttttctaggatctaaatttgcttccaggcacacatatcaggctgttcacaattgtctgtgaatccagtttcaggagattctagcacccttgtgctcccaaggagcctgcacatacccacacatcaagaaaacagacacacacacacacacaccaaaaacacacacacacacacacacacacacacacacacacacacacacacaccccaaaaacaggaggtaagggcaggcaggtatctgtgagtttgagtccagcctggtctataaaacaagttccaggacagccagggcaattacacagagagaccctgcttcaaaaaacaaaataagaatgagaataaatgtggtggtggtgccctttaatcccagctcctaggaagcaggggcagatctctttgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttctctgtatagccctggctgtcctggaactcactttgtagaccaggctggtagaatattatttttagtttacattacgagattaacaatactgttgcttaaacacatgtgaatattgaaggttttctggtttgttttgttttgtggagacagggtttctctgtgtagccctgtggctatcctagaactcattatgtagaccaggctatggtcaaactcagagatgggcctgtctctgcctcaccctcacgggtgctgggctcaagacttacaatgcttttttgtttttgtttttgtttttgaagacagggtttctctgtgtagccctggctgtcctggaactcactttgtagaccaggcaggcctcgaactcagaaatccacctgcctctgcctcccgagtgctgggattaaaggcttgcgccaccaagcccggctaatgttgagtttttaaaagggggaattaacacaataaattccctttaggaaaataatctatcatgaaaataatgttctgccaggcagtggtggcacacattttggatctctgcactcaggaggaggtagacagagctgtgttcgaggccaatctggtctacatagtgaactctaggagagtcaggacgacatagagagaccctgtcttgaaaacacaaaagaaaacctatcttcagatttataggtccatttttactgagggttttgcttttcaacgtcttccaatttaaccatgtagacataggtaagcacagtttaaatatttttgttcatatttttaattttgttcatgcttaaatttaaggcttttttatagaacataatctagagcttaagacactgagggaatgattaagagactctgaatctgaggtcagctgcttcctctcacgagcagtgtcctgaaccatttcctgtgtagacattcacattgttcaaaaccctagatacattgaaacactatacatgctttcattcgctttttatttttgtttttgttttttttttttttttgttttcgagacagggtttctctgtgtagccctggctgtcctggaactcactctgtagaccaggctagcctcgaactcagaaatccacctgcctctgcctcccaagtggtgggattaaagacgtgcgccaccaacgcccggctcattagcgtttattaactacacatcttattgcggactttttacataaatttaactctgatcatgttcgcccatatatgtaatttgttaataggaaacatttctggtcagtattgtgttccagaaaacagaactgtggcacatttgagacgctaacttgaatcagcagcatgagttttacagggttcctggctccctctaaaattaaaaaattagtatgcaccactacaggcacataaagttgaatactagagactttctaaatgttgcgtttcatcttgttccattaccaaacattaggtttgatgaagttaggggaaatccttggtgcttggggtgggggtcttaacctagacggcttaaaaatacaaagaaggcatttgttttaagccccaagaactatggaaaccaaagggtttggtaaaagaaggcaaagggagacttaaaaatgcaattttgtaacaaactaaagctgtatggaaaccttcagctgtggaagtctggctttccctagattccagacaaaagaagcgtttgcgaaccgaggggatttgacttcctgcgcatcccgcaccacagcctgtctggttttcacgcttcccctccagggccagcactcggagggggcaaggccagtcggccgccattcttcaggggggctcggtgtcccgggaaggagccaggcccgggcaaagggtcctcaagagagctggcgcagaactccgcccgtccgaaggcgatcgaggccgggacgaggcttctccggtgcagggggccaggagagagggaaacagcgtgcaaacccagtaccgcccatcccttatcagcgtccgaggggaagggcggagagccgaggaaacagcgggccccgcgcccgagctcccgcccgagcgccttttaaactgcgtttctgcacctctcgccctgcgccgcggcggctggaacccgcgcgagccgcccagccaatgggtggcgcgcttcctccgggcgcccgccaatggcggcgcgcgttcttggggcgtgcgcgagccaggctccccccaccccaccccacgcactagcttgtgtatgggctcggctcgctgcgggctccgggttcggctgcacttgctccccagtcgtgcgccaggggctttttgtggcgggggccggacctgggttttgtgtcccgagttctgtgccgtgcccgcggcgccgctccggggcagggatctcccgaggcggcgggcgcagcccccgggaccagcgagcgagcgcgccggcgtgagcagcggcggcggcgactgtgaggggccggggaggagagaaggagggggacgagatgccggagttcctagaggacccttcggtcctgaccaaagacaagttgaagagcgagttggtcgccaacaacgtgacgctcccggccggcgagcagcgcaaggacgtgtacgtgcagctctacctgcagcacctcacggcgcgcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcagagcgctccctggagggcagtttgcgacatagtcatttctggccttttttttttttttttttaaataaaggcattcccgcctttttatgttgttgacttttttttttttttaaacagatggagggctttttgaaccgttttgtttcctcgcgtgtcatattcttccagtcatcaggccccgccttaagtgggtttgctgtactgtaaacgggacgttttaagtacgttgcatttggaaaagtttgttcccgtagacatcctggagaatcccagctagtgagcgttttgttttatcgttgtaagatttttgctggaggaagtaaagatccggaagcaaaaagaaaagtttatgacatactgatgtatcagtatttgaatttgaatgcctcaggccagtgagatgtaagatgcgttcctgccggtgtgtatcattttgccttttttttttttttttttggttgctggctttttgggggtacgttttaaatagtattttgtaggtttatatttagttaacagaattcaagtcattaaaaattagttatgagtgttgatttggagtgttttaaatcttcgagaagcatgtgaatgttttgactggtatcgcggtttgcctctcgttttggtgctgggaattgaactcaaagcctcttttttgtatgtactagccgggaactacacctcaagctgtttgcttcttcgaaagtttagagtgtcttgcgataatttaaaaaaaaaagtgggttgtttcctgactgctcgaacaagagtgaaagttacatcaaacgcatgtgtggatttagttgagaaaacttttacccttaactttcaatgcctaagtgttttaagattgacacaaatctcggggcggtggtggcgcacacctttaatcccaacacttgggaggcagaggcaggcaaatttccgagttcgaggccagcctggtctacagagtgagttccaggacagccagggctacacagaaaaaccctgtctcgaaaaaacaaacgattggcacaaatcagtgtctagtaagcattagccccgtgaattacagcgtcgggcacctgtaatccctgagtccatggccgtcctcggctacttgagctcttgcctaaaaccaagtaaatattgaccagcctactgtctttggtgtctcctatttgtggattctgtgggggcaaacataccatgttattgtttgtgtgtgtgtttgaagattttttgttgtttgttgattggtgtttctcctgcatgtgtctggggggtgccatatcccctggaactggagttgagcgtccatgtgggtgctgggaattgaaccaaggtcctctggaagggcagccagcttaagaacactggggcccccatgttactgtattttcaattctacaaaataatgggtttcctcctaactttttacttacccgtgtgtcaagttcccccgtggctcccaacccctttctcccttcacattagtccccttgcactcccttcaattttacatgtcatgtattttttcctaaatctagacccagcatattagagtgtgtaggtagaatatttatttgtctttggaagggggattgagataggatgtcctgtgaccctgactgtgcttgaatgcactgtagcccaggatgacattgtctctgattcccgggtactgggattgtgggtatgtgccaccatgcctgggtctgtgtggcaaatttcacttaacataatctcctttcatccatttttgtacatggcatgattttattctttatagccaagaaaaacgcctttatgtatatatttacattttcttcagtgattcgtgtagtggcaaagtcccatgctttttgtgggctaaagccattcagggggctagggagatgacctgtcatgaaaacacaaggacctgatctccagcacccacataaaaagctgggcacaccagtggcatgtcttttttaaagatgtggaagacacatacctgtaccagaatgtgaacacacacagacagacacacacacaaccactttaagtaaaatgtagtagctgatagggctggagaatggctcagtggttaagagcactgactgcttttccagaggtcctgtgtccaaatcccagcacccacatggtggctcacaaccatctgatgccctcttcccttgtttctgaagacagctatagtgtactataaataaataaatctttaaaacagcaacaacaaaaaattgcccagcagtggtggctcacttgggaggcagagccaggcagatttctgagttctaggacagccagggctacacacacaaaacaaaacaaaacaaaacaaaacaggagaaaaaaaattgtcatatttcctcttaccagctcaacttacatgaaagatccttccttttttgtgagcacttactatggggctaggccgtacaagagtagaggacagtttcggatgctccagaaggagcattgatgcccagcacttggtggagacacagttcttgctatatcccttggatgctggctccaacccagctctttatggtgggggctctttctctcagtgggtctcatatgataggtgtgtattctccacctgcactatttaaatctttttaaatataaatgtcttgattggactcagtggtatcaactactcgagaaaccaatattggaaacaagtacaagaataaagtgagttctgatttaggaattaaattaccactttaaagtgcagcatagggaaggtatcttgaatttcagaagaaatgtagaacatttttgattgcttgtataaaagttattcccctgtttttttcctgccttggtcgcctgtgagctagatagtaggatgttccaccatgcccagccttcgtgaatatttttaaattaaggataattccataaaaggatatgattgtttcatatgtattaccatcatagaattctaccttgaatgcatatgatgggtcctgtggtatggggggggggagatttaggcgtctagttatctgtcttggtagcagtatttttaggtgttaaaatcacctagatagtacacacaagagcacacatttgtggggttggcaatctgcctttttgttagagcgtgccaagcatgaaagtttcgctgttagggatccagcggagcatagtaacattcctggtgagcctgtcaggggaggaaggaacttcaggcatgcatagttgtctatttgcttacagaaattcttgctgtatcgctcagcctggcattaaacttaggatcctcttcccgggctccgtgtgctgggagctgaggtatgccccactgcctgtgctgatggtctgtgggtgggtgggtgggtgggtgcttcttcttgttttgttttaagacagggcttccttcccacagctctgactggacctgactcctgaatagtgcagaaggatgaaatacagttagatacatgacgtgccccatgccgtattttatagctgggtatgctggcttgcgcttagttctacaacatgggaggtggcagcaggaggactgctgggagttcaacaaggtcaccctggattacatacagtctttaagagctctggctgctcttcagagaacctaggtgtgcttctcagcactgaactgacatggttactcacagtcagaactccttgttccggggatctgataccctcttgtggtctccacaggtactgactgcgtgcacatagttaaagctactttaagggtggtaaattccatacagttactctttggttgaaactgctttgttaacagaatacaccaaactacccactacttgttcttattaaatttagtatttattaggcggtgttactttcctgaaacttttccccctacagattaaataaatattaatatcaaatagcctgttggtggaccccaactttctgggctcactttatgcaagcagattacctgcttcaaaatgtatttcttgttcacttgaagttttttcattatggaaatgtaaattcaagaggcttatgttttgtttttttttttctttcttatttttaagggaagactggaacccagcgcatgctaggcacacactccagtgtggagttatattcacagcccatcgtgtctgataggaagggtttcgttttgctttttaatgacttagatatgggtgttctgcctgcatgtatatgtgccatttgtgtccagtgtcctaggaggccatttattttactttgcttttatttgcttttgtacactagatgccattactgtctcttcagttaggcagttagcaccctatcactaagctgccctcaaccctcaagagcagtgtttttatttttattttctgtacttttttttttttttgcctgaatgcatgtctgtgtgaaggtgtcggatccccagaacatgagttatagacagttgtgagctgccatgtgagtgctgggaattgaacctggatcctctagaagagcagccagtgctcttaactgctgagccatctctccagccccaaattctgggtttcagtttaatcaaattgttggggctaatgtgaaaataagttaccttgttgattgcatagagaatgtcatgtaaatgagttctttcatatagaggagataattgtactttgtttgcagaaagccacaaagaaaactgataagcccaggctagaagataaagatgatctggatgtgacagagctctctaatgaagaacttctggatcagcttgtaagatatggagtgaatcctggtcccattgtgggtaagggttttatttgtttgttttttgttttgttttagatttattatatataagtacactgtagctgtcttcagacaccctagaagagggcatcagatcccattatggatggttgtgagccaccatgtggttgctaggatttgaactcaggacttttagaagagcaatcagtgctcttaaccactgagccatctcttcagccccatttttatacccttattaattgttaggggatcttctgagaccatttgtcactatttaaccattaacattttagtttccttaactctcaataaggagggggagttttagtagattatatgtaagattaccagttgctgatattgtcctatttagggatcgtattgtgctattctgtaagccttgtggatcttatcaggccgcgtcgtctgcattagtgaattagagaataatgagtagagtgcaagtactcaggccctgagtgtcagttccctaattagcactaagggttttgttctaagtctgtctaaagaacaaacaaaacagaaggcgtgcaagaactaaatcctctatctaggtctgtcattgacttttctaggtagcagtgtattgccaggttgatcatgcctttcttacagagtttaggcagtaacctccagactgagaaaaagaaatccacacagaacttcagaacttcagggttctgtgaaaattagaactcagtatggagattggttgggttttgtttcagctatagttggaaacgatgagttggttttgtttgtctgtctgtccagtctggatctcactgtgtagcctgcctagctttgccacccacatgctggaattaaaagttgtacttctcaggctactcacagacaaacttgtagttataattaccaacagacatttgctatcttttgtgaaattctgaaagacagtaaaaaatacatattacataaaaatgtgctaattacatgatatgttacatgttaaaatatcagttgtctgtcataagacctattattcaaaaataaaggaaagatatataactaatataaagtagaaattaaagatattcaagtaagatttatagactttgatacccatagttcagtggctgtttataggcatgttgatctcagtgttgtgacgtataatcattttctgttcaaggtttccctctgtttatataagagttctttggggagctgtagacctagctcagcatttaagagcactggctgctctttccagcacccacgtggccaacaactatctgtaacaggacatacaacactgtcttctggcctacacaggcacatggtgtacagacatacgtgccaacaaaacacccacacacataaacaataaaatcttttaaagaaaaatataatcttgtattaatatcccagagaaacaactattttgtaaaagaatacattatgtattatttttttaatcactttagaaacagaaagcatgttgcttaaaaactggttttctgtaggggctggaaagatgatcccagtttaaagaaattgtactgtttttgctgaggaccagagctttattctgagaactcacattgggtgacacacagaggcctgtaaccagctctgggggatccagggcctctggtctctaggtatctctgcactatacactcaacacacacacacatcatattgtttgttgtttttaatcttttaaaaagataatttcatgccaatataatggaacttctcccttaacccaggaacaaccaggaagctatatgagaagaagctgttgaagctgagggagcagggaactgaatcgagatcctctactcctcttccaacagtctcttcctctgcagaaaacacaaggcagaatggaagtaacgactctgacagatacagcgacaatgatgaaggtaacattttaactgctcttagccatgaggggctttttcctgactaggtgttgagctgagaaaggtatcctttaaagcagcatgggcagacacttgtaatttaactttctgtttaaatagctatttaacttttgcttcaaagtgatgcttttatataaaggcaaaggtttctttttccttctccattatcacatctacagaagaaatcattaatttggtatttagcttactaattcatttttatatttaatgaccagattaggacatgctactttatttttttttaattctatataaatgataggttgggtcttttatgggccatttttgttccatgtaattttttttggtccatattacatgtttatgtgcttattccctataattaatatacagtgttaacaattaaatatagcatttctattaataggtgatttttaaatattttgggactagaataggaagtatatttctctttaaaattagaatagtgcagcctttcttgtaaatcttgtaaatctttagtttggctgtgccttccaaggcactgtatagcagatgagtcgctgagagtgtgaagtatagggcccttttcttcaacaacactattttagcaaggaggcaaataagaccagaccagaccagtcatgcttaaacttcctgcctcttttgcctctacaggaaagaagaaagaacacaagaaagtgaagtccgctagggattgtgttcctttttctgaacttgcatctactccctctggtgcattttttcagggtatttctttccctgaaatctccacccgtcctcctttgggcaggactgaactgcaggcagctaagaaagtacaaaccactaagagagacccacctagggagacttgtactgatacggccttgcccgggaaggggcagacgcacaagttagcccctggacggagtttatttattccttcagagtctagctatgatagatgtgtagagaaaagttcttcaccatcttctcagcgtgaatttgctgccaggttggtctctgctgcagcttctccttcactgataagagaaaccactactacttactctaaggacatagtggaaaatatttgccgtggagggaagagtagagctcagccattgcgtgctgaggagcctggcgtgtcagatcagtcagttttctctagtgaaagagaagtactgcaggagtcggagaggtcgcaggtcatttctccaccacttgctcaggcaattcgagattatgtcaattctctgttagtccagggtggggtcggcagtttgcctgggacttctgattctgtgcccacactggatgtagaaaacatatgtaagagacttagccagtccagctatcaagattctgaatccctgtcccctccccgaaaagtcccaagactcagtgagaagccagcaaggggcggggactcaggctcctgtgtggcatttcagaatacacctggatccgaacataggtcttcttttgccaaaagtgttgtctctcattctctgactactttaggagtagaagtgtctaagccaccaccacagcatgataaaatagaagcctcagagccgtcttttcctctccacgaatctatcctaaaagtggtggaagaggagtggcagcaaattgataggcagctgccctcggtggcgtgcagatatccagtttcctccatcgaggcagcacggatattatcagtaccaaaagtggatgatgaaatcctggggtttatttctgaagccaccccacgagcagctactcaggcgtcctccactgagtcttgtgataaacatttggacttagctctctgtagatcttacgaagctgcagcatcagcattgcagattgcagcccacacggccttcgtagctaagtctctgcaagctgacataagtcaggctgcacagattattaattcagatcctagtgatgcacagcaggcactcaggattctgaacagaacctatgatgcagcttcatatctttgtgatgctgcatttgatgaagtgaggatgtctgcctgtgccatggggtcttctaccatgggtcggcgttatctgtggttgaaggattgtaagattagtccagcttctaagaataaattgactgttgccccctttaaaggtggaacattatttggaggggaagtacacaaagttattaaaaagcgtggaaataagcagtaatgaggttaagaacaaaggcagaaactttgacttagagaatttgtgaacctttctaagactttagtctcctaatagagctaatttcaaggtgttacgctaccactcatccagttacagtataattgcatatgtagaggcctagtacagttgaagctccgtaggtcacatctgtcttacatgatcgtacagcttcctgtttcatttaacattttagatatacaaggaattcagcaactagaatatcagtggaaccctcgcttcctttagtttgccattcgagtacttcctgatgcataggtcggagttaaacattgttagtcacttgaaacactgattttttttttccccccctgctcagaggagtttaactttgagaagtctcgtgtgtagtatgtcgagtctcacagctcctgtgattccagtctgctctgccttctgctgcttgctttcattatataaataatattttgccatgagtccttttgttgtccactcattacattgcaggccatctcacaagtgacctttgtactgcaacaaacctcataataattctagatcagtgtaactcttttaagtgccagtgcacaaacttgctgcttggctcgcagacaagcgtgtgcatgtatagaagggaaagaccctgctgctctgtgtgtgggaggatgcatgcacttggcgtgcacgtgactgagttcagagccacttaagaaagtgtaataagagtttaaatctagagatactttgtaaacaaataagaggtaaattgtatacctgtatgtatgtataaacacaaacacatttatgcacatttttaataatcgaatagacaaggcagtgtacagttttatgtctgatagaggaggtagccaacaaacaattcctagttatacaagtacatggaccacacttgaggaacacagcaagggatggtaagtggagttctggtatacctcatcttcactcaacatggctattttgttagataaacaagacactacaaaggtggggcttttttattttctacatgtatttaaaggtattttatatgtcctacatagatctggatgctaaaaccaacaagatgttttctaaaaaccttaagaatttttactataccctaatgtctgtgtctgtatgaagcaatgtatcaccctgttttcatttgtatggttgtaaggtaaggaatcctagctgtcgagatgctgtggaaaacagtctcaggcacaatcaaatacggtctcggtgtccatgtctaccactaccatgttcttaggctgcacagtccatcgctacagccctgttacttgtctttaaaatgtacatgtatacatgtacctgtgaagtgctgtgtgatttttttttttaaagcaatgtatgcctgtagaatgcttctacaaattcaataaagttgttaaatttgaacagttttgtgtggtctccagaaacatgttttatgtgtgctttattcttggagtttgaacaagctgaatatatgtggatgaacatgcctttgccatttcctcatggaaacatcccagtagtgacagggaatattctacttaccacatgtcctcctcactatttaaggactatgtatttaattgtctgtaaaatctaaatttggacaagaacttaatttgtagccacatagtttgtctaatcaatcagtttctccttgctaataggtatttatttatttactttgctctatgttgtctgaggtttcttagattcttctgagttaagcaagaacaaaagtagcttttataatgcagaggagtataccaaatgcagatgacagtcatagatctggtgacagtgttggggatggagttggttgcttggtcttcattgacctgtttgaactattttagttaaaaatcactatccagagggagggagaatggcaggtatatatgattaactagggttagactggaaggccagcaaagtcacagagttctcttgatcggtttgaagcattgcttcattaagcttgtataaaattaagccttaggaattgactctcttgtttctttgctaagaaagccaatttctagacctgtcttgctatggtaaatgaccacaaaagtagaaaacagttcctgttttgttgagacagtcccactttgtaggatgtgctagccttggactagaggtcctctggtgcctgcagctccaggggctggggttacagatgttcacgctgatgggaagttctactttttttaagagtctgtataggtcttcgaattacgataaggccaaggttaaaagaattagaatactcagcctttttttttttaatttttattttttaatgtttacactattgggttaataactgtaagagactttataatttcatttattattttggtgctagggatggagcctacatatggtctgctactgaactagagcccgtaattaaggagagtcatcattaacattaaagcagtgcggtcacatcattggaagttaccgttaattattaagtggttggtgtcacacaatcttttccacttttaaaattctccctcttgtgatattttaataggtaacctttgtcatacagcagtaatgtattacaaggacagaatggttgtcacttccaagtttgccttggtttttaatgaaaatgcctccccagggtcagccagcttgaaaaccctttaatcccagttaaaatcccagtctaggggtggggagaatggaaaagagtaagtagggagaagtagccagattaaacactggtactggatatttttttaaaaaggggggaggaactaagtttataagagtgtatgttcagcctgttctgttttctatgaaagggtttaagataaatcttactaaacatctttttctctggtgaggtattaaaattaaacagatcgtcacatgtactaatgtgcctacgaccagtactgttagtaaaaacgtgactccagcgttccaatgaataatgatttcctcgatgttatttccagactctaaaatagagctgaagcttgagaagagggagccgctaaagggcagagccaagacgccagtcacactgaagcagagaaggactgagcacaatcaggtatttgtagttttatgatccccgtgtccaggtgtgtcatctgactagtatcatccaccccatgtcttgacctttggtgcacacacgccgtgcagcctgctcaccccactgactggattcatggttgagtggtgtggggcacatactttgtgagatgtgtcatcagcatagcctccgttgtttattggatttaagtagtctagcattagtcatgctgcctgtttctgatttgggcgcagcagttttgaacctggggtctcgggtatggcaggccagccttccaccctcctgcttcttcctcttgagatgattgctttagaagataaaatgcaccctttttgatgcaactttgaaagctcgggaaagtttcatttgtgtctagatttctcagttgaatttcctttatttgtagcttcttaacactctgaagctagctagtatggtacattatttaaaatgacaatttcctcttttggggggatgggacaggaagggcaaggtagagttttcaaaagaaaactggggagagaatgagcataggcatcaataaagaccttcttttacagagggaaatgactggctctgatttagcctccacaccctaggttcttttcctcatctttactcgttagcttgaaaatgtgtcagtttgttgttcatctatcttttccatgttctgtctgcctctggtttctgtggtgtttttgaaacagtacttcacaatgaagccctggcctgcctgaccaggctggtctctaacttgtagagctttctgcttcctgagagatgggattacagagatgggatcccagttgtgcaccgacaggtcctgcttccttccttccgtgtgatcggaggggagaggcagggtcctgttctcctgaccctttacaggactacaggagtgtaccaccaatcctggccaaaaaatggtttactgcataattaagttgagtctgaacaatacgtctatactaattcccaccgtggctgtttctccgtcctccgtttggcgaccgtagttaaccatgtcggtatttcctgcttgctgcaggtggcaggtggttttcaagggttttatctgtttcttgataccctgtgtaatctggcatactggggctagacctgcatgtggcagtgcagagacttgggccttttttccttttgtagtcacaataaaaatgtttgtcagttctggagtagtctcgttttaactgttagagttagactatggactcctatctatttaaatagaactatggagctggtgactactgtattggacagcttagccctaaagggttggtctgggtttgggttcagtttctttgaaaagaatacttcataaatgatgttgtagccttcctactgatcatttcaggaaatatgaatttccttcaaaactattaaaattaattaatagttcagctgttggtcttttcagttaaggattttaacagctgtgaataatactgcctaaacccgtgactttattatagtcacaaagtgatgacttctcaccatgtgatttgatatctgtgactgattacctcatgttcctgggtaagatccttagctgccttaaagttaagttcaaataaaacagctaggaaaaactggatttgagatgcggtttctctgtgtagccttggctagtctgagaacttgctctgtagaccaggttggctcaaactcactgatccaaattctgggattaaaggtgtgtaaaaccacactggataacaattttttttaaaaacaatttatattttttagagatttattaatttattatatataagtacactgtagctgtcctcagacactccagaataggacgccagatctcattacggatggttgtgagccaccatgtggttgctggaacttgaactcaggaccttcggaagagcagtcagtgctcaactgctgagccatctctccagccccaataaatttttttatgctgttttgttttgttgtgtttttgagacaggatttttcgatatagtcttggctgtcctggaatttactctgtagaaccggctagccttgaacttacagtgatcccctgcctctgtctcttatctcctgagcactgggattagaggcatgtaccaccactgcctgacttacgtatgatttttacattcctgatcactgaatacagtcattacccccaccatacccaagcctgctgcaggctgtacagttgcttttctactgggctgattcacagccagataggtggagtctagagtctgcttcctccctttgtgtcctttctctcctctgtccctaaggaggagagtttgtgagcatgtgataacatctcaagcttacaaatccagcctgtaaacctgggttctcacgcgtgtctcgtgctgagcgtcttggtccttctaattgtagttttcctgcattttatgtgtttcaaaataacactaaggctgctaaatggaatccggtgggggtttgtttgtttgtttgtttgtttgtttttcatttttcattactaggatataaagtaaaatactgtgcctaaaatatttacgtttttaggcaatagtttaatggactgctggagttttatgtgacataggaaataaagactatcggttgtttatatttgctcctttgcatcaaacattccttcctttcatccatcttagcattcattcccgaatgaaaacactctcccttgtccccatccctaggatggctgcagcctgcatactgagatttgtggatgggctacacttctattcagctactttgcttttggtgaatgtgagggttggtttcactgtgggctctttaagccaagacaagcagccttctttctgcaggtagcattttgtctctgttgatgtatgagtgaaagcgctttctagtttttggagtgccttaccaaatgtctttacatcacagacctctactgcagtattcaagtgtgggtagtgaacgcttcagagtaactcagctctttatctttactctcgctccacgtttacatgttctctcaaccctccctctgtcctgtgagtcaaatccagcaactcttacatgctgtgtacttacttcgagacagtctcactttgcagcccaggctaccctcaggctactcagcctggtggctcagcatcctctggtttacaagtgtgcagcaccatgcaagacttgttatatcttactgtaaagtagtacagtatggggtttttgttagtgcagatttaagagcccagctcctgtaccctcacacgcctaagctctttaatgcattctgacttattcctcacctagtagcttcatagaattcagggagaaaagaattgtttcctctacttttccccaagataaaccaggacttttctagggaacagcttgctgatgataggtggaactgtgaatcttacttggcctcaaagcatagaatactcacattctgtatatactagtgagatagtcctctgtgtgattggtgcatctttccaaattctgctattggatgataattttattaatttttatttacattctcaaagtcagttgctgtgagtggcaatgtgtgcttatgctgcagcactgctaggcaggctcatgagacttgagagctggaggccagggcaagagagacaggaatgtgtcaccaggattcagagcacagaccgacggtgtgtctgatttggacatttgactgataataagaatttattttgttaccatggtctgctttctgcgttttatttacatgatgtgtctttgacatcaattttacattcagcagagatcccctaactaatagcaggataagggagattgagattggtgctggacagacagcctactgcttagtgttcttgcagctacctgcgtcagattctcaaacccacatcatggctcacagctgcttgtatctcctgccacaggggaccctctaattggcctctgatgtgtatgtgtacagacatacacatacaattaaaatatatttctttaaaaaataagctcttgctgggcagtggtagcacatgcctttaatcctagcactccggagaaaggcaggccaatttctatgagttcagggccagcctggtctacagagtgagttccaggacagccagggctgcataaacactatttctaaaaaaataaaaataaaaacaaacaaaaacccaccacaaaacaaaacagaaactcttacagtgtcaatccaaataaacatgagattggctttggagctgttatagagttggaatggtgatacggctagcaaatcagcttgcttacttaaaacgggatcagagtgagaagtagcttagtaagtcctgacacacgtaaggctgatgctgatgttcgtgcactgttagcttgacaaccgctgcacacaccggattggctgagtggaggtgagctagtgggaaaggcctaaggtttttttgttgtggtggtggggtttttttggctttggggttttttggtatgatgttagtagccaaacatggtattgcttgcgtatgtgatgcaagccatgtccccatccccaaggtactttttaatttttttagtcagtctcaatatgtaccctagactctgctagaacttgtgtcagttctcttgtttctgcttccctgaagccaagatgacacgtgttgtaccgctgtgcttggtcactacagtactgcttaaatgagggggaagttagttctctttcctcccggagaaaagtgaatctggggttggaaggcaaccactgtctgctctctgtagggagggaagagtacagttacattttgactgattctactacaatagttaaatcacatggaaagactgatttatgaacagccatagaagtttgttttctttttctttttttcttttttttttttccttactgggaatagaacccaggactcacacatgataaagaggggctctaacactaagctactgccatcaaaagtgtttttttttttccttccttccttccttccttccttccttccttccttccttccttcctggaaacgaatcataacaaatgatatgtttttatttaaagacagatagagctccagggctaggtcagttcccaagcagcacttcccaggagaagccagtatgagctgttagtacccccagcagactctagtgtattttattacccttcactatctggtgattacaaagcagcaaaattagtgcctttagaaaccttttgagggcgtggcattgcttgtaattgctgacgtctagagaggtcttggtttctcagtgtcctaaaaatggccattgttcaggggtttgtgttaggatatgactttttaatgtgtcgatgcttgactagagctattctcaagctggagtaactgagactgaatggacgagtggatcttcaacaggcggacctctgcaggcattaactagggagtccacgagagggtcgagaagaactccaaggaaaagggtgacgcagggcttgccgctgagtcgggtttgcagagcggtagggccttagtgattgcttcacactgattgtttttgttctgttttcaaactaacaggtggaaacttcacagcattttcgtatagatggtgcagtaatttcagagagtactcccatagctgaaactataaaggcttcaagcaacgaatccttagtaaatatgtcttataaactatctaagtgctattctttgtaattacccttagttggaatttgggaggtggtgaattttggcaaatggaaataaatctaattaattacagaagaatcctaaataccatgaggataatttttttaccaaattttgaagagttctaaggtttcacgtgtgaagcactgaatgtgtttctagatcccactccctaaatttttattaggggaaaatcaaatattacagaagtaaattatctttttttatattttgttttgttttgttttcattttaagtgtgtttgctatatttggataattctgagtctgaataatttgaatcttggcaggtggccaataggttgactggaaatttcaagcatgcatcttctattctgccaatcactgaattctcagacataaccagaagaacaccaaagaaaccattgacaagagctgaagtaaatggatacaatttagcccaatgctgtctctcatctttcagagttttgctttgctttgctttgttttgtttggttttgaagtgggaggagacagaactttactgggaggtttatatgtatatatatatatgtgcgtatatggtttaaaggcaaatttagttgtgaaaatagaaattaatacagtgtggcatactaataatactatattcctgctgctgtgtggctcttcagttcctggttgcaggggagttggtgtgctgcttgtattaggctctttctgtcgttgaatccaagtttaaaatgctacttgggctgtgagggaagctgcccttttcttttgttgaaaagaccttcaagtacctttgtgtggtagactcctgtataactgatcttgaaaatgctagctgcatggcttattataattttaatcttaagcaatgttttaaaagctgaaatggtttaattgactttaaaacaagatagaggtctatattaattatgtatcgtctgtatttaatcctttacatatcacagattcctaacagggagaaatggtgcactcttaatgctttcttaatgcaaagcaaggaaatcccttgagggattttacaagccttgttgggctgctgggtgtttccctctaatgaccacgttaaggtaccatgccagtggtgagcggtgaagaggcttggaggcctctgaatacctagatgatagcagaacgaggccagagggtattttgttcccctaaagatctcttaagtatttaagttattgtgtgtttatactacattttaacttgtgtttgtttctttttttctcactaggtgggagaaaaaacagaggagcgaagagtagacagggatattc

SEQ ID NO: 44 - DNA, 1894 bp, Mus musculus
gaaagccacaaagaaaactgataagcccaggctagaagataaagatgatctggatgtgacagagctctctaatgaagaacttctggatcagcttgtaagatatggagtgaatcctggtcccattgtgggaacaaccaggaagctatatgagaagaagctgttgaagctgagggagcagggaactgaatcgagatcctctactcctcttccaacagtctcttcctctgcagaaaacacaaggcagaatggaagtaacgactctgacagatacagcgacaatgatgaaggaaagaagaaagaacacaagaaagtgaagtccgctagggattgtgttcctttttctgaacttgcatctactccctctggtgcattttttcagggtatttctttccctgaaatctccacccgtcctcctttgggcaggactgaactgcaggcagctaagaaagtacaaaccactaagagagacccacctagggagacttgtactgatacggccttgcccgggaaggggcagacgcacaagttagcccctggacggagtttatttattccttcagagtctagctatgatagatgtgtagagaaaagttcttcaccatcttctcagcgtgaatttgctgccaggttggtctctgctgcagcttctccttcactgataagagaaaccactactacttactctaaggacatagtggaaaatatttgccgtggagggaagagtagagctcagccattgcgtgctgaggagcctggcgtgtcagatcagtcagttttctctagtgaaagagaagtactgcaggagtcggagaggtcgcaggtcatttctccaccacttgctcaggcaattcgagattatgtcaattctctgttagtccagggtggggtcggcagtttgcctgggacttctgattctgtgcccacactggatgtagaaaacatatgtaagagacttagccagtccagctatcaagattctgaatccctgtcccctccccgaaaagtcccaagactcagtgagaagccagcaaggggcggggactcaggctcctgtgtggcatttcagaatacacctggatccgaacataggtcttcttttgccaaaagtgttgtctctcattctctgactactttaggagtagaagtgtctaagccaccaccacagcatgataaaatagaagcctcagagccgtcttttcctctccacgaatctatcctaaaagtggtggaagaggagtggcagcaaattgataggcagctgccctcggtggcgtgcagatatccagtttcctccatcgaggcagcacggatattatcagtaccaaaagtggatgatgaaatcctggggtttatttctgaagccaccccacgagcagctactcaggcgtcctccactgagtcttgtgataaacatttggacttagctctctgtagatcttacgaagctgcagcatcagcattgcagattgcagcccacacggccttcgtagctaagtctctgcaagctgacataagtcaggctgcacagattattaattcagatcctagtgatgcacagcaggcactcaggattctgaacagaacctatgatgcagcttcatatctttgtgatgctgcatttgatgaagtgaggatgtctgcctgtgccatggggtcttctaccatgggtcggcgttatctgtggttgaaggattgtaagattagtccagcttctaagaataaattgactgttgccccctttaaaggtggaacattatttggaggggaagtacacaaagttattaaaaagcgtggaaataagcagtaatgaggttaagaacaaaggcagaaactttgacttagagaatttgtgaacctttctaagactttagtctcctaatagagctaatttcaa

SEQ ID NO: 45 - protein, 601 aa, Mus musculus
KATKKTDKPRLEDKDDLDVTELSNEELLDQLVRYGVNPGPIVGTTRKLYEKKLLKLREQGTESRSSTPLPTVSSSAENTRQNGSNDSDRYSDNDEGKKKEHKKVKSARDCVPFSELASTPSGAFFQGISFPEISTRPPLGRTELQAAKKVQTTKRDPPRETCTDTALPGKGQTHKLAPGRSLFIPSESSYDRCVEKSSSPSSQREFAARLVSAAASPSLIRETTTTYSKDIVENICRGGKSRAQPLRAEEPGVSDQSVFSSEREVLQESERSQVISPPLAQAIRDYVNSLLVQGGVGSLPGTSDSVPTLDVENICKRLSQSSYQDSESLSPPRKVPRLSEKPARGGDSGSCVAFQNTPGSEHRSSFAKSVVSHSLTTLGVEVSKPPPQHDKIEASEPSFPLHESILKVVEEEWQQIDRQLPSVACRYPVSSIEAARILSVPKVDDEILGFISEATPRAATQASSTESCDKHLDLALCRSYEAAASALQIAAHTAFVAKSLQADISQAAQIINSDPSDAQQALRILNRTYDAASYLCDAAFDEVRMSACAMGSSTMGRRYLWLKDCKISPASKNKLTVAPFKGGTLFGGEVHKVIKKRGNKQ

SEQ ID NO: 46 - DNA, 39148 bp, Homo sapiens
  misc_feature (1)...(39148): n = A,T,C or G
atactgtgctaagtactaaggatgaggatacactgagtaaaaatgggtttttttgagcatcaggagacagatatgttaagccaccaaacgccataatgtgttggggtaagttcatgttacttggtaagaaccatgaaagtaacatgaacagagtggtatgggggtgctaaaacagtggacagtaactccacattgggttgtatgaggctataacaaggtgatacaacctctccatctacatcacaaaaatatggttttgtccaaatgagttaacatgattggtccaagctacgatatatgcagtatatgcaaatgatgccagagggaagaaatggcttctgttatgggctgaattttttttttttttttttttttgagatggagtctcaccctgtcgcccaagctggaatgcagtggcaacctccgcctcccaggttcaaacgattcagcctcccaagtagctgggattacaagtgcaccccactacacccagctatttttttgtttgtttgtttgttatctttagtagagacaaggtttcaccatgttggccaggctggtcttgaactcctgacctcatgatccacctgcgtcagcctcccaaagtgctgggattacaggcgtgagccaccacacccagtttatgggctgaatttcatctccccaacattcatatgttgaagccctcactcctagtacctcagaatgatcgtaagacctgattaagtacgctaggtgcagtggctcacgcctgtaatcccagcactttgggaggccaaggcaggtggatcacaagatcaggagttggagaccagccttgccaacatggtgaaaccctgtctctactggaaatagaaaaattagctgggcgcggtggcgggtgcctataattccagctactcgggaggctgaggcaggagaattgcttgaacccgggaggcagaggttgcagtgagccgagatcgcaccactgcactctagcctaggtgacagagcaagactctcttttaaaaaaaaaaaaaaaaagacattattaagtaaaaatgaggccattagggtgggccctaatccagtctgactggtgtcatatttataagaggaaatttggacacacagacaccaaggatgtgtgcacacaggggaaaggccatgtgaggatacagcaagagagtagccatctacaagccaaggtctaggaagaagccaaccctgctggcctcttgatcttagacttctagcctcaagatctctgagaaaataaatatctgtttacttttattatggtagccctggcaaacgaatacagcttccgtcaagaactactagttctgcagaatggctggagaggtaaataggcgtcagcatacaggatcagtgtgccattccaactaatttagattttattctgagggcaatgcagaactataattcatgactaagacaatccagccagcttcacaaagactaaaaaatggccaagaactgttcctggaccaccatcctgggaataagttagaaatgcaaattttcaggcctcacctcagacctacagtctcagaaaattgggtgtggggcacagcaacaaaccttccagccgttttgatgcaagctaaagtttgaggacctccggcctataaagcaaggcaagactagacgtcctacttaccccacaggttaaaaggatcaaataagataaaatacatcaaaatgtttttgaagctgttatacatgtcattattaatactgttatggctctaaaactgtcacttcccaggtcccagattctttcccaaggctggacatctgtagttttttagaatgctccatctgatgactttctataactttgaaatgactgcaaatccaacactttttaacttaatcttctatactcatgatatagggatgatatacggaaagagttttataggaaaggtggaaacaaagagctatcaagagctatgaagtgtcaggatttgaactgaaacatggacctgtctagaaaagacagctctgtggatttgttctatttcactaagaaatgtctattcatgtattcttgcaagaggacttatccactactatagaatgctctgagcatttatttcacctgtttaatagccttgctttcttttctgagagtattttagttacttaagtcctgtgaaagaaaaatctcggtgttactggggtcccaatccagaccacaagagagggttcttgaacctcacacaagaaagaattcaaggcgagtccataaaatgaaagcaagtttattaggtaaaggaataaagaatggctactccataggcagagcagcccagagggctgctgattgcccatttttgtggttatttcttcattatatgctaaacaaggggtggattattcatgcctcccctttttagaccatatagggtaacctcctgacattgccatggcatttgtaaactgtcatggtgctggtgggagtgtagcagtgaggacaaccagaggtcactctcatcgccatcttggttttggtgggttttggcaggctactgcaacctgtttcaccagcaaggtctttatgacctgtgtctttttttttttttttttttttttttttgagacagagtctcactctcgcccaggctggagtgcagtggtgcaatctcagctcactgcaacctccacctcccaggttcaagcaattcttctgcctcagcctcctgagtagctgggactacaggcacgcgccaccacgcccagctaatttttgtatttttagtagagacagggtttcaccatgttggtcaggctggtctcgaactcctgacctcgtgatccacctgccttggcctcccaaagtgctgggattacaggcgtgagccaccgtgcccggcctatgacctgtatcttctgccgacctcctatctcgtcttgtgacttaaaatgccttaactgtctgggaatgcagcccagtaggtcttttcttttttttttttttttttttttgagacggagttttgctcgttgtccaggctggactgcaatggcgcgatcttggctcactacaacctccgcctcccgggttcaagcgattcttctgcctcagcctcctgagtagctgggattacaggcatgtgccaccacgcccagctaattttgtatttttagtagagacagggtttctccatgttgatcaggctggtctcaaactcccgacctcaggtgatccacccaccttggcctcccaaagtgctgggattacaggcatgggccaccgtgcacggccttacccacccttttttcaacatggaggtgctgtgattcaaacccctctaacatcaggaccccaaaaatgactaagccaaagggaaagtcaagctgggaactgcttagggcaaacctgcctcccattctactcctaaaaaaaaagatagctactaagataaaaaagctatatatacctccctcacaatttgaccacaaagaaattccttgtggacaaaggacagatagagatttaaaaagtcatccctctgctcatatgagataaatgcatatctgattgcccttttgtttccctaagccagactaacataagtgactattcctgtaaatagtgtattcagtgaaaggctaatcagcaactcaaaagaatgcaaccattggtcttttatctacctatgacctggaacaccccggagccccccaacccccacttgtattaatagctgtcccgcctttctggatgggaccattgtacatcttaaacatattgattgatgtctcatgtctccctaaaatgtataaaaccaagctgtgccacacaaccttgggcacatgtcgtcaggacctcctgaggctgtgtcatgggtgtgtccttaaccttggcaaaataaactttctaaattgattgagacctgtctccgattctcttggtttacagagcgatgtattctggacgaactaataaaattgagcttttggacacgcagaattgaaatgcagacctgaattctgataagccaaatggttctccaacttagcactctcacttaaaaagaaaaatatggttttaaaatcatatgtgttcattgtggaaatctagggaaatacagacatataaataaaaagaaaataagaatcacctgtgcctcactatccaagagaaagtactccactttgatgtatattattttttttcttttcttttcttttttttttttttttttttgcctccccaatagctgggagtacaggagcacaccagcatgccagctaattttttttttttctttttttttgagactgagttccgctcttgcccaggctggagtgcaatggcgagatcttggctcactgcaacctccgcctcccaggttcaggtgattcttctgcctcagcctcccaagtagctggggattacaggtgcccaccaccacacctggataattactgtatttttagtagagacagggtttcgccacgttggccaggctggtcttgaacccctgaccttgggtgatccgcccgcctcggcctcccaaagtgctgggattacagacgtgagccaccgtgcccggccccacctaatttttggttatttttagtagagactggggtctccctatgttgcccaggctggtctcaaactcctgagctcaagggatcctcccacctcagccttccaaagtactgggattataggtgacagccaccaagccagcctcatattcttaaatgtcaaaacatgattttttactactgtgcattattttgtcatatggatatatcataaacaaccaattccttactattggagatagagattttttatttttttcaccattataaatgaagcaataaatacctttataaatgaattccacatttgattttatctttagaataaattatcagaaatggcttaagggagctaaactttttttttttttgagagaccgagtctcgttctgttgcccaggctggagtgcaatggtgccatctcagctcactgcaacctccgcctcccgggttcaagggattctcccacctcagcctcccaagtagctgggattacaggcgcatgccaccaggcacggctaacttttgtattttcagtagagaggggcttccaccatgttggtcaggctggtctcgaactcctgatgtgatctgcccgccttggcctccccaagtgctgggattaccggtgtgagccaccgctcctggcccctcttattatttttttttaagatggagtcttgatcggtcgcccaggctggagtgcagtggcacgatctcggctcactgcaacctctgcctcccgggttcaagcgattctcctacctcagcctccctagtagctgagattacaggcgcccaccacaaggcccagctaattttttaatttcttggccaggctgagctcgaactcatgacttcaagtgatccgcccaccccagcctcccaaagtgctggaattacaggcatgagccacgacgcccggccgagaactaaacattttttaaggtttttagcttcttactattttacatcacttaaagtgcaacttaccctcctgtttgaggtgacacccttaaattcacaaccaatcctccgcaaaatgggataatgaaaaacaaagccagctgtatgttaataatattaagaacttcaaaaaaagaatggaggcagttatccaggtgatttttgtttgtttgtttgttttgagatggagtttcgctcgtgttgcccaggctggaatgcaattgcacgatctcggttcaccacaacctccgcctcccgggttcaagtgattctcctgcctcagcctcccgtgtagcttggattacaggcatgcgccaccacgccaggctaattttgtatttttagtagagacggggtttctccacatggtctcaaattcccgacctcaggtgatctgcctgcctcagcctcccaaagtgctgggattacaggcgtgagccaccgggcccacctccagatgatttttttttaagttatgggaaagttttctgatttaaaaaaaaaaaaaattgcatcaggccagacgcagtggctcatgcctgtaatcccagcaatttgggaggctgaggcgggtggattgcctgaggtcaggagtttgagaccagcctggtcaacatggtgaaactcttgtctctactatattacaaaaaaattagctgggcgtggcagcaggcgcctgtaatcccagctacttgggaggctgaggcagaagaattgcttgaacctgggaggcagaggttacagtgggctgagattgtgctactgcactccaggctcggcaacagagggagactccatttccaaaaaaaaaaaaaaaaaaatttgcatccaccaggcacagtggctcatgcctgtaatcccagaactttgggaggctgaggcgggtggatcacctgaggtcaggagttcaagaccagcctggtcaacatggtgaaacccagtctctactaaaatacaaacaaattagatgagtgtattagcaggcgcctgtagtcccagctactctggaggctggggcaaggagaattgcttgaacctgggaggcggaggttgcagtgagccgagactacgtcactgcactccagcctagtctctgttggacattctgaccacagtcagaatattaagacttctaaaaactctcatttccctgtgaaattttctgaattaaaattacttttatctaccaatgacctggaacaccccgagccccccaacccccacttttattaatagttgtcccgcctttctggaagggaccaatctacatcttacacatattgattttagagacagggtctcactctgtcacccaggctggaatgcagtgacaggattatggctcactgcagcctcaacctcccaggctcaagtgatcctcccacctcagtctccctagtagctagaactacaggtgggcaccatggctaaattttgtatttttttgtagagagggggttttactgttttgcccaggctagtcttgaactcctaagctcaagggatccgcctgtctcagcctcccaaagtgttgggattacaggcgtgagccacagtgctcagcctttgtgttttttgtgtcacattgatcaaatattttaaaaattatcttttatgttgaaacaagtattaaggagatgatggaaagagtcaattccttgagaagggtgagagccagagtacaagtggtggaatttccttctgacaggacacatctttcactgaaaagaaaaatgcaagagaaaatgaatgcaaattggaaagtctgacgttgaagcattcctcataggtggtttttattttttgaagttgaggcaaggtcaccagctaaaaatgagaggtagggaaaaaggatgtgaaatttgaggagatgtgaacgtatgaatggttaacccagagactggaatagcattgccagccagtgttgagtgctcctgagaggactgaggtcatgaattaaaaccagttagcttgttatatgactgacttttctccagcagcttttgctgtttggatgtaagcaatgagaaagttcagctggagcatggtttagtccaagcaaggctgagattctttcaagcaaaaaaggagacattgagatcagagagttgaaaatgtttgtaaaagagtgatgaaaaggactgatcagggaatttaagtcaggtgagttgcaaaattattacatgatggcagaagcagaagagttgagtttttttaagtgttggggttaatagcgtggaggtcttaattaggtaagtgagagtaccataaattagctgggaaaaaaaggctagtgattgacaattgggaagcttgaaactgagatttcaactgatgacaaggttcagaatctgactgataccgaagtggttaagacgcaagagaggaacaaattgttggagatgaagaggtcagaggtctaagaggccaagtgttggtgttgcatgggtcacctacaagcatgctgaattcagatagaatgtagacaagagggatggtgaggaaaacctacggcaagcagctctataatttctggaaagtgaccaggaggctcgtggatgatggcaggaaggagagtagaaagtgatttagccagaagatatgaacttcaaatatttttgaagcagaaaagagcagaaatggtttggaagtagcaatcaggaccaaagagaccacccaaactcaatagcccaacctcttagccttagggtacgcagaatctgaaaagtgtaatctcaattttggagctctacagcagtaaatctgcaagtaaccacctgtagctaatgtccagggattaaaaaaaagataatgaaaatgtttttgcccaggaaacattaatttcaggcgtatctagaatgcagttcttgcattatacgtactgggttaccagtcattgcaaagtcatggtcctttgcctctcagctcagttccccttctgaagataaaaacatttgcctatgtgtccagggaagctgtgaggacaaaaaaccaagcaacttttacaagggatcataaaaacctacctaacaacttgctaattaaaacctgatttttaatttgcattattgagcttaataccattgcttaaatgtatgtgaatactgagatttttataaaggaattagttacctctaggaaaataattatcactaaaagaaataatatcgcaatttgaataaaagtaagtcgcttaaatcataggaaacatttttagtgaaggcgtttgttttaaatgtattctaacctagcaatgtagaaagcaggcaaacatttaaaaaaaatttaaccagtttctaaaacatagtttggagctcagattctggggaaatgattaacacaccctacatccaaggtctcctttcctttctagaaagaaagcatctttaaacatacatattcatcagaaatacaaatatttgtcatcagtgatactaatttccaggcaaacattttaattgcagtcaatgtattagattctaccaggttttaatttggatcggtaatacgggtttgattagggttctaggcctaattataggtcactagtcttcctttaggattatgcaccatctgttattttaaattgaccattgagggggttcccaagggttctccttcgttttgttatcaaacgttaggtttaggattcttgcgggtggtgggatccaaagccagagacggtttcaacaaaaatgcaagcgcgaatttgtcttgcgtctgaacgcactgttcaaattaaacaatttagacatgccccaactatgacactaagaagtgaatggtatagtacacttttgtcacaaattcaagggtaatttaagtgcccgattgtagaggtctggcttcccctgggtttctggaacaaaagaagcgttcgcgaggagaggggtaactccccgccctccccctcccaaagtaaatcaaatcaaggaatatgagtgcctgcagacaagcctcgcttcttttcttccccttcagggctagcgtttggggaaggcaaggctgcggctactcttggagcttcagtgtcccgggaggaagaaaggcccagccaagggtcctcacactggcgtggaattcggcgcgttcgtaggcgatcgaccccagagacgaaagctgcttctcaagctgggggagggagaggaaacggcgcacaaaagcagtacgacctgtcccttatcggcgtctaaggggaagggtggagaaaacgaaaacagaagcgggccgggagcctcggctcccgccccagcgccttttaaactgcgtttctacctcctctcgctcagcgcggcggctaatggaacccgcgcgagccgtctcgccaatcaccgccgcgcttcctcccgtcgcccgccaatggcggcgcgcgttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcagggtaaggacgcggggccggggctacaaaggcgggcgtttggcggttgccgcgcgcgctcgccgccgtttgcagcccctccctcccgggcgccccctcgggcctcccaggtgcggggctgtccctgcgccccctcgcgtcgccccttccccgcggggctgcaggcgccggagcggagaggccagaagttggggccgcggggttcgcgttctttgacgtgtgggtctgggaggtgtggagttgcgttggcggcggttgttttgcacgcagtcgacgccgcttccctggaccaccagccgcctgcagcgggcgtttagacggggacttccgtgccctttcgaaagctctggaggggtggccccaaaatgctataggttaagttcgagcgttttcccgctttattaactgaaatgactcgcagcagagtctcagagcgctccctggagggcaactgatgacactctaatttctaaccaaaatttgaaatgaggaaattcccgcctttttatacttttgcgtgtggagggctttttgaaccgtttatgttttctagtttgttttaatttttcccagcaacaggccatcttttggcggaacagcttcatgccgaattaaaaggagcattttaaactatatttttaggcgcctattataattttttagtttttatttatttatttttttagatggagtgtcgcacttgttgcccaggctggagtgcaatggcgagatctcggctcaccgcaacctccacctcccgggttcaagcgattctcctgcctcagcctcccgagtagctgggattacaggcatgcgccgccacgcccggctgatttgtgtattttttagtagagacggggtttctccaagttggtcaggctggtctcgaactcctgacctcaggtggtcctcccgcctcggcctcacaaagtgctgggataacaggcgtgagccaccgggcccggccctgcaaacaaatatttgaaaattgcagtttggattgcgttttccccacatattggtaaattttgcttgaggaaacgaaagacttaggattcaggaaaaatttatttcatgacattctggtgcatcagtattgcaatttggaatgtctgatcctggttaaatctcaaatcggctccagcaaagcatgttttgtttcagaatagtttgcttttttacctgtggattttaatatgctttttgtgggtttgcttatgcctgccgagttaccaggcttcaaatcgtaataggatgaagctaaaactagtaattggtgtaacataaaatgccttgtaagagacagtgaatgtggtgtttggagttgttgggaatgatcactagtttaaaccgaaattattccttccttcaaattttactttagtttttaaggaacctgtctaatgtgttttcccggctactcaggcagaaatgaaagacaaatgtaatagacacatgtaaatttaattgaaaatcttattctcggcttcagagaagttgaaagttttaccaaacgtcttcagtccggtgtctggcacatagtagtgccaaatatttgtacaataaataaaagaccaatcacaccttattgtttaaacatcttgttttgcggaaagcttctttaatttcttaataaacaaatttacttttgaaataaaagcgtacccgcttacccgttatgtttccctgctctgaaaaagaaggtagtatttaaactctttaagtagagttggttgaggccgggcgcggtggctcacgcctgtaagccccgcactttgggaggcccaggcgggtggatcacctgaggtcaggagttctagaccagcctggcccatatggtgaaaccccgtttctactaaagaaaaaaaatacaaaaattagccgtgcctggtggcggcggccgaggcaggagaatcgcttgaacccgggaggcggaggttgcagtgagccgagatcgcgccatcgcactccagcctgggggacaagagcgagacttcgtctcaaaaaaaaaaaaaaaaaaaagttgtttgaaaataatatttaaatcagcacactttataaaaaacctaattttctatagaacccttcattggtcctctgtgcaaaagtattaaaccgtgaagtttttggttgtatgtttataatagaattactggttattatttttaggcgggatctcgctttgttgcccaggccggagtgcagggatgtgatcatagcttactgcagcctcaaactctttggctcacgagagcctcctgcctcagcttccctgagtagcaagggcaacggggcatgcaccgctacacccggctaattttctaatcttttttttttttttttttttttttggtacacaggctttctgtgttgtccaggctggtctagaactcttggcctcaagcaatcctgcctcagccttggttcctatttattttgaggatgatttcttttacacagaaacaaccatctcagttttaatgttttcctatcagccacttggtaaaagagagtttatgtccccatctaccttgtgttcttttggggggtaagaagacctaaatgtaaaaattttttaattaagattatccagcaattttgagttcctaccaagtgttcttaactactgggtttaaaactttggggatttaaaaatgaattgtgtttatttacttgtctgtccaactcatatgttaattgaagttggttagcatcatgtaaataagttttgagtaaaatgaagggttttttttttttgagacgagtcttgctctgtcgcccagtctggggtgcggtggcgcgatcttggctcactgcaagctctgcctcgtgggttcatgccattttcctgcctccgcctcccgagtagctgggactacaggcgcccgccaccaccccccagctaattttttgtatttttagtagagatggggtttcaccgtgttagccaggatggcctcgatctcctgacctcgtgatcctcccgtctcggcttctcaaagtgctgggattacaggcgtgagccaccgcgcccagccaaaatgaagtaatttttgttgttgttattttgttttgtttgttttgttctgagacggagtctccattgcccaggttggagtgcaatggcccgatttcatctctgcctcctgggttcaaatgattctcctgcctcgacctcccgagtagctgggattacaggcgtatactactatacccggctaatttttgtatttttagtagagaaggggtttcgccatgttggccaggctggtctggaacacctgacctcaggtgatctgtccccctgggctttccaaagtgctgggaatgcaaggatgagcgacggcacccagcccagaagtcatgttttttagagtacctagtaggtctattggcatggtaattaagctctttacgtttcatttaattatttcatccatataaagaaaacttacttcataattacaggtttaaatgtcttctacctggagtatttaaaactcaagaggtgtttacccttgactgagcttaatagccatgccaacaacttgaagaaaaatattggtagtcagcgtcattttctgttttaaagtacgttaagtacaagtgagttataattaggagtctgttcgatgtttttatcagccataggaaaaaataattttaagtttacaggaaaagaaatttataataatttatgtgtaaaattattcatgtcaattcctcttatatgtactatattttacgttttggtcatttttagccccatataaaaataataccaggtcatatttctttttttttctttctttctttttttctttttctttttttgagatggagtcttgctctgtcacgcagcctagagtgcagtggcgtgatgtcagctcactgcaacctctgcctcccgggttcaagcgattctcctgcctcagcctcccaagtagctgggattacaggtgcccaccactgcgcccggctaatttttgtatttttagtggagacggggtttcaccatcttggccaggctggtctcaaactcctgacctcagttgatccacccgcctgagcctcccaaagtgctgggattacaggcatgagccaccgcgcccggccaaccatatttttcccttccttccttccttccttccttccttccttccttccttctgtgtgtgtgagagatggagtctcactctgtcacccaggctggagtgcagtggcatgatctcggctcactgcaacctctgcctcccaaattcaagcaattctcctacctcagcctcctgagtagctggtattacttacaggcacacaccactactcctggttaatttttgtatttttagtagagacaaggtttcaccatgttggtcaggctggtctcgaactcctgacctcgtgatccacctgcctcggcctcccaaagtgctggaattacaggagtgagccacctcacccggccaataccaggtcttatttcttttttcctttttttttttgaaacggagtctcagtctgtcatcccagctggagtgcagtggtgcaatctcggctccctgcaagctctgcctagctgagactacaggtgcccgccaccacgcctggctaattttatgtatttttagtaaagactgttagccaggatggtctctatctcctgatctggtgatctgcccgcctcggcctcccagagttctggaattacaggcatgagccaccgctcccggcctccaggtcatatttcttaaagaatatttataatcttctgcataatggagtggtaaaaaggaataaaagaatatttatttatattataggagaaagccaaattatgtttgagagttgcagataagggagatttttaacattttaagacaaatcaagcattaatgtggatttggccaagattaactatttgcatgcatataccttctatttaatcatgggtttatgaggaatttttttttttttttttttttttttgagacggagtgtcgctctgtcacccaggctggactgcagtggcgtgatctccactcactgcaagctctgcctcctgggttcacgccattctcctgcctcagcctcccgattagctggggctacgtggtggcacctgccaccacccccggctaatttttttgtatttttagtagagacggagtttcactgtgttagccaggatggtctggatctcctgatcttctgatcctcccgcctcagcctcccagagtgcggggattacagacgtgagccaccgtgcccagcctatggggaacatttttaattaaataagaaattgtttcatttcagcttctaccatagtctcttggattcacttggtataatgtgacaaaactttgcatgttaaaagttttgtttttattttgttttcttatttctaagctttttattttatgtatcttgctaccaatatttttaggtgttgaaactacctagattgtggacacaaaaataaacatttacagagttggcagtctgcctttttgttttaagaggcagagcctgaaggtgtagctatttggatctagtggagcataatattcttgaatgatctgttctggtgaattatgagtgtgtgtttgagaaggagtcttgcgctgtcatccaggctggagtgcagtggcgcgatctcggctcactgcaacctccacctcccgggttcaagtgattctcctgcctcagcctcctgaggagctgggattacaagcgtgcaccaccatgcccagctaatttttttatttttagtagagacagtttcaccatgttggtcaggccggtctcaaactccttcctgactttgtgatctgccccccttagcctcctaaagtactgggattacaggcgtgagccaccacgcctgtctgtgtgtttgtttgtttttttaagagatagggtctcgctctgtccctcagactgtagtgcagtggtatgatcatagctcactgcagcctcaaactcctgggctcaagcctctggaatagctgggactacaggtgtgtgccaccatgcctagctgatttttaaaatttttatagagatagtctcactatgttgaccaggctggtcttgaattcctggcctcaagggatcctcctgcttaggcctcccaaagcgttgggattgtaggtgtgagctgctgctcctggccaaattatgaattctcaataggaaatatttgaagacctggaaaagaacataaaagcatgctaccaataggaaatgttaattaaatcacaaatttaccaccactgtataataaggtgttaagtttacagacttgtgaataatagagttatagattcaaattccaggtctgccacttattcatatgacactgaacagtgtcttaatctaagatcctctattttcacctgaaatagaggaataacctaatagctacttaatcagattgaggagtacatgccattgcatatgtgaagtgtctagtgcttagtaattaatagccattaaatgatttctgaatttttgtctttaatgtcagggcaatatagtgcaatgttactaaaatataattttgggaaacgaataaggtagataagtgaaagtgacatgtatatcatagcatgcagatttcctgagttagtgaagagcatgcttgaacctcagttttctgagttgtcagatggggatattagcattttattccatagatttttaggactctgtaagttaatgcaaagacacttggaacacaactcagtacgtaatacataataagtgcccactagaatatattgttatggttcaacatctttatactagaggtagagattaaaggaattagagaagctcatcggtgatatcatagagctgttgggttttgaagttgaaaaatacgttagagatcatcgggtagcatagtaggtactatttttgagtgaaactcttaagtgatctacttaaaggaacaaagctttctggaggcagaatttaatgcaactgatgcttcctttttcctgactgaaactgctaatcatgtacagcacactgtctcctaattttttatccttattaaatctgagatttataaaatgacatcacttttctggaacttttttcctgacagattaaaaaccacatgtttgactgtgtgcagtggctcacacctgtaatcccagcactttgggaggccgaggcaggtggatcacctgaggtcaggaattcgagaccagcctggccaacatggtgaaatcctgtctcttctaaaaatacaaaaattagttagtcgggtatggtgttgcgcgcttgtaatttcagctgcttgggaggctgaggcaggagaatctcttgaacctgggagatggagggcatgccactgcactctagcctgggcaacagagtgagactccatctcaaaaaaaaaaaaatcacgtttttggttttaatttatctgacttaccttatgtagatttgttggtcacttatttaagatatctttgttcagctgatgtttttcattatgtttgaaggaaatataattgattttctttctttcttttttttctttaggcgaagtctggccttatcacccaggctggagtgcagtggcgcaatcttggctcgctgcaatctccgcctccccaattcaagtgattctccagcctcagcctgccgagtagctaggactataggcgtgtgccatcacacctggctaatttttgtatttttagtagagatggggtttcaccgtgttggccaggctggtctcaaactcctgacctcaacgggagatcctccctcctcggcctcccaaagtgctagaattacagacatgagccactgccgagaattggtttttacttagatttgataggcctgttatttctaataagaaatggattttcaaaaataaattactttttccttccccagatttgacaaaacatttatcagggggctattcctgtatcagtctttttagaaatgtttagatgcttggaataagaatatgaggatgatagtgcgtctgctttctgttgcttgcctcaatgctgcatccagatcacctgggctacacaattacaaacagattatctggcccaaggtgaagaatcagaaatgggtaagacctttccaaatagaggtaacaagagttaagattttgggctgggtgctgtggctcacgcctgtaatcccagcactttggaaggctgaggtgggcaaatcacgagctcaggagtttgagactagcctggccaaaatggtgaaaccctgtctctactgaaagtacaaaaattagctgggcgtggtggcatgcacctgtagtcccagatactcaggaggctgaggcaggagagttgcttgaacctgggaggcagaaggttgcagcaaggcaagatggcgctactgcactccagcctgggcgagagagttaagagactccaccttgaaaaagaaaaaaaaaaagagttaagattttttttgagacagagtcttgctctatcgcccaggctggagggcagtggcatgatgtcgactcactgcaacctccgcctcccagattcaagcaattctcctgcctcagcttcccaggtagctgggattacaggcatgtgccaccacacccggctaatttttgcatttttaatagagacggggtttcaccgtgttggccatgctggtctcgaactcctgacttcaagtgatccacccaccttggtctcccaaagtgctgggattacaggcatgagccactgcacctggcccaaagagatttcttgaaaacctctcaggcgggtttgaaaagttggaatttcctggatgttttattgatagtaaatttgaacattctcgtggtagtggggattatgtacaaataatttgaacctgattgattgtttttccatgttttatttttattttaagcattatttagtttttctgtactacctgactgcactttttggaaaatttgagtaagtcagtaacataggattaagtttgtttgattaaatcttttcttgaaagaaataagtcttagaactcttagaccctaggcaactatttggatattatggtgtgggttgcttccagatatgagcctgacagttctaggtcagtgcaatgtatgtgaattaaagcctgctaaaagtactctcactgtaactctccacagccgtctatttaagatttctcgtaagttgacataattgttcttatgagcagctatttttttggtgaaggttttttggcttctgattatagaatgattagccattagcagctttttaaaaagaatttctcatatcttgctttatttgaagtatttcaggccaggttccatggctcacgcccgtaatcctaggactttgggaggctcaggcgggcataacatttggggtcaggagttcaagaccagcctggccaacatgctgaaaccccgtctctactaaaaatacaaaaattagccgggcgtggtggtgcacacctgtaatcccagctactcaggaggctgaggcaggagaatcacttggaccttggatgcagaggttgcagtgagccaagattgcgccactgcactccagcctggataagagtgaggcacagtctcaaaaaaaaaaaaaaaaaagatttgatttgagcctgacaattctaggtcagaacatttttattgttaaaaacagtaattccagtacatagtcaaatcatgactgatttttccccctaatattattggaaagtgagcattccatacaacttgataattttagcctttttcgtaaaatttactttgatgttgccattgtttaattagccatttttttgttcagtactctgatgttttttctgtgatcactgaggcatttgtcaggctgtttgccacagccttaaaaggtatccgtacttttgcttcctttttatttgttcaaccttggaaatttatagtttttccagtaaatactgcctttgtagaaattaattttaaaactttcaaattttccctcaaagtttgtttcaagttattttgactatttttagtaaactggtggtacagaagttaatctggtgactaaactgtgtcacaggtgataatttaaccatgaagtctgtcagatttccttcctaagtcataaactagctactaaaataactgtgttacaaggagtttacagtcctgtctcctatccttggggtggagattggttccaggacccggccatggatatcaaactctggggatgctttagtaagtcccttaatatatagtggtgtagtaacctacacacatcctcccttatacttcagatcatctctagattacttataacgcctaatacaatgtaagtgctatgtaaatagttgttatactgtatttttgttagtgtttttattgtcgtattgtcttttttttacccaagtatttttgatctgtggttggttgaattcacatatgtagaacccaactgtattcatttgggagaatggagagccaactgtattcatttggccttcttaagttctcatatgctgtttaaagaaaatcatttctggccgggcgcagtggctcatgcctgtaatcccagcactttgggaggctgaggtgggcagataacgaggtcaagagatcgagaccattctggccaacatgttgaaaccccgtctctactaaaagtacaaaaattagctgggcgtggtggcgcacacctgtactctcagctactcgggaggctgaggcaggagaatcgcttgaacccgggagtcggaggttgcagtgagccaagattgcaccgctgcgctccagcctggcaacagagcgagactccacctccaaaaaaaaaagaaaaagaaaagaaaatcatttctatatatgtatctaagtgtaagcctgtatggtaaagtcttaaactttcctggattaatttaaatttttaaggattatcaaaaagttagtaagtagcattcatgatcatttagatgaaaaatgttaagcccagtctggctttactttccatggttcatgctgatctgtttccgttgccattggagttatatgctttaagaaatgaaatataatttttggttatttaggctgtgtgcagtggtttacaactgtaatcctaacactttgggaggccaaggtgggctgatcacttgagtccaggagtttgagaccagcctgggcaacatggcaaaaaccccatctctacaaaaaaaaaaaaaaacaaaaaaaaaaaaccacaggcaaaaagccaagggtggtggtgcgcacctgtagtcccagctatttgggagactgaggtgggaggatcgcttcagcctgggaggtgggggttgcagtgaactgagatggagccactgtactccagcccgggtgacatagctagaccctgtatcattaaaaaaaaaaaaaaaaaggttatttaaaagaaaatgttacccaaagtcagttttacttttagttgctcttttgcatttttgatgccattactatctcttttagataggtaatccaaaatggactattttaacaacaatgtctttaagttacttgcttggctgtgcggtttgtatgattacagttcaacttagaaagtgttctccaataatgagttgctcttaatttaatggaattgctaaggcctaatattactataaaccaatttggtagtgagtttgcatgtttatgttatacaggttattatctagtaagtgaacactttaattcatatggaaatgattactggactttgtttacagaaagccacaaaaaaaactgataaacccagacaagaagataaagatgatctagatgtaacagagctcactaatgaagatcttttggatcagcttgtgaaatacggagtgaatcctggtcctattgtgggtaagttgataaaatttcaaatacagtatcttttctctgaagcaggaccccaaattattttctcctttttgtttagcagtttaggttccaaggactggtttgtcattaatcatttgttatcagcagaacctgtgtttctttgactgtaaatgagtgaaataaaatgagaggattgaattagataatctccaaaattacctctattgttgagattgttttatatggtgcttatatcgtactttttttttttttttttggttttgttttgttttttgtttttttgagacggagtcttgctctgtcgcccaggctgtagtgcagtgacgcgatctcggctccctgcaagctctgcctcccgggttcatgccattctcctgcctcagcctcctgagtagctgggactacaggcgcccgctgccacgcctggctaattttttgtatttttcagtagagatgggatttcaccgtgttagcaaggatggtctcgatctcctgaccttgtgatccgcctgcctcggcctcccaaagtgctgggattacaggtgtgagccaccgtgcctggccacttatatcgtacttctgctgagacgtgggtcttgtatgacaattgaggaaaatctgaggtaacatagctgggcaaatttgcccaaaaatgtgtttnnnnnnnnnnnnnnnnnnnnttcagatcatctctagattacttataacgcctaatacaatgtaagtgctatgtaaatagttgttatactgtatttttgttagtgtttttattgtcgtattgtcttttttttccccaagtatttttgatctgtggttggttgaattcacatatgtagaacccatctgtattcatttgggagaatggagagccaactgtattcatttggccttcttaagttctcatatgctgtttaaagaaaatcatttctggccgggcgcagtggctcatgcctgtaatcccagcactttgggaggccaagatgggaggattgcttgtgcccaggagttgaagaacagcatgagcaacatagggagatcccatctctgcagaaaattttaaaattagcagggtgtggtgtcacaaatctattgtcccagctacttaggaggctgaggcaggaggattgcttgagatggtggggggaagtcaaagttgcagtgagccgtgatggctactgtacttcagccaggggcagtggagcaagaccctgtctcaaaaaaaataaataaataagggaaaaagaaaaagtgagttagtgacagacttcttcttaatgaagttattaaattcctagcctagtaccctattttttttttttttttgagacggggtttcgctcttgttgcccaggctagagtacaatggtgtgatcttggctcactgcaacctctgcctcccaggttcaagcagttctccagcctcagcttcccgaatagctgggattacaggcacctgccaccatgcccggctaatttttatatttttagtagagatggggttttgccatgttggccaggctggtctgaaactcccgacctcaggtgatcccacccacctcaggctcccaaagtgctgggattacaggtgtgagccaccgcgctgagcccctttttcatttatcattaaaagtacccttttgaaagtcctatcttgattggaattgaggaattatacccttaaaaaacaaaaacctaggactaaatacactggatttccatcgttggattacttttaggtgatgaagattttgcagtgttgattatgccttagttttggagggtcttagcaataacctcaagatgagaaaattccattttattattatttttttttttgacaaggtctttgctctgttgtccacgctggagtgcagtggcacagtcatggcttactgcagcctcagcttaggctcaagcagtcccacctcagcctctcaagtagctgggaacacaggcacgtgccaccattcccggctaatttttgtagtttttgtagggatgggggcacactatattgcccagggtggtcttgaactcctgggctcaagcagtcctcccacttaggcctccctaagtcctaggattacaggcatgagtcactgcatctggtcttgatcttctaagttacctaaaattgtggacgctagagatttggtaggttttgctataggtatagttgcaaataaagatttagaatattttgttttaatgtataagctgcttccaaataatcataagcttattcatatacaagtaccaacagatatataacacttttaaaaaatgtttttgtttaaagttctaaaaggcctgggcatggtagttcatgcctgtaatcccaacactttgggaggccaaggtggtggaattgcttgagttcaggagttgaagagcagcctggacaacatagtgaaaccttgtctctatttaaaaaaaaaaaagtagccaggcatgtagtgcacacttgtagtcctagctactcaggaggcaaaggtgggaggattgcttaagcccacaagttcagggttgcagtgagctatgatcgcaccactgcagtgcagcctgggcaacagagcaagaccttgtctcaaaaaaaaaaaaagaaattccaaaagggagacactgaaaaatgtgtgttataatatcagcctacattaaattatatgttgatgtatgacctgttcatcttaaggctatttatataacatttctggacacatgttgcttctaaaaaatatccattatcattttgctcatcttaccaggagttaaggaaagataatacagttaatgtaaaacaaaatctattttggttttaaactgtcactgatgttcaaatgtattaagaatttgtaatcaattttgctttgtgatatgtgttttccataaaaggtcattttaactgcaaagttgttatatttaaatctgatttatagaacttttcttttccccataactgaatacaggcatattaatgtcttagagttgtggaaatttaatcatagttatttttcatagaggtacaatccgcttacatgtgatttttctaccttggcaagtactattacgtagtagtagagaaaataaatgcaagacttcagtcaaaaatagtcatacatggcttttcagtagatggtctatagaaaggcctgtattaacctactatgtatttcatgctattaaaagaaatgtcatttcccaaaaaaccacctgttgtaaaaagagtgcattatatagttgtgtggaatgcaatggtgcgatatcagctcaccgcaacctccatctcctgggttcagttctcctgcctcagcttcctgagtggctgggattacaggcgcccaccaccaggcccagctaattttttgtatttgtggtagagactgggtttcaccatgttggtcaggcttgtcttgaactgctgaccttaggtgatccacccgccttggcctctggaggtgctgggattacaggcatcagccaccacgtcctttttttttttttttttttttttaagacagcatcttacttcctctcccagctggacagtggtgcgatctcagctcactgcaacctctgccttccaatttcaagtgattctcctgtctcagcctcccaagtagctgggatcacaggcgtgtgccaccatgcccggctaatttttgtatttttagtagagatagtttccctgtgttggccaggctggtctcgaactcctgacctcaagtaatgtacccgcctcagcctcccaaagtggtgggtttacagtcgtgagccactatgtctggccgcattatatggtatttttttttttaagaacttgagtttagaaaaataaagggtgaaaatagcttaaaatgttgctgaagatagtgtctgagctgcatcctaaatgaaacaatacaggtactaaagcaagttctgccttaatccaggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggtaaaattttaaatgatgttaatcaaatgtatggaattttttcacactcaaaattcagtgaccatgaagaaagtaaaatttaaaacaatattggcaagatacacaaattttattcgtgtcattagagtaattctgtaatttgatttaaatactttttattgaaaattctaagaagcaacatagtacaaattcataattttccatcacctgaaattgcaagttaactttgtcttttttgctacaaatctcatttttctgagagaataaagtattacaagtaaaggcaaagtttctcgtacttacctgtacctatcacctccacagaagtaactactattattaattcaatgcctgtctttcaagttttatatttcacatacacatctgtctaatacatggtattattttatactttaagaataaaaaatttatataaacagtatgctaaatcttatcacttgctttttcttactccattatttttgaaatctaatcctgttaattacatatctgtttattcttcataattaatacatagtggtagcatttaaatatggcatattttctctgttctctattgataggcatttaaattgttcgcagtttttgttaatctgacctcagggcaactttaaagcaaatattttgactatatttttagtagactgtatagtatcttaaaatttgatcatgatgtttaaatattttttaaggatagtatgtgaaataaatgtcctttaaaaattataaatacaacttgatttttgtaaacttttaattaatatgacttgtgattatttattttgatccagattgtttatatctcaataagctttgtctaccagggcaaatctggcagattagttcagaatatgaaattatagtcttttcctttgacagcactatttttagcaaagaggcaaagaataaaatcagctcaaacacaggtaatgcttaaacttcctgcctcttttgcctctacaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtgttgtgtggtctccagaaacatgttgttctgtgtgctttattcttggagttgcaacaagttaaatatttgtatatgaacaccccttttccatttcatcattgaaactcactttgacatttcagtggtataattgaaaatattctgattatggtatggtttttcttctgtttgaggaccatgtttttattgactgttggaatctaaatttataagaggaattaatctgtaaccagataccttattcgtttaaccgatttctattccactactaatggttttttttactttgtgctttctagttcttagattctgagttaacaaagcataaaatagattttatattgctgggggttgtaccaaacatagatacattgacagatccattgatagaagtgttgggagatggacttgaaatcttagtcctaaataaagactgaactgtttaaactaacttgataaaaatcactgttcgtttttgggaacctgcaagtattaaatagattctgtactaactagtattaacactggaaagttagcaagacacatatagatgtcttgaccactttttcacacaagttcagagttcatgtaaaactttagaattgacttcctttctgtctcttcagtaagaaagtaatctaacttaaatttttggtagtagaagttttagaaataacaactgactaattttgctataccatgataaatgtctacaaaaagggatttttttttttttgaaatgaagtttcgctcttgtccccaaagctggagtgcaatggtgtgatctcagctcgctgcaacctccgcctcccaggttcaagcaattctcctgccttagcctcctgagtagctgggattacaggtgtctgccaccaaccctggctaatgtttgtatttttagtagagacggggtttcaccatgttggccaggatggtcttaagctgacctcaggtgatccgcccacctcggccttccaaagtgctgggattacaagcgtgagccaccatgccctgccagggatgttaactaaaatcagtcttttcaaaacctagatcttcaaatgatgatgaatttaagactaggagactggaatattgaagcctattaaaaaatacatatccttgcgttgttaggttaataactatcatggtgacaagtgtataagtattggcttcttttcaaagaaatgttatttttattataaggactgggacgagaagtgacctgtgattggtcgtatttttctgtgaacaagattccttctttacctgagttgtacctaggttttttataactacatcaaaaaagcttttatattgtacttattaatgttatggcagttacttatagaagcttggtactatatggatttttttcatttttaaactttcccttctatgttccaaattttaatttagtaagtcaacctttgctgtacagtagtagtatactgtatggacaaaacaatggtaacaattgtgttattttaaatggcctttttccacatctaaattgttcttactgaaaagctttcgtgggagcattttgaactcacttcatgttcaaagctatgagtcccagataaaggaaaggagaataggtaggaagaagtggttgtcagatgaaagggtaagggagataagcaaaaatgggataaataatgaaacagttttcaagacaaattgcagttaaacaattttggactagtgaggtattaccagtagacttgtttttcaccttttaatgtgcctaaaaccagggttcccgattaatattaggataacatcatcatttattgagtgtttcagagagtaatggtttctccaatgttatttccagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgatactaaaaatctaaactttgtgggttttgtcagtagtgtagcctgtgattacagcaaaagcaaatttttaatgtctcatttgtgtttgagtctgtgctagatgtagttcaaagccagttatatggtgttttgaaagaaatattttaaaaggtggaaatatctagacacttttgatacaatttctttaaaaggcaatggaagggttttatatttgtgtctttgtctctagatttctgactttgattttatgtttgcctgtcttgtcttctgcgattctttcctaaactcagaagctagtctggtcctaagactacagttttctttccttatttcagatgaaaatttaccttttctattgtgggagaggcgtttcagtttttcaaaagggaaatgtaggaaactaaggagaaaataagcataggtataaatgaacagagaacaaattattgactaacctagtattgtttacagagaacaaattattgactaacctagtattgtttacagagaacaaattattgactaatgcagcattgatttggctgatgctttataagacagctattcctagagtcattttccttacccctgctatgtctagctggatgatttgtctagttggttatcttttccatctcctatttgtcactttgtgtgtttgtttgtgacggagttttgctcttgtcacccgggctggagtgcagtggcgtgatcccatctcattgcaacctccaccctgctgggctcaagcgattctcctgcctcagcctcccaagtagctgggattacaggcacatgccaccacgctcagctaatttttgtatttttagtagagacggggtttcaccgtgttggccaggctggtctcaaactcctgacctcaggtgatccacctgcattggcctccgaaagtgctgggattacaggtgtgagccaccgcgcccagcctgtttgtcgttttaaaatcaaatccttagaggaattattcttgattccttaaggcaagtcagtctctctcttcatttgatgtagttgataagttgaatttcagaacgatttgttagaaatgagctttgtgacaagaacatacagagcattgaatgaatgaagactttgttaacatagaaccaaatactggaatacatgttttattgcccttttatgtagtagtcctaacaaatagcttcaggagcatgctgaagaataaggaaataggccgggcgcagtggctcacgcctgtaatcccagcactttgggaggccgaggcgggcggatcacctgaggtccggagttcgagacgagcctgaccaacatggagaaaccctgtctctactaaaaatacaaaattagccaggcatggtggtgcatgcctgtaatcctagctactccggaggctgaggcaggagaatcgcttgaaccttggaggcggaggttgctgtgagccgagatcgcgccattgcactctagcctgggcaacaagagcgaaactctgtctcaaaaataaataaataaataaataaataataaagatggtctaagggataattgagttggaggaatctaaactgaggagcagaataaatagtcaaaggagtgtaggtttagatgacaggcagaattagacagtggctttattgcagaaaatttaaaacatgtagaagagtggagggaagagtttaatgaccctccagtcatagatgtgccacagttgtcagtgttttaccagtttggtttcatcaccccacaccctccagctttttaaattactttttttttttttttttttgagacagaatctcactctgtcgcccaggttggagtgcagtggcacaatctcggctcacttgcaacctccgcctcctgggttcaagcagttctcctgcttcagcctcctgagtagctgggattacaggttcccgccaccatgcccagctagtttttgaattcttagtagagaccaggtttcaccatgttggccaagctggtctcgaactcctgacctcaggtgatccacccgccttggcctcccagattgctgggattacaggcatgagctaccgcacctggcaataaattgcttttgattttttttattttgctttttcctggagtatattaaagcagtctttgacatagtgtttcacacattaaaaagtcagcattttagcatatatctctgaaagataagtgctattccagtgacaatgccaatatcacacctaataaaattaataatttatttgtatctaattcatgtttaaatttctctagtttcagaaatgtttcgtttatgattatgttgttcaaatcaggatccagacaggatccacatatccggtttgatttttggttgttttactctctcaagtctgtagctgttaccactgtaactttttctcttccctccatttatttggtgaagaaaccaggtcattacagaatttcccaacattctggatttgttaggttgcttctttatgtcatttaattagcttctctatacgctgcattttctgtagagtgggttagatctgtagtgaggctatgcagtagacctttctgtgatagaaatttttcatacctgtgctatccgttacagtagccactagctattgaatacttcgatggtgactagtgaggctgagaaactctgttttgctttgttgttgttgttgtttttgtttttgtttgtttgttttttgagatggagtttcattctttttgccaaggttggtgtgatctcagctccccacaacctctgcctcccaagttcaagcgattctcctgcctcagcctcctgagtagctgggattacaggcatgtgccaccacgcccggctaattttgtatttttagtagagacggggtttctccgtgttggtcaggcaggtctcgaactcccgacctcaggtgatccacccgcctcagcctcccaaaatgctgggattacaggcgtgagccactgcgcctggcggaaactatgttttaattttaatttaaattaaatttcaatgaccatatgtggctagtggcctaccatattggacggcacagatccagagggttggtcagatccatgtccagtttctttcacaagaatacttaaatgatatagcggccttcctgttacatcgttttaggaggtatagaatgtctttctggcgatgctaaaattagtaattgatttagattttgaaagattaatccatctgttataaagatccacattgtcctttcatttaatggttctaacagccattgtcatatgattattgcctaggtctattattttgaggttttttttatgtattgaatttatgatcagttacagtcatcattcttttttgatgttcacattgtgccatctgtagccattaggaattactaagttggttcctgtattttttaattccttcccccatttatctttgatagtttcttgttttctggaatagtaagacgtcccaggctcatgtatacttcctgcgtcatgcctggaatcagccatgtttctaaggaaccgtgatccttttaatagataatactatttggaagcaacaatttggatgctgacatgttcattcctactggttgtcattgtttctgggtcttttcagtaggtagtgctaggtaaatcatgaattaatggtgatatttcaaatttataaatacaggctaattttgggttatgttatacttgtatcatttttatcttatgctgaatatcttggttcttcaaatgatgttgttacttatgtaagtatcacaacatatatgtgtttctaaataatacagtattactactaacaataagactgttaaatgcaatttgggcttttgttttccttgtctttaggacatatcccactagaatgtaatgtcaaaacactgtgcttaaagtcacttgaaagaatttttttgtgtcatacagccaccaacttaatagttaggtttttttgttctctaatgctaggattgctttttcttttattattttttaattgtgttgagagtataatgtagttttatgtaggcaaaataaggtagagtcagaattttggcttctgtccttttcccttccatctacagataagcatttttattgttttgatttatattttgtttctttttaaaaatataagtaaatatatagatttttatatgctccccttttacataaaatgcagcctgctttgtacatttccatttttaacctaaacctagagatcactccatatcggaacgtagccatcttcctcattgctttgtacaactgcattttatgtgttgcattttatggatgtactgtaatttatttaaccactctccatttggtgaatatttgagttgttttcagctgtatgttgctatgaataatgccaggatgaaccatggagcagcattttgcatgtgtcactgcatattttttgccagtttatcttggggaagcgtaccagtaaaattgctaggtaatttcaccattacatttctctgcatatgagttgaagcattttgcattcccaccagcagtgtttgaaagtactgttctcaaatggaggaatatgaggcttttttgttttgttttgttttttaataaagttagtacgagtaaccatattggtcatgttttacttaaattgataggccttcaagatggcttttagttatctcaggagctttagaaattatctattcccagacctggagagattctgatttaattggttatggtagttgggggcatttgctttttttttttttttttaaagctctccttgatggtactgtgccacaaggattgagaatctcagattataaaactacctttccgtctattcaaatagttggtaatttgactattaaaaaccacttactctggccaggtgcagtggctcacacctgtaatccccgcactttgggaggcccaggtgggtggatcacctgaggtcaggagaccagcctggccaacatggcaaaaccctgtctctactgaaaatacaaaaaaatcagccaagtgtgctggtgcgtgcctgtaatcccagctactcaggagggtgaggcaggagaatcacttgaacctcgcaggtggaggttgcggtgagtggagattgcaccactgtactccagcctgggcaacagagcgagattctgtctcaaaaaaataaataaaataaaaattaaaaagcagttactctgtgtatgtctgtaatttgtttacaagtttctcttttgacaataattttgcattcagcaaatacttcctaattgataggatgaggaacccagagattcagattgtgacttaaaactcttataatatcaattccaaatatagataaatacaaaaccatgatttatgagactatgtctgtaacttgtggggttttggtagtattacatccagccatttaggcatatttattggatgaccactcctgtcacaggattaaagtttaaaaaaaaaatctgtctttaatagacattgacttggacctaaaaccatcagtaatctaggttaaatattggcgtgaaagcaaaagtgacaacagaaggacactctactataatactgatcattgatggatgttctgtagttaaaagaatttaaaagaatcatctggtaatagcgacttcaaaactgaaaaccttaaactacttggaatgcggaatttcgggccctacagctacagaatcagaatctgcatttaacagaagcttcaagtgattgataggcacattacaatttaagaagaactgatctaatgggttttaaaccagtatgtaagaaatgctggattctttaaaaatgatcagtggaacatagaaattaatctgagactgagaattaatctgaggcagctgttttctgtctttctgtagtgacatggatagcattgagatttgaaagtgacgttaggcttgcatattcattaaagagtgaccacagggtttttgtggctacctaattttgtatctgtttccaagaaaaatttgacacctgagaattttttagttcaaataagctatatgtgggattataatttaaactgattctactaaaatgattataaccatatgaaaataataatgtttatgctaacaattacaaaagtttgtatttttgttttaaaaggaaactgacttataatagatgacttttttctaagtcatgatcagtctgctttttgtttagacagagatgtagctccaatactagagccaaatagcacacagtgagtcaaaaagggaactggtgatagttgatgtgctttttttcccataatgtttataatttgtgagctactataggtggattctttagtgtattttagcactttttaagtgtttcctgatgcctaaatatcagttcaattaatacatttaggaatattttgaggacatagccttgtttgtaaatgctggcatttggagacttctatttcatggcttctcagtgtgccagtatggccgttattaaagtatttgatgttagaatatgactttttaatgtgttgatgcttgaatagagctattctcaagctggaataactgagactgaatggacaagtggatcttcaaaaggcggacctctgcaggcattaactagggaatctacaagagggtcaagaagaactccaaggaaaagggtgatgcaaggcttattccttgggttttcagatttgtagggttttagtattattttatatttattgtttttgttttgttttcaaactaacaggtggaaacttcagaacattttcgtatagatggtccagtaatttcagagagtactcccatagctgaaactataatggcttcaagcaacgaatccttagtaaa

SEQ ID NO: 47 - DNA, 2490 bp, Homo sapiens
gttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctg

SEQ ID NO: 48 - protein, 727 aa, Homo sapiens
GSEAAARSPARSKRAGVSGGGKGCGEGASQIPEMPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEGKKKEHKKVKSTRDIVPFSELGTTPSGGGFFQGISFPEISTRPPLGSTELQAAKKVHTSKGDLPREPLVATNLPGRGQLQKLASERNLFISCKSSHDRCLEKSSSSSSQPEHSAMLVSTAASPSLIKETTTGYYKDIVENICGREKSGIQPLCPERSHISDQSPLSSKRKALEESESSQLISPPLAQAIRDYVNSLLVQGGVGSLPGTSNSMPPLDVENIQKRIDQSKFQETEFLSPPRKVPRLSEKSVEERDSGSFVAFQNIPGSELMSSFAKTVVSHSLTTLGLEVAKQSQHDKIDASELSFPFHESILKVIEEEWQQVDRQLPSLACKYPVSSREATQILSVPKVDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 49 - DNA, 37265 bp, Mus musculus
  misc_feature (1)...(37265): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatagactctgggcatggtggcacacgcctttaatcccagcacttgggaggcagaggcaggcagatttctgagttcgaggccagcctggtctacagagtgagttccagaacagccagggctatacagagaaatcctgtctcaaaaaaaaaaaaaaaaaaagaaagaaagaaaaagaaaaatgcacatagacaaaacacctgtgtgtgtgtgtgtgagagagagagagagagagtgtgtttgtgtgtgctgtgctgtgtatgtctacaaaatttaattataaacataatagtaaaacaatgtagtttgattaaggcctaggagctggttttctagggtatgcaggtctcatatgcctaagagcattaaacacgtagacaatgcaggggaccccagagaaaatgaacctaagcatgccatctctcctccattaggatgtaatcctggaagtttttctccctgcttggctctgagtattcctgacaggtcccacccccctcatccacatgatgttgactggagtggattaaattctctgttgtatcaaggtcacccacactggcagctcattgtaatggacccatggggtcatagccaatccagtagaggggaaatttcttctttttctgaggatgcatgcatctaaggcccagacatgaatgccacaggcaggtgtaccagcgtccccttctggggatgtttattgtcagggcatcatagttaagatcttcctccattattggggcctagggtcgcccacgaaccttcttccctctcttcccttccctttagctaatcgctgcctcccaaattctataattaaaaaaaaaaaaaaggcaagtcttgtaactaaaaagcaggagagcacagccagttcactgtgaagtgaactgtacttcagcacgtagcagcaatacagccctgctagcaccaccacagtgacatcctctgagcacacaatggtgctatgcttatgctctatgcatggctgcctcagactgtggtggcaggagcccaccctcctgagtgcctgggcaaagcactgtcagttttgactctgcactagatatactgcatgggcttcaaagggaatactgaggacagtataggtgatggttcagatcctttgcaaccctgcagccctgccaatatgtggacctaactggcctgatggggcaaaaataatcatcctgtgttgccaaacccagacccaacaccacaaatatgttatgtggtttcttataaggatgttagtgttcaaggatctgaaatgagaactatgatctaaataaccacacaggattactatcttgtaagaaaacagtgggaaaagactatctcccaaggaagaagaagtcgtgtatagtgttataaagagagaaagaaaagctagaacaggagggtttaataagaggcaattaggagagacaggtagaggcatggggtacacccttccacagccctcacctctttcaggctccgttacctgcccctcctattcatcaacatgatattgactggagttgagtctctccgttgtatccaggtcacccttgttggctgcccagggattcctacctgataatgtagagggtccgtttctttcggttatgtaagcacccacagccctggcatgcaggcctagctaaagtaggaagtaaggggagggaccacaaacactaaaggccttttgaaaagctatatggaaatcagctactctagcagcttcctatacatttatgcaagggatccttatggagccaaaaactgacagaggagacaaggctccaactacacatcctgtgccaccaagttacacctccagtaacaggaatgggttgcaacctgttgagtcattaaccaaagggtcctacattaagcctcaactatcagcacaggctagtgccaagagtattgtgtggtctacacaatctgatggttaggactgattctgaaggtaacatttctatcatcacagtgggaaacctttatgaggatttcctgtcaggcatgaatattgcagaacctgaagggacccctctattgtgaccttcatatctctgtgaaaatcattggctcataaactcactagttcttggaaaggaaaggccattggcgggtacatcagacactgctctgggcctgagatggggagcagggaataaaaaaataaaataaaataaaataaaataaaataaaataaaataaaataatcacagggcaaaaccctgctctcctgattgcctatttcctggttgtgaagagtctggtgtttagcaagttctaggacagtgggaggagttagcaaggtagggctgggaaggacccatagggaagaatgtgagcactgagtaatccatgggtcatagagaacagcatcccttgcagaggatgagcaaacgctctgagaacagaacagcccaaggcagctggaggggaggaagaggatgggatagggacacaggaggcaggaggtggccataaagacaaagttgccaatgtgaggcaacttgggtctttcatggaatcttctctggctgttggagacagagtgtgggtgcaatggtcagttactacagttaaatagacagctcccgaattagcaacataaaacatgtagggatagactcatgaattctgtgggtcaggaactggactaggtccagccagaaccttgagatcaaggtcctggtgccagtggggccaaggatgtcttgtggtggcagctgaaggacacgtaccttctcctcacccgggacagctctctgctgggccaatggctctgattccagataagggaaggtagaaccacatcttcccatagctatgctccttcactgtgcttctgtttgtcagcagtaacacaggccctgcctcctcaaggaccacaagaagggacaagtaccagcaggtggagccctggggccacttgaggctgcacaccaaaaacataaaggtaggtgccacagcagtggtccagacctgagaggcagcagctgggggaagcagccagacttttttttttttttaatgctgcaaacaacaggacctcacaaacaatgtgagaagtgtctagctttggcataaagatggggttgtcacaacaggaaatagtaacaacccagtaccaccctgggaatgggttactcccatgcaggagaattaaatggtgagagctctctaaagttctgtctgctgagcagaggctgacagaactcaacagagagacccacatctagctcagtacccaaccctaaccaaaagcaactctcctgtcagtaaataaggaaagctctacttggggcaggctgccagtgcctgagctcctgtccagccctaaccaatcaaacctcccactagttgctttagggaagaggactcctaatggggctttaaggagacagacaatagccccactccagctgttggctggggtaactgtacaaagggctcgaggttgagctgagattggattacctgcctgtttattcatgcacacacatttatcctcagccacccagggtagagaggggatttagctacagcccatgaatgcaaagaagaagagtttatgtgggaatcatacagatgacaggaattcatctctgtccgtttctacctcttctgtgacctccctttcaaagccagtctgctcagggtccagaaaacagactctagctccatgagaaactgaatcatacatagctttcccctccaggggagagatttaaggcagttttggcagaatcctttcttcctcaagggatgcctccttagggaaggggaatcctggcacaaccccacataagatggtaatataccaagcccccttctggccctggaccaggttcccctcctgaggacgagataccagacctttacaggtctgcaaggcctccgtgtctattttcccacattaccttctcagactggcatagccaggtatctgccactgcttgaaatgaactggtaagcggactctctgcaccaacttgtgttctcactctagaaacttccagaagtccaggcctggaaggtcccctggggaagaagggaagaagacagcgtccaagcagaaggatgcacaggcaggaggctcatgatgggcatggaggtggcaggcctgtcttgtccattcagtcatgggtctgggttagcgctctcccctaggtagggtcatggagggacagaaaacgtgtcctgaccagactgagatgggcttggggtcctaaggagaatgtgggtgcttagcaatctaccctagatggagtgtggattcaggtggctgggaacagatcaagctgaggccattttgctgtgttatggccagaggttctatgcagctctgtccaatgctcctcctagcagtcctggatagcaacacccccaaaaggactccacagaagtgagggtgccctgatggtctcactaggatgcaactcagtggtccctcaccctcaccccgtccctgaccctgagcaagctgtaaacaaatggcgatgtgtggacatctcaccaccagtcattccattagggcttcttgagctaacagatggccaaggagtgggtgagtgggcggtggtggcccatgcctttaatcccagcacttgggaggcagaggcaggcgaatttctgagttcgaggccagcctggtttacagagtgagttccaggacagccagggctacacagagaaaccctgtctcgaaaaaaactaaaaaaaaaaaaaaaaaaaaaaaaaaagaatcttttagccgggcagtgttggcacacgcctttgatcccagcacttgggaggggtcagcctggtctacaaagtgagttgcaggacagccagggctatacagagaaaccctgtctcgaaaaaccaaaaaaattgggggggggagggtatgggggacttttgggatagcattggaaatgtaaatgaggaaaataactaataaaaaaataaataaaatctttttttaaaagttaaaaggaaaaaaaaaaaaaaaaaaagagtgggtaagtgcttgtagtccttcctcctgagaactgttctagggaagacacagaacggcccagggtcctgaggctgccattcagatgactcttgtcaacactttaatgtgtgtcactacagtgccatagtgtaacattgagcaagtggcctaacttggcacctgatttccatggtacccactcccctggcaactcagcagggactcaggacccaggtggcccggggtctgactgatagggctacaaggaatcctgtttggggtggggaggggcgggcacggagggaggctggtttgggggaaggttggtgagaggaattagcacagcgcagggcgggaaggggctgggactgagggcaggaggggcggcggagaagggctggtgcagaggcggagatgagtcttaggcaggggtggagccaagtaccttcgcagtttccaggatgctgaggcagaagaagattgacattgaggccagcccgagctacgtggtaagactgtctgaaattgaggaggaggaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctgaaagggcatgggaagtcttgagttctagaccagcacctgcctagaaccagtcaatgacaggtgacagtgatcacaggtcaaaacctgttccatccgactctgatggctttgcttcagcccctggaacccaccctactccagctctggacacagcaatggcatgcatgcacacatccacacacatatggggaggagagagagggaggaaggaagggagggagggagggagggagggaggaagagagagagagagagagagagagagagagagagagagagagagagatgcttttcttaccattctcaaatcccagaacccaaaggtgactcgagggctcttgggccaacaaaaggacatgtgaaaaatgtgaacagcatggagaatggagagcgggctatcttaccaattgtggcagatggtcaccagtcagctgggtgtggggcctatctaaatgtttaatctttattgtttgaattgatgcataaattgattaattgattcattggtagtgtgcacatgccacaggttagaggatacttttcaggactctctcaaaaaatccaggctttgctacaagcatctttgcccactgagccatctcaccggccctgaagctagtatttagctatgtatggttgccatcagaacccggcatcatttggggcagagctgcagtagatggttcaagtaagaagtggggcagcctcagtctgggatggacctggatttgattcccaccacaggaaaatgcccaaactgaggtgtctggggtccaaggctgcaggggcatgtactggagatgaagggcacttagctttctggttgtgcccaggccagtggtcccacttccttggaggtgcttctggggcagggagagagatggctcagtagtcctgaggatcatcatgctgccatgtgaccctgaacaagaaacggagcccaggccggggagttaagtctctcgaagttgtcatatgggagtggagtggacatgtggctcttgcttaatgctgggcagcctggcttcatcaccagcacacagcctgaataaataaatggcatgtcacatgaatggatagaccagagttgctatatgacctccaaagcaactcctagccatgttccttgattcctttgtttgtaaaatgaggctcaatattaaatgtcacctcattcacagcctcggaggggttctccaaagagccatgtatgcagtaggtacttaataaaagctatcccctctttccctcccagtctcccgagagacttgacaggtgcagagatcaaggagcttctcctgtcactttaaaatatgcaaatagcctgcggatgaatttccaggctcagccaaccagtgcagggtttatgaagcaccgcggggcggagctcctcctgaccacacccatggcggggccagcggcgcgctccgcagcgcgcggggagggcggggcgcgggtctggagcgcgcaggtagcgccgcgagaggcggtgagtgtccccggcgcggggctccggtgcggggtgcggggtgcaggacgcgggggcggggtgcggggcggggacgcagcctccatcctgacccggcccgagcgcaggtgccgtctgcagaaggcggggcgccactctatggcatctctcaatcctgggctgggaggctgagaccccccccaggacccccaatccctcttccgggtctctagcctggccctaagctgggggccgcctccctcgctgcccctcttcctcgcctgggaacgagggtctcctcctttcctttgcacccgctctagggttggtaggctggtgggggttctgtagggcgagtgtggtggaattgcggggtatctggagtatggagcgcgggatcccctcccgggggaacggggcctggagaggcctggagcctgcaccagggactcccgcgccctgttaggggggcagccggcatctgctccaagggacagaattagtctaggtgaatgaggatggggtgcagagaaggtcggggatggccgcccctccacttgccctcagcgtcgcaggacctgcttcatggtgaccttgggcaggtgacagcacctccctgatccttagtctcctcctcagaatatagaggttgaggaagccagactatctgtctcaaattcccaacacctgtgccccatttctccagatggggaccacaatctttagtcaaatgttagggcactctggttttggcactttaaaaggggttgagcctggtgtggtcattacaatcctctggtggctgaggctggaagatctgcagcttgaggccagcctgggctacattcacagactctgcctcattaaaaaagcataaacaaaacaaaccatgattttgattgatggatacagtctagcctggggcggagcagcgagacctaaggccagcagaggacagtttctatctgaccataagatggacgggcctccaatcaagacccagactttgtcactgtggtcccacccatgtggctgcccaggtcacaccctgacccacataccatcacctacaatagggttcctaggctggttcctgggcggggtcccaagtggaaggtcaggtcttagtccctgcctcttgcaggatagtagggtgagtcccaggcaggaagcctgacacccccaaatttgtgtgcccagactggacttaaactgagccttctgtgaagtggactgaaagtctgtaggaagatcagaggtggttgtgggagtgacagcgcgccgtaaacacccactcctatgatagtaattatgatattgcattcattaaatggggtcacagccaaggaggcagtgagatgtctttgaagggtgtgaccagtgtcactagcaccccaaggacttgggtacacagtggtgctcaaagtatgtgtgacaaatgaaatgactcagtggaaggcttgcacagtggcctcagtttccctgtagatttctggctggtgtgggaggggaggcagtgagggtcacactagggatcaatggctgtgggcacagccagcctgtatccaacccccagagtgcagctctggtctagtcttgcctggctcagttccctggtgctgttcacccacctaagcctcaggttttggggactcggtgtcaggagatggggtgcttgctctgtgcctctgagcagtgtctgtccctggaccttattctagtattgtagagcccagaaagccccaggttacattaggtaaactgtcttaggctaaaacattttcagaggcctctattggtgttttaacttctttccaaatcacacggtttaaaaacacaaaacgaaaccccaagaacaaggggctgagagacgccttgtagtacttaatatttacaccacaccatcaccctagcacccagaggaggagacaggaggatcaaaaatgtgaggccatcctctgctacatagtgaattttgaggccagcctcagctacttgaaaccatttctaaaaacaaactttaatctgnnnnnnnnnnnnnnnnnnnnttaatctgttgatcctaaagtaattgtaagaatatttgagtttccctttctgagggtgaggcttcacctgtcttcaagcctcggtttccactcatgggcatactgacctagcgcaggccaaggtagacacttgtggctgtctgtctctctggtaatgatcatgtcgcctccagtctgctccctcacctcccccatttgtgtggctgccctgtgactatggggaggtcccagggatgctgggcggggaggtgacggttgggtggcaggcagggcgggccaggcttcctgtcctcccccagacacagaggcctccagttagtgctggcggaagtgtcaggggtcatagcctcccggtgcctaccccatccttcaggggccccaactctcagtgcccatcggtgagtttgaccccaatctttgtctcctcagagcaggaagttatcccacagccgtggctccgggtctggggccaacggtcggtctgtcacttcctggccaggtggcagcctctgggcctatccttggccctactcttcaggcgggaggccctgatctgggtgcaggttgtggcccatcaagggctgctgggtagagccagatgggtggtcatggccctgatagctggtatctagccaggtggggtagggaacagcatgaagtatgccccctaagagtggcttttatgttagggtggcgggaagcagggtgctgtctaacatgagctctggggacattgatggcttccgggagactgttgcccaagatgacgaagacaactgtcatctacccagcgtggcccccaggcatgtgtgcaggagggcttggttcacaggggacatggattttacttatataaagatcaagctgccacattggtgtagggtcctggtccctcgggacactttagggggttcagataggctgcctggtcctagctagacaccaggataagcagggaaaggtgggtgtaatgctccaacctgtcaccccaatacttgggagactgaggcaggaggatgaccctgagttagcagtcagcctgggatacagggtatggctctgcttaaaaaaataatcaaacaaaaacctcccaatatggacatttgctgttttccaccctagagtatcagccagtcttacacaagagaggcatggtccaagccaaggctggagggtgtccattggaaaatgaaatcatcatttgcccaatgcactcataatctgctgaaggaccccagctgccagatccctcctgttggacctaaaatccccagcatccttcctgtatctgggacacattgcctctctaggctggcccaggggagcctgtgcccaggtcccctgctccccatcagctccagtcaggtgcagtgacatgcagttgagtccctgcagaggctgaggcaggaggacccagaattctagaccaggttgggctacagagaaaaaaaggggggcagctaatttcaatgttaggtaaactgaagctaagggttaagtgagtaccctcccagtggggcccgggtggtccggtcctgtggtcctgtggtcaactgccccgtctcatctgtcgctgggcctcctgggctccagctgtcaccacacagcccagcagctcatgaagtatggatgagaacagacaggctcctatgacagcgagcctccctgtgcccaggattctacacatccttctgctgctgcttggccccacccctatacaaagtgacctgaagtctctagctaaaccttctctgggtgttctgtctcctacagatggagaaactgaggcacagagctgagtgaattggagccaggtgagcagtggcctctgagcagtggttggtattcctggggcccctgatgtgggaactgaccgtgatgcccaaggggaccctgccctcccaggctcatcatgctgagactgttcccacagaaaccaccccattgtttcagtcgcaaaatccactgtcccttcctgccatttgaccttggcaagtagcttctccttttggggtgtaactcagtttccctacatctgaaatggcccagaaccatcgtctataattcagttcatccaataccactctggccccacaaatccatgctttaaaaccccacctgctccctcccctccagctcctgtccccttccccctgtcccatcccagccccatgtgttcctgttgcctagggctacaggactaaggctggacttgctcctgatctgggctttcactcccttagtccctgtaacagggaaggtgtttggagtttccctactcaggcccttagttatggcccaagccctccaccctacctctcttttcagacagacgcaggacagaggccaccaggatgtcctattttggggaacatttttgggtaagacctgctgtttcttctgttttgttctttgctatcatttctgtgggagctcacaaagggatagaaggacttttatggtcaaggggagactaggcagatgaaagacagaggttaaatcacggattgccttgaccctaagcaaggaacagattaatgcactgagaactcagcccagagcagcatgtgtgttctgagaatcacacagtacagcagtacaaagctgggtgtgggggtacacacctgggattgcggactgaggaaggctgaggcagaagaatggcagcttcaaacctgcctgagctgcagaggaacatgtttccacagataacatgtcagcgtaacctggcctcgaacctggggtcaaatcaaatttcccagatcaaggccaacccagccagggaaattccgtgtttatttccatcttgggaatttggggtttttttaaggagtaaattgactccctcctgacctctgcacccttggccatctaggtcctgctgcaaaccaggtctgggaatgagagactctcacaaagctgcatctgagctctgagagagccacttccattcttggggacctagagagccaacctgatcctgcagctcagtccatctcagtgcaacctacagcccagtttgttgcagccccgaaggctacttttcaggatgtgcaaatgccattacaacatcaggaaatatcctgaatctatctgagaggtgtgacactgggtggcagtcaaggaccgaggtctcctccgggttggtctggccagggaactggagagccaccaaggatgtaggagcagcatggagtcagagagacaccaggctcaaaagccccttcctccttggtaggcccacagcttgcaaagtggtagctggttgctaagcaacccgttgcccctagcaacaatccccactccctccccagctggagctcttcttaacttgcctctgctttcttaaagggcccaccatcccttgccacctgcagggctcaggcttctccctaagactcatattctcccatggcctctgaatggctgagtgtccccctggaggtgtcgtcctctggtctacatggaacctctgtcctgcagcagcagcccaagagacacccacatttaggaggggtggcagtagcacctcagtggattgtcagtgttttatattccacgaggtgtgaaaaacgggggggcgggggagaggagaagtcaatgagcaaagagaaaatagaagccaccccaacttccctcccatgcataccccaagatagcatggctgaaaggggctcagaccgttgattcaggatcccactggctcagaggttctccctaggaaggggctggccaaccagcctcagtgtgcctaggacaggaaatgaatgaaagttgcatctttgcacataggtctgtggctgatatataggaatccttttctgattttgctctgctggggatagaactcagggcctcacatgtaataggtaggggctctacccctgagccacacccccagcccctcactggaggattctaggcaggggttccactcatgagccacatgcccagctcctcactgagagcccaatgctgactggtattggtgttccccagttcctttgaggtaagtccaggtcaaaagcctagagagcactgaggagctacggcagatgtgtaagcagtagatatcaaaccgtgttagaatgtcctttggctgtcacccaggagttgtgatcagagacacaggccctagaagtccctcctcagacccttgctgcctgcccactctgtggagacagaaagtgccgagggcttgccaggtctgggaactgggccagtgggtggctctgtgttagccccagataatgccctgggcggcagtgcctggtgcagcctcacccaggatccccagcagcagcaggtgggctcagtgggagctgtgtgtggagccctcattattacccagaaggcctgtgtgtctagcagagtgccagacacatctcactcataaagccattgtgtggcagctgctaccatcatcgcctctatttttctcacacgacagaattaaggctcagagaggtgcagccactgccccaagtggcccattgcacttcagttggaagagagaaaatagggagtggaggaacagaccatgaccctgtcgggaggctggagctctgcgtagctatggagctgtggaatggtctgtagggaagctggggcggagtgggctgggggaggcagaaataccctaaggacttttggggcagctaatggacagtaggagctactgattacaatgactctaaagtgaggaatggtgggctgtggctgggacatttgggcctgaggttgacatgggtttgtccctctcttggctttggtaggaaaagtgcttgtcattgctgtggctgggacatttgggcctgaggctgacatgggtttgtccctctcttggctttggtaggaaaagtgcttgttattgcaagcatcaggatttcatttttagaccccagcagccaagttaaaagctggcgataaccccaggactggggagttggagggagacggatctctggggctttaattacgggtttctggttcagtaagagactctgactcagaaaatgagatggaggacgatggaggaagacacattaagtggacctctggccacacagagacccaggaagtggaggtctcaaggatgcttccctcaagccagtggggaaatgcagcctgctgattggttaggtctctcctccatctctacagtcatttggctccttggtctccaaggctggtctgtgttgctaggcaacctaaatgcccttctctgacttctacatctcctctcatcccttacagggcgacaaaaaccatggctttgaggtcctctaccattgtgtgaagcagggtcctgtggccaccaaggagctggctgacttcattagggaaaggtgagccacacccactcggagactgggtgctgggacacgcccaccagagctctccctcaaagcaccttccctgggactccaggaagggtcaagggggcagatcttctggggttctgggaatcaaatgacctgttcatcccagttcctccaatcccgcaggcccacttctgccttgagatgcctttgtttatctttattttactttctattttgatcttatctgtgtagagggtctgtgtgcatggggcatgtgatgggcagaggacctggttctctgcttccatcgtgtgtgttctggggtttgaactcatgtcactgggcttggctgcaagcaccttcatccattgagccattgcactgggctgcatgccccttttaaatcatgccccaggggtctgatgtctcctctactgaaatgaagatcactactcatagggagagttatgattctgagtgctagcatcagaagtgaaaatatatatattgctggcactgggggtagttgaagccagagaattaccatgagtttgaggcccatctaggccacacacatggccagttcctgtgtcaaagtaaaataaaataaacaacaacaaaaaacagctaaataaaataaaaatattacctaaggaaatacaaaattacccaaaggaaataattatccagtcaacttggaactcttttttgagagcaagctgtagagatgggaaaactgaggcaggaaaatgcctttctcagggtactgtaatctgctctttgccccttctctgacccagggccaacatcgaggagacatactcgaaggccatggccaaactctccaagctagccagcaacgggacccccatggggtaagtgcagctggatgggtgagggacactcaagtgaccttggcctgggaccagatggacacaactgccaagtaccatatcagcaatgacggcagtgttgtgtgtgaggggcccctggggtatcagatgagctggactctgcctgtccccaggacctttgccccgctctgggaggtcttccgtgtgtcctcggacaaactggcactgtgccacctggagcttactcggaagctgcacgatctccttaaggatgtgctgcgctacggcgaggagcagctcaagacccacaagaaggtaatgggctgccccagcaggtatgcagggtcattggggctcccgggaccccagatgagcttgtgtacacatctgtaacttagtgtgtatggatgggcccagaagagcatgcatgagagccacaacccagcctctccgggggttggggggaaatcctaggcagggttccacccccaagccacactccttccctgcttgcctcctcatcccaccacagtgtaaggaggaagttctaggcactgtggatgcagtgcagatgttgtcaggcgtcgggcagctcctgccaaagtctcgcgagaattacttgagccgctgtatggacctggagagactgcgtagagagaacaccagccagaaggagatggacaaggtttgttggtctcgtgaccagagagagagagcaagcatgccacaaagtgataggcactacactggcagggtggtaaagccacctgactgtcccccatctatggtttctaggcagaaaccaaaagcaagaaggctgccgacagcctgcggcgctctgtggataaatacaactcagcccgagccgactttgagatcaagatgcttgattcagccctggtgagaagcccgctccgctctgtagatctcacagtccctgctggggctccccatccttggaggagctgtctctcagctgtaggagctttagagtcatgggctgggaagccaagctatggctatggtaacacacacctgttacctagcagttaggactcaaggcaagaggatcaggcgttcaagattttatatatatatatacatacatacacacatacacatatgtatgtatacatatatatacacacacatatatatacatatatatatttcaaatgtgtatatacgtgtgtgtgtatgtgtgagtgtgaatttaaggttagcctgggcattctgagaaagaaagtagaagtccttgtttaaacggattatatatatgggtttactaaagtgaaaacatccttgatcaatgagtgcagtggcatcaggctggatccaggcattccaatggtgtcattagttaagatgtcatctctgccattggtcactgctttctaggaactcctagcctgacagaggatgtactgggaggtttgtgtgtgtgaagtgtagaatatctctaatccagcacggtgatttttcttttcgtgagacaggtctcactatgtagaccaggctgttccatgaactcataaagactgtgacttgcatcaaaaatgctaagcttctctaagccaggcagagcagacaggagctgggctgactggattggttagcttggtcacatgcccctcccacctcagcgttttcaggccatggaggaggcacatctgcagcacatgaaggccttgctgggctcctatgcgcactctgtggaggacacccatgtgcaaattgggcaggtgagaacgggccacaaatgtaagctgggcaagcgagaggctccgccctcatgtcacaccaccggggcctcaccccctcatcccccgcccctcacactttcccctacccaggtgcatgaggaatttaagcagaatgtggaaaatgtgacggtggacatgctcctcaggaaatttgcagagagcaagggcaccgggcgcgagaagcctggtgagtgacatcaggacttctctgatcctcagtttcttctttacaaaaatagggtagtgcagttctaggtcccccagaaggcgcctgattgctgctctcacatattggcttcctagacctgattcccaaggggggttatgaaaggtcagctcagaggtttggctgtttcttgccgcctccatagtgtaagaaagccattgaaggcactgggcacaaacgtctttgttgagagttttatagccaggttgggcttacgtcctttctcattccttgctgtgtgaccttagtcgcatgtcctgactcacctgagccagttcctctttgctgcagtggagatcacaaccccctccctgctggcacgctgtatcccctggtccaggtggccaggaaagccaagcgctccttgctgtctttacattgtcagccccaggtctgccatgcctaggtcccttctcacccctccatggcttccattgtggagtctgggtgctgccgtccttagcagacctggttctacccctcagacatctcccatctccccctaccccagggcctctggacttcgatgcatacagctcagctgccctgcaggaaggcaagtacgtctgggcctggatgcccaggctagacccagggtgtgggagggggaactgaatagagagggaaagaaccgtccagagttcagctacccccttctgtcaatagcaatgaaacgtctccgtggagccaaggctttccgccttccaggattgagccgtcgggagccacgtgcatctgtgtgaggaagtgctccactcttgcccaggctaccccaaaaatggaagtcccctatatgactctgacccagtatcatctctgcctgggttactccagaaaaacctgtcccaggctagcccaataatgccattcttcaggctgatctagaattcttcctctaacccaggctgggccaaaagctgcttggcccattgtagccttaggctggccatgatcccttgcattgtcaagtctagctcccacctgttctactgtttgaggctatctctgactcagctccctctagatgtccgctacagtctcaaagaagccccaaggcccccactttataggctagcttgaaataatacgatagagcaccctgtaggggctctggtcactcacccctgttcctttgtccccagtgatttcctggagtctgactcaggggtgagtactggtggggaggggcagcaggtggatgggattggtcttcaaggcccagaaggaggggcccagtgcggggctcagaatcaaatctcacctctgtggcccccatgtgaagaactgagaactctgctgtgcctcagttttctcccttggatttgcctacattcctggaatatattctgggtcctgagtgggcaagatgaagcctgacccccacctctccccaggtgcctccagaggtagatgacgaaggcttcactgtgcgccccgatatatctcagaacaatatcctttttggcgactctgtgtacctgagagggctgggtataggcacctgtcctgtgtgcttcaggatggtaaagatatggaggctgagagccggcagtggtggtgtgtcccttaatctagcataggagacagaggcaggcagatttctgaatgtgatcccagtctgtgagttccaggccaaccagggctatgtagagagattctatttcaaaataaagacagacaggcaagacagatggacttttctgggggaaaatccagggcagcatcctggaggaagggcaccagtgttgtggtttagtggttgggcatactgtacaggacctctgggtgggaggaatgtggtcagattcagggttggttccttgacagcaacccacatggggctgagcccccacgcttctcctctagtgactctgattttgacgatgaggagcctagaaagttctatgttcacatcaagcccgcccccacccgcgccgtggcctgcagctctgaggctgcagctgcccagctcagggccacggctggcagcctcatcctccctccaggcccaggggtgaggtggggttgttaacgtgtgggcacgggggtacaactggatgcagctgcgcctagtgttgcttgattcttgattttgttccgcagggcaccatgaaacgtcattcatcacgtgagtagctggctgggtttggaagtgccttggagggaactgagtaattccttgaatggctgtgagttagagttagttggaaatggctgctgagctgctcgccttttctacagagcagcatcattacacaacgggaactggactggcagcagggccagacctagagccaagcgggactcaggagcaggggcaggggcaggggcagaggcaggatttttcagctagcctgggccacacagatgcacggagctaccgccagctcagtccctctgctgaccttgggcctgtggctgacaaatgccagctatggtcctagtgggacagaaactcaaggctttgtccatcctaggggacacttctgggaagccacagagacctcgttcggccccacgcactggcaggtgggtctcaccgggacatgatggagcaggcagatgggccccaagtccttgcctctagctccctcaccctggcctaaggtccagctattggacacttattaagtgccagctgtgtacttgtgctgtgctggctctgggaagcctgtagacaagggtcaaaattctggatgcgcggatgagtgggatgtggccatgctgcataggcagggtcctgggggaagatgtaactactgaacccgaaaggcctaggatttgcgggtgaagtcacgcgctgggaacaggaacagcctgtgggaaggtagcaagctcgaactcgctcctgtcgctgttcccagttgcgcagagaagcccctggcctcggaggagccactgtccaagagcctctttgggccgccgctggagtccgccttcgaccacgatgacttcacaggtagagggggtgtgcacagcaggaggggcagaaggccatattgggtggggatttggttggaatgggagtcatggaggctcgactagggggcagggacagagtggagggtctgcggacattggcggtgacaactaggcatggactacggtgacctctgactgtgccctccttcctaggctccagcagcctgggcttcacatccagcccgtctcctttctcatcctcatctccggagaatgtggaggactcgggcctggattctccgtcacatgctgcccctggtccgtcacctgagtcctgggtcccccggccaggcaccccgcagagcccacccacctgcagggcacagcaccctgagcccaggggcctaatgccccgtgcaccctcaccaggtccctgggggcctgagggaggtgcaggtaagctggaacccagcaggtgtcccaggcaagctgggcacagatggaggccttcatagggggtaccatctgatgaccaagcaaaggccctgaggcaggagggggatgttaagttggtccccatgaggagggggtgagcttaaacacctgtgctggagaaagtgcgggtggatcctgtggccaccaatggatggagatgtcattgaagcaggaagccaactcaggcagctagctggcatgcaagggaaagaatctggttcctgacagagctaagggggtgggacatcagagttaccgacagaggcacagctgatgtgggggactctgtcactctgaagatgtaggctactgaatcaccagatctgtggcttacccacctcctaacccatcagtccttcctgatacagacccagtaacagcaccctcccttacccatctgagcacatctggggcctagggtattagccagaaacccttgaaacattgtctcttcttgagggttaatactcccaactcctgggagtctcagtccagccgtgtccttcctctagattcactgacgccggctgaccccaccagggagggcctagctgccacactgagaagaccacggtccaggaaagtgtcctgcccactcaccaggagcaatggggacctggtgggtgataggctgatgactccaggttgggaagaggccagaagctgcccctgcagacagctttgggtagctcacagccccattctctcttgtcttccagtgccggtcgctcagcccatccccactgggatcctctgcccccaccatcccccccgatcggcctagcttctccacccagatgggacatggtttgtggggaaccttggagcctcgggccccttctctgtctgggatggtgtctgagtgggtgaggcctgccctgcttctgaccctaaccttcccacaggcatctgcccgtggccccagcccagtggtcctgggatctcaggacaccctgcccgtggccacagccttcactggagtatgtccatgcctatttccgtggccacagccccaggtaggcagtgatggcaagtgtggggtcaaccagtagggcttttgtgtgaggctagcaatcctgaggccattctaaggagtccatgggcactgagccaaagggacttgtagtagaaacaggtcaagggtgaactgggggctctgaagctggcttgccctccctggggttgccatatgcaagaggagacattagcattaagccacaaagaagagtagagtgttagactctacacccaacctagggatgctcagaacacccagttgattctaggttgggactcctagtggcccaggagaagaggatctagggatggtactttcattagtacttaaatgtaggctgggttggagaaattcatcttgccaggcagggaaggaagagtaagaagttggggagacaatgctgagaataatcagagccccacaggagctttggctgcaagtataaccaggagggtccagtgccaagcggagccctgatcccatactgtccctggtttcctagttgcctggctcgagtcaccggggagttaaccatgaccttccctgcgggcattgtgcgtgtgttcagtggcaccccaccaccacctgtcctcagcttccggctggtgaacacggcccctgtagaacacttccagcccaacgctgacctgatcttcaggtgccttgcatgggccgtgggagagggtcccagatgtcagtggagccaggggcccagggccttaaatgcctatagcgccccctgctagttgctgtgtggcatggggcaagtggctgttcctctctggacctactactgcacccacagcagcccagtctggaatgggagagcgtctcccgaggggtgaggatattctgtccctgtctctacagtgacccctcccagagtgacccggagaccaaagacttctggctgaatatggcggcgctgacggaggccctacagcaccaggctgagcagaaccccaccgcctcctactacaacctggtgctattgcggtaccaggtggggctgtgcgggggcggggcgagggcgggttacataaataatgcaaataatagatagtgctgtgtcctctgagctctcctgctctctgctggccactcgcggtactgcgtatgatactggtggttgcacattgcttggactaggctgggggcagcatagcccttgtgaccggccgtggctatgtcgcccagccacctctgtcttttcgttcctaagttctcccgccctggacctgagtcagtgcccctgcaaatgagcgcccactggcagtgcgggcccacactcacgcgggtctcggtggagtacagctaccgtgcgggcgccactgctgtgtccacgccactcactaatgtccagatcctcctgcccgtgggggagccggtgaccagtgtgcggctgcagcctgcggccacctggtaagccaccctgcccagctgggaacatacaagccagccaacaagagccctgggatagctgtgccacgacacacccctgcacgggtggggagactgaggcttggctgggcatgggtttgcaaaggctacacagttaactgactgccagagacctctctgtcgagtctgacccagattccttgccaccaggaacacagaggaaaagaggttcacgtggaagcttccagatgtgtgtgaggcagggggtgagtcacagctctgatgagggctgctgcgtgggagaaatcgcgggtgggcagattgttaaaactggacatagttcgtgggaactgacgaattctagaggagggttctcaggatacaggaccacctgtatcctgagcctgtgacaaagagcctgtgacaggagcacatcctggacccgtggtctaggcaaggggtatgcgaggtctgatttagtcgaggctgacccctcaccccgtaggctcaggccacctgtcagccagttggcagccgcagtcggggcccagcactcccagccccgtggccgcacaattcaccagtgagggcgccacgctgtctggcctggacctggagctgctaggtggtggctaccgcatgtccctggtgaagcggagattcgctacaggtagttgctgccctttggggctggagaagcagggtggggtgggtagtcgggagggggagctcatgcaagcccccacgctgttttatccccacagggatgtaccttgtcagctgctgaggttcctagtgctggggaccgcctgctctcctgcctctgccggctcccccaggctggactccgtggacaggaacacccatttcagcctggctcagccaactcctccgtccacaagcaggccctggcctttagtattctttaaataaacagttttctaacaaaataaagaggaatcctctttccggttcagaccgggaaggatggggaggggggaaggaggagctgatacctactgtgcggttcatctccagggctgtgtgagctgcctattcctgctgacacacagctaggctacagggagggagaagtagatgaacccctagaacactgcttctccaccctcctaacgctgagaccctttaatatacttactcatgttgtggtgaccccccaaccataaaattatttcatttctacttcatagctgtgatttttgccgctgttgtcaatcataatgtaaatatctgatatgcaggatatcttatatttgagccctccaaaggggtagaagtaaactgctacctagagggttctgaagtatacataggagtgtataaactagagaaggacgggcacctgagggagagctgggcttggtgaggaagccagcagtcaactcagggacagacagggtgggaagcaggataaagttcctgatagtctaggctcagcagctgaaaggccggacctgattgtcctcccagcactcagagtcaagggaccttgcgccctcttttggcctccaagggcactgcactcatgtggatgtaggaagaagatacatgaatgaaagtagaactagttttaacaaacaaaacatttcttgcgagccatagtaaccagaaggatgtgagtgcaactcgggtttatctgcgactggctggtcaaggttctgtggggaggccgagcacttgacatatgcacgagaagactgggtgtgatccacgtcagtactccagcttcctagcttctactggagaaccagcaggtcatgaacctcaaaggacctcagggacctcggttcaaccttacggctctgaagatccctgaccaagactggactgcagatccataacctagaagctgggagtgtagctgaggggcaggggcggggaggggtggagtggaaggaggactactcctacccagaatcccccccccccctcgtgagggtcgggaggctcaggtggaacactgcctagtgttataaataagaaaaaggaaggctatgccttgaaaccctcttgttctctggccttcccatcttcctctgctaagatggggtctgagttgccctggactatctcatatattgttccatgcctcaacttcccatttgtaaggtcccctcctcagtctctggaaagtggggtctctgcagggggatcccagcaggtaccaccagacctgtctttccacccttctcatctgtgtttgtagattggtggctggaccctgttgatggccctacagacactacgtggtaggtcaccatcagcattccccccccaccccatgcctgggggtcaccatcagcagcctgcagcacaggtttgcacgtgtttcccagctgtgatggtttgtatgtgcttggtccagagagtggcactattggaagcagttgtggagtagttgtgtcactgtgagtatgggatttaagacccccatcctagctacctggaagccagtatctgctagcagccttcagatgaagatgtagaactcttagctcagcctgcaccatgctgccatgttcccaacttaatgataatggactaaacctctgaacctgtaagccagccacaattaaatgttgtcttataagagttgccttggccatggtgtctgttcaaagcaataaaaccctaactaagacagaagttggtaccagggactagggtattgctgtgataggcctgaccatgcttttgtttggaaaaatatggatttgggaactttagatctggaaagcagtggaaaatgctttaaatagggcttagtgggatatcctagtaggaatatggaagactttgttactgagagtgatttgaattgtgcagacctggcccaagaggtttcagtggagaatttgaatgtgtggcctagagaccattgtatgtgtgtgtgtgtgtgtgtgtgtgtgtgtgtgtgtgtgttatcccaggtagcataaaaacaagcagatctctgacttcaaggccagcctgaaacagtagcaagttctaggtgaagaaaagcttaaatccaggcatggtggtacacacctttaatcccagggcacaaccaagcagatttctgagttcaagttcaatgtccagagcaagatccgggacagccaagcttaggcagtgaaggagttggaaaagaggaagctagtgataatgtaatagaacaaggaagccatgttagttaaagctcctacaagcagcagaacttggaaacttcagctctggctttatagtcaagagagggagactactggtactattgatgctggttagctgaagctaagaaattagtggtgattaagaagagaccagcgggggctggtgagatggctcagtgggtaagagcacccgactgctgttccgaaggtccggagttcaaatcccagcaaccacatggtggctcacaaccatctataacaaaatctgacaccctcttctggagtgtctgaagacagctacagtgtacttacatataataaataaataaatctttaaaaaaaaaaagaagaagaagagaccagcggggctggcgagatggctcagcaggtaagagcactgactgctcttccaaaggtcctgagttcaaatcccagcaaccacatggtggctcacaaccacccttaatgagacctgataccctcttctggtgtgtctgaagacagctacagtgtacttacatataataaataaacaaatcattaaagaaagaaggaggaggagaagaagaaggagaaggagaaggagaaggagaaggagaagaagaaggagaagaagaaggagaagaagaaggagaagaagaaggagaagaagaaggagaagaagaaggagaagaagaaggagaagaagaagaagaaggagaagaagaagaagaagaagaagaagaagaagaagaagaagaagaagaagaagaagaagaagaagaagaagaaggagaagaagaagaagaagaaggagaagaagaaggagaagaagaagaagaaaccagcattgctgaggtgaaatcttctgggaactgttttctgagacagaggctgtgttccagagatagtcaaggttgtacttcatgctgtggctggacttggtaatgtgtaagagtaacccaggtggtactggttttgaaggcatgaaggagtcatgacgaacagctggggcttggcactgtaagaggccatggaaggccattggtgaagatgcagcctcgcttgcaattaatggcccaggactgaaggggtcatgcaaaggaggtgaggcttggtaccatgaagagagcctatgagaggctattggtgaagcctagttgcagcggaagaccccggtgtattggagatgtcagtaccataagatgatcaccaagaacagcagtggtagtggagtggatcaacctgagcttagagtgctacaaagggcaaagctgaagatgtgacccaagccctttggaggagcccagaagatcatgtgtggatctcaagacactgaaacaagaagttgtgacattgaagctgctaagatgtttgaggtgccagagccgtgggctatctgctgaggaaagctgctaacagggagtgagaccagcccaggaaaagaagtttgttgcagtcaacaaaaatgaaaaggaggggggcaagagggaggagagggaggagtcaagggccgctgccgtgccccgcactcggcggggcgccagccagggacacagagttcccaggtgttgttgtatggccgatcggtgaatttcaaagctccatagattaccagtatcagcttctgcggtgcaatgttgaccttcttaaaatcatccagctgggccttacgttcaccaacgagaagggggagtacccatctggaatcaacacgtggcagttcaacttcaagttcaacctgactgaggatatgtactcccaggattccatagatctgcttgcaaactcaaggctgcagttccagaaacacgaggagaaagggatcgatacactgcactttgcagagctgcttatgacatcgggagtggttctctgtgacaacgtcaagtggctttcatttcacagtggttatgattttggctacatggtaaagctgctaacagactctcgactgccggaagaagaacacgagttctttcacatcctgaatcttttcttcccgtccatttatggtgtgaaatacctgatgaagagctgcaaaatctgaagggaggccttcaggaggtggctgatcagttggatctgcggaggattggaaggcagcatcaagcaggctcagactctctgctgacggggatggctttcttcaggatgaaagagctattactttgaggacagtattgacgatgccaagtattgtgggcgcctctatggcctgggcacaggggtggcccagaagcagaatgagaatgtggactgtgcccaggagaagatgagcatacttggccatgatcaacaacatgcagcagtgatggtgcgggcaccatnnnnnnnnnnnnnnnnnnnncatgcccctctgctgcctcctgccaccagcatccatggctccatggacacttttttaaatctccaggatgtctgaaacaaaccagtaaaatgtctatgactctttaaaaaaatgaataggagttggaaatctgaagactgctttgacatcagacatggagatgcagagtttggagcttgcccacctggtttcctatcttgctttggggattacagttaagtgattggataaatgtcagaagaaactaaactttgaacttttagcattgttgaaactgctatagactacagggatcttggaagttgaatttattgtacttttttattatgctatgactagatatggcccccaaagactcatgtatttgaacaagtctatgggggccatggagtggaatgtgatggtttgtatatgcttagcccagggagtggcagtattaggaggtgtggccttgttggagtgggtgtgtcactgtgggcctaggctttaagacccttgtcctagctgcctggaagtcagtgttctcctaacagccttcagatgaagatgcagaactctcagctcctcctgcaccatgcctgcctggatgctgctgccatgctcccaccttgatggtaatggactgaacctctgaacctgtaagcctgccccaattaaatgttgtccttataagacttgccttgatcatgatgtctgttcacagcagtaaaaccctaactaagacactggcccatctgataagtgctgagaacatggcacctcctggtggctttaatttgctctccttggggtacaggaaggcagggcagctttgaaaacacaggagtcctttttctctggcctggcttccctcaccaggcctcccagagccagggagataggtgcttatctcaggagggtgagtcccagcagctggggcagagccttgggtggggtgtccttgcctgtttataatgccattgccgttttcaccgaagtgactccaaaacctcaactatgcagtgagtgaacatttgtcaggcaggtccaggctgagtcacctgcattctgagcaggagccagaagaggtgttttctgtggcagggagctggagtgagtggcagttaacatggcccccggcagccttacctgctgcattgccagaacatggttgcccccacaagatcatccctcccgcccctgacctgctccttgtctgtggatttttctgccgtgtgacacaggtgggacgtttgtactagctgctgtcactcaacagcagggcctcttcaatcatttttatggttcactaatatcccagtgcccgtgaatagggctgctgtgacctctgggtgcactcagggaaggattaccacgtcaagggacaatcctggagctctgcccactgtgtactggtccagggagccagtgtcaggaggactcagtttccggtttaggagcttacttctccctccagcaggctactagggcctgggactcagagttaagaccaccaagtttttgaggtaacttctgaggaagggcgtggttggggacgctcctaggagatttacacctgatcctggcatttaggagttggagggcctaccaacaggttttaaggtcctgggatcttctaagtctctgagctcactctcctccaggctgaatgtttcctcaggagaagagggaggagggggggcagctgcagcattggctgagctggggggctgggagggaggcaagaggctacagcaggggctgaaatgaggaaggagggcggaggttgaagcctgggctgagctgtgggagaggcgctgcagtaggggacagacagacagacttgctcaggacaggggagctcctgctccctctcgtggcgtggaagaggaagatggggctctaaatgaaggaggggttggagggagttagactcccaggggaggggtaggactggaggaggaagaggtcaggttgggaatagaggtccactggaggaggtgggggttagggataaaagtgaatgggcatggccaagaaagagggaaggagggtggagacgtggaccttcttgggtaaatctggacggagggtggcgcctagagggaggggaagggccacagtccaggtagaaagacaggtggggaaggacatgaccacagtgaagaacaggacggggaggggcaagggaaaggaactagacgggggggggggtgagggcggaaggagggagactttctccttggctactaggaagctcgactcactggagggaggagcgggaaagggagaacagggaagaagcggaggaaggcgagtagccaagagccagctcaaggcggtcgcccaggtaaacagtgtggcctccggggctgtctggagcccgcgatcgcagtgtgtgccagggtctcgggtggggtggtgcgaagttgaaatctgtggcgctttctagctgcaccgtgctgaagatgctccgcagccccggccatactcctgggctccgggtctcttagacgccgcgaagtagccccgctactttccaggatcagaagcccgcgttttccccagtgtctgcacagccgggtggcctcggctctgactcggtttcccctgttcgagtttgtgaaactttccctgtatgggagttaggctgtggtgaagtaaactgcgaggcgtggtggtggcagcatagttaaattgatagtctgtattgctaaccgaggttctgacgctttggggtaaatttcccattcttttcttttttctccttttttttctgagactgtctttgaacagtctaccttcctcctgagtgcttggtctcgggtccccactttcactttctcatcctggcctgtcacactctgtggagtcaggaggagaaggtgcggccgcttaggggacattagttggtgcccatctggtcagtgtttgctcagccagcccaggccggatcccttcccctgggcgtggtgtttcccctcaatagctgagattgcgaagatcctgtaggggccccaggagactactctgctgccccctccgaggtctggaaccccgcggacttttgttccctgtcctgcgtggaggggcgctggaggcagaagtgggtgcctggtccaagtccctgggctaagctgatcccctgcctcgggtcccctcaggaggcgctaacagcccagcaagggtggggctggggccggcgtgtttactttactcttgattacagggatcttgtgtctgtgacattttatcttgattgtaaaaattaaagaggttattgtaatcctggtgtaaacgtcaccggaagagggacgagagaatgggacccgcttagagggtagggatctagggtgaccccagacgccaggcctatgaggctgctctgctaattggaagggcaaggaaacggccagcaccttcccagcctccgtttccttgtctgggaagtgggccgggctggactttctttcccggttgggggtgggaggctgggggacgctgtgtggcctcggagaagctgtgtgaaggcagggcgttacctccgtaaagctggggtgtgaaagcagggccatcaagacctgggcctccgaagctttatctttataggaactctctttttgtcggtaaaattccaagttcctcgtaaaaagaaaattgcccagggttaaggagctagtacaaacctgaacggagctgccatggggtcagttgatcagctcgtcctacccagctaagcgctgggtgaccccgggctcagggtcacagggacaaacgccaacctggggaccccacgtccagctaggacgcacagaaggaactgtccctgaagcacccatcatcctccgcatccctcactctgggagaatgatccagaacgtctgagcgtgtcagtatccaccctgatgcctctttgagcacgtgtcattcctctacctcagtagccttctgaaggccgctgccaagtcagggccaagggcacaagaccgtttccacccagggcagggggagccaggactcatgaatattcataaagaaataaccaagcccatcattaagactcagtgtttgaaccacacatagtaatgagcattctatgggtcattaatatcaagatgaatctcattaatatttagctaaagtcattaatattccgatgaagttcattaatagtcacagcagcagcgctatgaacctcggtctgtgagccaaaagtcaggtcattggccatcgacctgtgcgtgcatgtcgactgatgaggcatccagttcaactttgacacattgattagccagtgcctcttcagtatccaatgtgtccttcctatgcaatggctcatcaatatgcagtgaataattgaataattaatactcaacatctcgttaagaagcaacattttcttttcttttctttctttttttttgtggtttgtgtgtgtgtgtgtgtgtgtgtgtgtgtgtgtgtgtgtgtgtgtgtggtttttttcgagacagagtttctctgtgtagccttggctgtcctggaactatctctgtagaccaggctggtctcaaactcagaaatccgcctgcctctgcctcccaaatgctgggattaaaggcgtgcgccaccactcccggcagaagaagcaacattttcttatgttctgtggctcattaacatttggttagtttgttgtaattaatgaccgaattcagcaatattaactggtcaataattaattgtgtagccagtgtctgggaactgtgtttttcagggcaatattgtctatgacatgggtcatggcccttttccagcctagcacccaggaagaaggttttgtgagcagttctcaaactgtttattttttgcttcttgaacaagatagcacagcagctgtgagtcttgggggcttaggaactattcaaatattcaggaattagtcattgggtctctgggcacacacccatggctttttatgctttttgagttttggtttttgtttgtctttgtttttttgggaacagggtttctttgtgtagccctggctgtcctggaattcactctataggccaggctggccacacagtcatagagatcctcctgcctctgcctgctgggactaaaggcattcactaccaatgcagtgggtgaggggcagtaagcccagtgcctagcacaactcggcaggagctccacccctgagccacctccgagcccctcactacaggattccctttgccctctttagccccatctctccagcagacactggtgatatgatgtctccttggtgtaattcccattgccaatgcaggcagcagccatcgctgtactgatgctggaagcacaaggaaaggcctgcttcctctgtcttatttcaacttccggaactgggaggaagcagctcaaattgcttcctgatacaaacagccctgggcagaacttgtctgacagtcaggggcagagcagaatcactctgaatcctcacatctgtaaccttgtgtttcttgacaccatgtcccacagtgccctgctgatggtcggggcatccaggccagcagcattcactcacaggctacaccccacccacccacacaggttccctccccagtgtccctatacaaagccccagaggtttctcatctccccatacatattcttcaaggtccccagccaggccagccacctccctctcctgtatgtataactactttattggggttttgtataccactct

SEQ ID NO: 50 - DNA, 3041 bp, Mus musculus
gggtctggagcgcgcaggtagcgccgcgagaggcgatggagaaactgaggcacagagctgagtgaattggagccagacagacgcaggacagaggccaccaggatgtcctattttggggaacatttttggggcgacaaaaaccatggctttgaggtcctctaccattgtgtgaagcagggtcctgtggccaccaaggagctggctgacttcattagggaaagggccaacatcgaggagacatactcgaaggccatggccaaactctccaagctagccagcaacgggacccccatggggacctttgccccgctctgggaggtcttccgtgtgtcctcggacaaactggcactgtgccacctggagcttactcggaagctgcacgatctccttaaggatgtgctgcgctacggcgaggagcagctcaagacccacaagaagtgtaaggaggaagttctaggcactgtggatgcagtgcagatgttgtcaggcgtcgggcagctcctgccaaagtctcgcgagaattacttgagccgctgtatggacctggagagactgcgtagagagaacaccagccagaaggagatggacaaggcagaaaccaaaagcaagaaggctgccgacagcctgcggcgctctgtggataaatacaactcagcccgagccgactttgagatcaagatgcttgattcagccctgcgttttcaggccatggaggaggcacatctgcagcacatgaaggccttgctgggctcctatgcgcactctgtggaggacacccatgtgcaaattgggcaggtgcatgaggaatttaagcagaatgtggaaaatgtgacggtggacatgctcctcaggaaatttgcagagagcaagggcaccgggcgcgagaagcctgggcctctggacttcgatgcatacagctcagctgccctgcaggaaggcaagtacgtctgggcctggatgcccaggctagacccaggtgatttcctggagtctgactcaggggtgcctccagaggtagatgacgaaggcttcactgtgcgccccgatatatctcagaacaatatcctttttggcgactctgtgtacctgagagggctgggtataggcacctgtcctgtgtgcttcaggatgggttggttccttgacagcaacccacatggggctgagcccccacgcttctcctctagtgactctgattttgacgatgaggagcctagaaagttctatgttcacatcaagcccgcccccacccgcgccgtggcctgcagctctgaggctgcagctgcccagctcagggccacggctggcagcctcatcctccctccaggcccagggggcaccatgaaacgtcattcatcactgggacagaaactcaaggctttgtccatcctaggggacacttctgggaagccacagagacctcgttcggccccacgcactggcagttgcgcagagaagcccctggcctcggaggagccactgtccaagagcctctttgggccgccgctggagtccgccttcgaccacgatgacttcacaggctccagcagcctgggcttcacatccagcccgtctcctttctcatcctcatctccggagaatgtggaggactcgggcctggattctccgtcacatgctgcccctgattcactgacgccggctgaccccaccagggagggcctagctgccacactgagaagaccacggtccaggaaagtgtcctgcccactcaccaggagcaatggggacctggcatctgcccgtggccccagcccagtggtcctgggatctcaggacaccctgcccgtggccacagccttcactggagtatgtccatgcctatttccgtggccacagccccaggtaggcagtgatggcaagtgtggggtcaaccattgcctggctcgagtcaccggggagttaaccatgaccttccctgcgggcattgtgcgtgtgttcagtggcaccccaccaccacctgtcctcagcttccggctggtgaacacggcccctgtagaacacttccagcccaacgctgacctgatcttcagtgacccctcccagagtgacccggagaccaaagacttctggctgaatatggcggcgctgacggaggccctacagcaccaggctgagcagaaccccaccgcctcctactacaacctggtgctattgcggtaccagttctcccgccctggacctgagtcagtgcccctgcaaatgagcgcccactggcagtgcgggcccacactcacgcgggtctcggtggagtacagctaccgtgcgggcgccactgctgtgtccacgccactcactaatgtccagatcctcctgcccgtgggggagccggtgaccagtgtgcggctgcagcctgcggccacctggaacacagaggaaaagaggttcacgtggaagcttccagatgtgtgtgaggcagggggctcaggccacctgtcagccagttggcagccgcagtcggggcccagcactcccagccccgtggccgcacaattcaccagtgagggcgccacgctgtctggcctggacctggagctgctaggtggtggctaccgcatgtccctggtgaagcggagattcgctacagggatgtaccttgtcagctgctgaggttcctagtgctggggaccgcctgctctcctgcctctgccggctcccccaggctggactccgtggacaggaacacccatttcagcctggctcagccaactcctccgtccacaagcaggccctggcctttagtattctttaaataaacagttttctaacaaaataaagaggaatcctctttccggttcagaccgggaaggatggggaggggggaaggaggagctgatacctactgtgcggttcatctccagggctgtgtgagctgcctattcctgctgacacacagctaggctacagggagggagaagtagatgaacccctagaacactgcttctccaccctcctaacgctgagaccctttaatatacttactcatgttgtggtgaccccccaaccataaaattatttcattt

SEQ ID NO: 51 - protein, 859 aa, Mus musculus
GTELSELEPDRRRTEATRMSYFGEHFWGDKNHGFEVLYHCVKQGPVATKELADFIRERANIEETYSKAMAKLSKLASNGTPMGTFAPLWEVFRVSSDKLALCHLELTRKLHDLLKDVLRYGEEQLKTHKKCKEEVLGTVDAVQMLSGVGQLLPKSRENYLSRCMDLERLRRENTSQKEMDKAETKSKKAADSLRRSVDKYNSARADFEIKMLDSALRFQAMEEAHLQHMKALLGSYAHSVEDTHVQIGQVHEEFKQNVENVTVDMLLRKFAESKGTGREKPGPLDFDAYSSAALQEGKYVWAWMPRLDPGDFLESDSGVPPEVDDEGFTVRPDISQNNILFGDSVYLRGLGIGTCPVCFRMGWFLDSNPHGAEPPRFSSSDSDFDDEEPRKFYVHIKPAPTRAVACSSEAAAAQLRATAGSLILPPGPGGTMKRHSSLGQKLKALSILGDTSGKPQRPRSAPRTGSCAEKPLASEEPLSKSLFGPPLESAFDHDDFTGSSSLGFTSSPSPFSSSSPENVEDSGLDSPSHAAPDSLTPADPTREGLAATLRRPRSRKVSCPLTRSNGDLASARGPSPVVLGSQDTLPVATAFTGVCPCLFPWPQPQVGSDGKCGVNHCLARVTGELTMTFPAGIVRVFSGTPPPPVLSFRLVNTAPVEHFQPNADLIFSDPSQSDPETKDFWLNMAALTEALQHQAEQNPTASYYNLVLLRYQFSRPGPESVPLQMSAHWQCGPTLTRVSVEYSYRAGATAVSTPLTNVQILLPVGEPVTSVRLQPAATWNTEEKRFTWKLPDVCEAGGSGHLSASWQPQSGPSTPSPVAAQFTSEGATLSGLDLELLGGGYRMSLVKRRFATGMYLVSC

SEQ ID NO: 52 - DNA, 60815 bp, Homo sapiens
  misc_feature (1)...(60815): n = A,T,C or G
aaaaaagccaaagaataaactttgttggtattgtaagccatatagtctgtccagaccactgaattcctttgttgtaggctgaacagactacaacaaatgggtgtggtataaacatagaaccagtccaatctggttcagctttgttagtaacaaaatgtaacaaaatgatgagtcgtttttcagtgcaatggacccccagggtgcaagtcacatatcgctggagcattaacagatgaacaaagcatgcccaattcataacccttgggtggaatgaaaaagtcaactacaggtagaacccaagtactcggatcaaggaatggggactatgctgggcgtggtgactcatgcctgtaatcccagcactttgggaggcccaggcagacggatcacctgaggtcaggagttcgagcctggccaacatggtgaaaccgtctctactaaaaatacaaaagaaactaacggggcatggtggtgcgcacctgtaatcccagctactcaggaggctgaggcagggagagttgcttgaacccaggaagtagagattgcagtgagctgagatcccaccgtcactgagatccagcctgggtgacagagcgaggctccatctcaaaaaaaaaaaaaggaatggggaccaaattaaaaagagaaagctgggtgtggtgtctcatgcccaggaattggagactagcctgggcaacatagtgagaccccgtctacaaaagatacaaaaattagctgtgtgttgtaacatacgcctgtagtcccagctacttgggaggctggggtgggaagatcacttgagcttccggaggttgaggctacagatagctgtgatttcgccattgcactctagcctgggcaacagagcaagaccctgtctcaaaaaataaaagggggagggcggtgccttgtttactgcagtgtggacttgagcaccaaaaacacatcatcgcccctgcacgtgatgcagtcatatcacccccattgcatttccgtatctctcccatgataaccctctgcctatgaaacctgcccccaagctccagcttgaagagacagatttgaacttcgcctactgtctccttgccagttgactctcaaaaaagctttttaggccaggtgcagtggctcatgcctgtaatcccagcactttgggaggccgaggcagacgcatcacttgaggtcaggagttcaagatcagcctggccaacatggagaaaccccatctctactaaaaatacaaaaattagccaggtgtgctggtgcacgtcttgtaatcccagctactctgtggcagaagaattgcttgaacctgggaggcagaggttgcagtaagctgagatcgcaccactgcactccagcctgggcaacagagcaagattctgtctcaaaacaaaataaaaacaaaaactgttggaagttcctcccactgggcaaacagtgtcaggtgggcgagtgaaacacaaagaagcaacagcccatggtgtgaggtgtggggaggtggcacgcgcaccccgagggctcagaggaagccttttagcgctgccgccttgggggttaaaggaggcttcccaaggatgcaaaagggtgagccttattagggaaggggaagggtgctcctggaggagggaccggcagaggcaaaggcctggtttgctggaggaactgagagaagggtgacattgacgcccccgcaaagggggaagagtgtgggaggcagctgcctggaggcctcactgagcagctgggaccaaatcccatggggccctgggggaggggagacgcaggggaagcgggcttaaagtggacttgggagaggcccgccagtggaagaggggtgggggtgggggtgccaggtcctggtggggcgtggccagagctcatttctgggaagatgtcagctcttcccagagagaggcagtgatggggcagggcgtggtggagccctgcctggtatggtacctcctccaggtagccctccttgctacctcttagtccactgcctggacccttcctgactccctctcttaaaagtgtcctggccaggcatggtggcttacgcctgtcatcccagcactttgggaagctgaggcaggcggatcaccagaagtcgggagtttgagaacagcctggccaacatagtcacaccccgtctctactaaaaatacaaaaattagggccggatgcagtgtctcactcctgtcatcctagcgctttgggagggtgaggtgggtggctcacctgaggtcaggagttcgagaccagcctgaccaacctggttagcggggcgtggtggcacacgcctgtaatcccagctactctggagcctgaggcaggagaatcacttgaacccgggaggcagaggttgcagttacccgagatcgcgtcactgcactccagcctgggcgacaaaagcaaaactccgtctcaaaaaaaaaaaaaaaaaattattcgggcgtggtggtgggtgcctgtaatcccagctactcgagaggataaggcaggagaatcgcttgaacctgggaggtgaaggttgcagtgagctgagatggcctgggcaacaaagtgagactgtctcaaaataaataaataaggccgggcgcagcggctcaacgcctgtaatcttagcactttgggaacacctgaggtcaggagtttgagaccagcctggccaacatggtgaaaccccgtctctactaaaaatacaaaaactagctggacgtggtggcgggcgcttgtaatgccagctactcaggggactgaggcaggagaatcacttgaactcgggagatggaggttgcagtgagccgagatcgcaccattgcactccaggctgggggacaaaagcgagacttcatctcaaaataaataaataaataaataaataaataaataaataaataaagtgtcgtcctgtccaccagcacatcttcctgttgtatttccttttaatccatagccctagcagactcttacttgtttatatgtttatatgtcaatatgtttatattgattcccccaactgtgagcccatgagagctgcaccctctccatcttggttgtttctgggtgcccgctgcccaggacaggacccagtacctgtacccacacaccaggttcttgggaaatgttggttgtgccccagcttggcagcactgctgggtgacctcgggaatgttccttaacctctctgggcttctcctcttccccagtctcagaaataagaaagttggcctgaacctccaggaagagcagggagccttgggctgttttggcaactggacccctgagttttcttccctggcctgttcggccccaggcactccagacaggcctgacctatgtcatcctgtcctccccaccccctacagcatcctttgggatctgggcccagggcaggtgtgagctgtggtaccagcacacccatgtcaagtcctgcctctgacgtgtgtttgctgtgtgacttccaagagtagcttgctttctctgagctctgtttcccctggcccaggcttgggagtggagtgtctgggggagtgtggatgcagttcagacctcacctgacaggtgtggatagtaccagggccagggcccccaagaagctcccaggctggagggggagggggcaatgcctaacataacatcccagtcctgggggatcagcactggcttggaaggaaaaccagatgggttttcaggagcctgggaagctagctggagggcttcttgaaggagaggaccacataggaactaagagctaaaggtgggaaggaaatctgggatgccagaaggaggacttcctggaggaggggaccacataggaactaagagctaaaggtgggacgggagcctgggaggccagaaggagggcttcctggaggaggggaccacaagagctaaaggtgggaaaggagcctgggaggccagatggagggcttcctggaggaagggaccataagagctaaagttgggaaaggagcctgggaggccagatggagggcttcctggaggaggggaccaaacaggaactaagagctcaaggtaggaaagttaccagtcagatgcaccctgaggtggaacggcttttgtgccccctgcattgaggtgggtagagagaggtgaggacaggaatgtagggagggccggaccccataagcatgatgggctgctgagacaggtttgcagtttttaccaagagtgctggggagtctggggagtgtttcaagctggagaaaaaggtgagcagtttctgtttgaaaccccactgtgggtcccagttaaacattctggaattgctacacacatgcacttcaatggaacagctgagcacgtgaaggtgataggacaggcaagcctcaaaattggggcttagtctgagagggttcttggcttcacccaggaaggaatttgagggcaagtcaattgtgttaaacagcaacttttctttttcttttttcctttcttttttttttaagatagggtctcactctcatgcccatgttggagtgcagtgccatgatcttggctcattgcagcctccaggagtcctcccacctcagcctcctgagaagcttggaccacaggcacagtccaccatgcccacctaattttttttttgagatggggtcgtcttgctctgtcacccaggctggagtgcagtggcatgatctccgctcactgctccctctgcctcctgggctcaagggatcctcccacctcagcctcccaagtagctgggtctacaggcacaagccatggagcccagctaattttttgtatttttggcacaggcagggtttcaccattttgcccaggctggtctcaaactcctgagctcacgtgatcttcccacctgggcctcacaaagtgccaggattgcaggtttgagccaccgcacctggcctaatttttgtattttttttttttttttttttgtagagatggggttcggccatgttgcccaggctggtaaacagcaacattttcttcttcttctttttttctgagatggagtttagctcttggagtgtgatggcatgatcttggctcactgcaacctctgcctcctgggttcaagcaattctcctgcctcatccttccaagtagctgggattacaggtgcctgcccccacacccagctaatttttttgttcttagtagagatggggcttcatcatattggccagaatggtcttgaactcctgacctcaggtgatccgcccatctcagcctcccaaagtgctgggattataggtgtgagccaccatgcctggccttttctttctttctttttttttttttttagacagggtctcgccttgtcacccagactggagtgcagtggcaccatctcggctcattacaacctccacctcccagtatcaagtaaatctcgtgcctcagcctctccagtagctgggactacaggtgcccaccgccaggtctggtctggctttttttttttttttttttttgagacagagtctcgctgttgcccaggctggagtgcagtggtgtgatgatagctcactgcagcctccaactccctgactcaagcaatcctccagcctcagcctcccgaatagctgggattataggcatgagccaccatgcccagctaatttctgtatttttagtacagacagggtttctccatgttggccaggctggtctcgaactcttgacctcaggtgatccacccatttcagcctcccaaagtgctgggattacaccgcgcttggccctaaacagcggcatttactgaaatggccgtgtagagcagcatcagaggtgctgttccttgctgagcaagaccactgtgcataggcagtccatccagaatagtagctcacaggcacagctgcactcatatgtatacccacttttaattatatgcaaatgaaggccaggcgtggtggctcaagtctgtaatcccagcgctttgagaggctgaggcgggtgggtcacctaaggtcaggagtttgagaccagcctggccaacatggtgaaaccccgtgtctactaaaaatacaaaaattagccaggcatggtggtgtgcgcctgtaatcccagctactcaggaggctgagacaggagaatcgcttgaacccaggaggcagaggttgcggtgcgctgagattatgccactgcactccagcctgggcaacagagcaagataccatctcaaaaaaaaaaaaaaaaaaaaaaaaaaaaaatatatatatatatatatatatatatatatgtatatatatgcaaattaaggggcagtgtatgcagaaacttccaggaaaagggtgacaacttctgagtcatcagggttgttgccatggaaaagggtggtaacttctgcatgttgtcatggcaatggtaaactgacatggcacaccagtgggcatgtcttaaggaaagccccttccctgggggtctgttttataatagctagtcctcaatttggtccaatgtcgcagccccacctctggagttgagtcctgcctcctactttggagggctgacagtgggagccaggtttctcagggataaagtagaagatcacagacaggcaaggggaggaggctgagctcatgttcaacccaatatagatagttacagcaaaatatgtacagatatgtgtatatacatatatacacacatacagctccctgctctgtctgcagacagggcctccaagacacgtcaccccagtaacaagtacacattggccgggtgtggtggtttatgcctgtgatcccagtacattgggaggccgaggcaggaggataacctgaggtcatgagttcacgaccagcctggccaatatggtgaaaccccgtctctgctaaaaatataaaacttagctgggtgtggtcgtgggcgcctgtaatcccagctactaaggaggctgaggcaggagaattgcttgaacctgggaagcggaggttgttgcagtgagccgagatcacgcaactgcactccagcctggcaacagagcgagactctgtctcaagaaaacaaagaaacaaaaaacaaacaaacaaaacaaaaactaaaaaaagcccccaaacctgacagatgccattcggccaggaaatcaaggtcaacaccagcagagtaagtcatgttgacagtttgtacctttgatatggtgtgatgagatgggtgcttcacctctgtggtcttccttccccaaatccattaccctcatttaactgtgagaaagacatcagagaaacctcaatggagggacattctgtagaacacctgaccaccattcctcaaaactgtccccgaaaacaagacagtttgacaaaccgtcacaccccagaacagcctaaggagacatgaggagtaagtgtcatgtaagattctaggacagaaaaaagacattgcaaccaatggccataccagtggaaggtgataatcatgtgggaggcgggccgggcgcactggcccactcctgtaatcccagcaccttggaaggccgaggcaggcagatcacctgaggtcaggagtttgagaccagcctggccaacatgacgaaaccccatttctactaaaaatacaaaaattagctgggtgtggtggtgggtgcctgtaatcccagctactcggaaggctgaggcaggagaattgcttgaacctgggaggcggaggttgcagtgagccgagatagtgccattgcactccagcctggccaacagagtgagactctgtctcaaaaaaaaaaaaaagaaaaagaaaaagaaaaaggaaaaagacactgtaacaaatggacataccaatggaaggcgttaatcacgggggaagcaggccaggtacagtggctcacgcctataatcccagcactttgggaggatgagcggggaggatggagtgagctcaggagttcaagaccagcctaggcaacatggtgaaactccgtctgtacaaaaaaatacaaaaattagctggacgtggtggtgcgtgcctgtaatcccggctacttgggacactgaggtgggaggattgcttgagcccgggaggcagagcttgcagtgagctgagatggcactactgcacttcagcctaggtgacaagagcaagaccccgtctcaccaaataaataaattaataataataataataataggccgggtgcagtggcttacacctgtaatcccaacactttgggaggccgaggtgggcggatcatgaggtcaggagatcaagaccatcctggctaacacggtgaaaccccgtctctactaaaaatacaaaaaattagccgggtgtggtggcgggtgcctgtagtcccagctacttgggaggctgagaatggcgtgaacctgggaggcagagcttgcagtgagccaagatcatgccactgcactccagcctgggtgacagagcgagactctgtctcaaataataataataataataataataatagaccaggcacagtggctcatgactgttaatcccagcactttgggtggctgaggtgggaggattgctttagcccgggggtttgataccagcctgggcaacatagggacaccctgtctctattaaaaaaaaaaaattaaagaaaaaaataataggagaagctgggtgttgggtatacaggaactctctgtactctcttcacaataattctaaaactgctctaaaataaaaggtttatttggaaataaaaggaactggccagtttcagtgcttcacgcctgttgtcccagcattttggaaggctgaggtagggggatcgcttcagcctgggagtttgaggctgcagtgagctatgatcacaccactgcactccagcctgggcaactgagcaagacctcgtctctaaacaaagaaagaaagaaaagaaagaacaactacagttgccttggagaatagggattgtctagggctgggatggagggaacaagaaacacaaataagaaaccgagttggcatccaggctgaagacaattgggtcttcgctgggaccactatggggtgtaggaaaatggacaatttggaactgtttcagagacactgaatccacgggatgaaatgctggtaatgaagggaagagaagatccttagggcctcccaagcttctggtctgtgctcctgggctgccctgactgagcctgggaggctggtggaggggcaagaaaatcagccgggtgccctgtccctaagcagagggtaggatgggggactggcgggtgttgtgtaagtttatattttctttttctttgtttttgtttgtttgtttgtttgttttttaagacgaagtctcactcttgtcgcccaggctggagtgcagtgatgtgatctcggctcactgcaacctccgcctctcggattcaagtgattctcctgcctcggcctcccaagtagctgagattacaggcgcctgccaccatgcccagctaatttttgtatttttagtagagacagggtttcaccatgttggtcaggctggtctcgaactcctaacctcaagcgatcgagttcgaactccaaaaaagaactatcatatggcatatgaggggatgacctcctctgcaaggtgccggatcccggggctgccctaggccggctgcagacttgctgtgtggcctccaagcaagatcttgccctctctgagcctcagatttcccatttgtaaaataaagaccaataatgtccaggttacaggcttgtggggggtcatcaactgagccctgcctgttcgctcaataaacgttggtcgctccttactccttaccactgagtctcagggcgaaagagtggcgcctgtctctttaaattatgcaaatagactgcgggtggcgtaagggggggaacataaaaaggagcctagtcttcggctggaccaatcagcgcgctgagctggcggagctgggcgcctaaatggcccaatggggggccgcgcgggatcagagcccgccctgcctcctggcgccgtcgcgggggtggggactttctaggccacgccccgggggcggagcccgccggcagccgcgccgcagccgcggagggaggggcggggcgggctccggtgtcagcgaccaagccgcaggtggcggcgagcgcggggctcggcccgagctcaggaggtgagtgttgccccccggaaccccctgggataccctggcccgcgcagcctcccacgcgcaccgtgccctgcagccccggcggctgcggagggcaaaggcgcggcgggacgcgagggatggagagcagggggttggggctacgcggtgggcgccccggcttccccctccaagtggtaattgggggtccgcaggcgaaaatggggaccgctccccaaatcccccgtctcctggcctagaaccgagcgtgcacgggggcggcgacgacgcgagacccctccccaaattcttttattctaagcctaggtctgggttctggggctgcaaagatgggggcgccgctccccttccagcctggaaccctgggcggtggctgagatggggaccacccgcagattccctcttcccagctccggcctgcagaccaccggggaccgagacgagggaccccttcccttttcctccactgtgaacccctatccaggcctggtggctggaggagctggggtgtcacctggcccctcctctaatctgccccatcccagtcctccaccttaaggatggggtggggggcgtttcactggcatcttctgtggggaccccaaggttggaattttggggaggaggtcactgtggggtcccctgcctggcacggtttatccaggccaggccttgaagggcctggagcctggacttgggggggggggtccctcttttactgaggggcggggtgtacagctagcatctgttcctggggattaaaataaatcgaggtaaattaggatcttgccagaggctggctgtgagtggggtgcggaggaggcttggggggtgggggacccctccatctgccttggatcccccgagtcacctgccccagctgcactggggaccaggaggcagtgtcgaatggacctgcttcactggtgaccttgggcaggtgacagcacctttctgaacctcggtttcctcttttgaaaattgaggttgggagcttcggaccctgcattttacagattctgaactcacccagcccacattttgtccaatggtgattcactcttttgcttaacatgtgggtggtttggggtcaagacagcattgggtttggagaccctcccacagtgccttgctatcctctcagcctcagtttactgcactgcaaaatgggttgatgatgacactctgatattggggctgagggcatggggacagggagtaaaacataggaccaagctgcaatggctgggatggggcatcgccaccctggtctcaccattggggccacttagggcacaccctgacccacataccatcacccacgccaggggtgaacctgttctcgggcgaggtcctgggcaggagggggtgggagttgccaggccagctcattccctgtcccttggagcgccctcccagtggtgggcatggggctgggagtctgacacccccaggtttgaatttgcctctacctgtgtgtgtgtttttcccttggtgcctttgtttgttcttctgtgaaatgggctgaattcctctgggaagatgggaggagtctgtgggaggaggaagctctgtaaatacagacatgattattataatattaatgacagtattagtgctctttaaatcgggtcacagctgaccaggaggagggaggggaagggggagtctatcaaaggcattgcctgaggagactccagcacctgggaaagttgggtacacagtaggcattcaatagatgtttgccaaatgaagtgaggaagagggaggggacccatggggaggacagaaaatttctgagaatccctggctcagattcccacttggtggcccgagtcactgtgtgacctggggcacgtgtctcagtttccccatcgtggtgctggttgagataagatactgccttgaggtgtggtgacgagaatcaagccagattgtctgtgatcgcagcccaggtggcgaggccaagaggggagacatgacatagtgggtcattgaaacagcatggtacctgcttgaaccaagtgactggtccgtgggaaggatgagaaaacccttgctactggccctactgtacatacactggggtccaagagagagggaaatgtgagatcctgtttcccaggatcctggaagccagatcgtggaaggtcaggagtggcccaaggtcatcaggcaagacgtcagcggctccggacacccagccaggcaccactcgattcccaggatgggagctcgggtcttgcctttgttgctgatgtggttcctgctttgttttatctgttctggggctgctcacatgtctcagccccaggtttgcaagacttggtgccgggaaggcaggatggggacctctgagtcagctggcaatgtgctgtgtaaccttgggcaagtctccggccatctctgggctttgtgctggtactgtacaggctgggagacttgggttctagcagggctgacttctccatcagacccaaaatgcccagtgtctcaggctcacagtgcttttaggggtccctaggttgatgttttcacttcttttaaaatccaaagggaaaaaaatgaactcttgggttgaaggaaacatttttgtgtataatattaatatatttgtctttatgtcaatgtagttgtaaaatacagttttgttttgttttgtttttgagacagagtctctctctgtcacccaggctggagtgcagtggctcgatctccgctcactgcaacctccatctcctgggttcaagcgattctcctgcctcagcctcccgagtagctgggattacaggcatatgccaccccacccagctaacttttgtatttttagtagagacggggttttaccatgttgcccaggctgttctcgcactcctgggctcaagcgatccacctgcctcggcctcccaaagtgctgggattccaggcatcagccaccacctaaaatataattttaaatttcttttgtagtgaaggaaagcgctcatgaatgcaaaaatgtcttcccctttcttttcttttttttttttttttgagatggagtctcgctctgtcgccaggctggagtgcagtggcgcaatctcggctcactgcaacctctggctcactgcaacctccacctcccgggttcaagtgattctcctgcctcagcctcctgagtagctgggactacaggcatgggccaccacgcccagctaatttttgtatttttagtagagacggggtttcaccgtgttggccaggatagtctcaacctcttgacctcgtgatccacccaccttggcctctcaaagtgctgggattacaggcgtgagccaccgcgcctggccatgtcttcccctttctgagcgcatttccctctctgagcctcagtttgcccagtctgtgaagtgggtatcggcctacctcaggatggcaagatgttgaatgcctgggccagggttggtgctcagttatttcccaattgccatgattaatatttgttcggtaagaacagctccaggttcaggccagggggctccaggttcaagcgcctcttgtttactcacccatggcctgtgtggttccagggaggtcccatgggtgctgatcgggcgggggaggaaaggtggcggttggatggtaggcggggcggggtgagcttcctgtccccccccaacccatgcacacaagcctccaacttggtgctgacggaagtggcctcgtggctgtctcctggcgcctgccccgtcagacaggggccccatcccactcgctaccctgtccggtgagtttgagccctggccagtagatacccatcatctcgccttggcccccctcaggaacagaggggaggcccccctgcccggagcctgggtttcaggagaagtagcaggtgtcacttcctgggctggccaaagcctgcatggggccacccgttgccctgccccccgtcccccattccagctgtgagtggtggtttgggttaggggggcggcaaggggagcttggaaacccagagagccacgcgtgatggtttcaaacaggaggtcattggcagacagaccaggggcaaaatcacagtcagccgggaccaatgattgatctctctgtgcctcggtttccttcataaagttggggttgcctctgagggcatggcatgaagattggatgagcagatgcgtgtgaatagttgggtacagggtcgcacacatactggtgctccatgtgtatctgtctgccagaggtggggtgaggcaatctaattgaaactgtgaaaacagtagtgagattcttggtttctggggaacttgggctccttggttcctgggatcttctagaacaatgttggccatccaatacagcagccatcagccccatgtagctactgagccttggaagagaggctggcacagctgaggagctgggcatataattgtatgtatgtatgtatgtatgtatgtatttaattattatttttttaagacagaatctcactctttcaaccagtttggagtgcagtggggcaatcttggctcactacaacctccgcctcccaggttcaagcgattctcctgcctcatcctcccaagtagctgggactacaggtgtgtgccaccacgccctgctgatttttatattttttggtagagatggggtttcaccatgttggccaggcaggtctcgaactcctgacctcaagtgatccacccacctcggcctcccaaagtgctgggattacaggcgtgagccactgcgcccagccaattgtatttaattttacttggtttaacattaatacaaaaattaatacaaaaattaaggccaggggttgtggctcatggctgtaatcccagcactttgggggtcccaggcaggaggatggcttgagctcaggagttcgagactggcctgggccacactagtgagacctagtctctacaaaaaaaaaaaaaaaaatttatttttaattagttagacatgtagtcccagctactcgggtggctgagatgggaggatcacttgagcctgggaagtcgaggctgccatgagctgtgatcatgccactgcacactccagcctgggtgacagagcaagaacctgtctccagaaaaaataaaaaaataaaaaaaacttaatacaaaaattattcaggcgtgagcctgtagtctcagctactcgggaggctactattcaaggctcccttgagcctggggaggtggaggctgcagtgagctatgatcgcaccactgcactccagcctgggcaacagagcgagaccctgtctccaaaaaaaaaaaaaattaagtcaccacatggggctagtggttcccatgccagtcagcacagctctaagagatttggagatgcttagggtcctggtcatggacagaagctaagaaatgatatggaaatttagggcttttcccctagggatgtcagcgtagcatgctcaccaccctacccctgccaccaaactaggtttcctaagggggtgtggtggggactgaagtttttcaggggccctgtcattaaccagtgcagggttgggaatgtttgttgaaacaaataattccttgcccagtgaactcctattcatgctttaaaaccccaactcccatgagccctcctttagtccaggttcttttggaccttgtccctccatctggcccagccctgaccatgcaggacggtgatatctgtgtccagctctgtctctctagactggggactcctgcagggccaggcccggggctgaatcaactcagggaccctgacattgttctagtctgggtgagcaagtaggaggtcttgggtgactcacagaagtcccgggattggaggctcaacgataatgggtccaattaaactaactaactttctttctttttgagacagggtcttactctgtcgcccaggctggagtgcagtggcgccatctcagctcactgcaacctccgcctcccaggttcaagcgattctcctgtctcagcctcccaagtagctgggattacaggtgcccgccaccacacctggctaatttttgtatttttaatagagacagggtttcaccactttggccaggctggtctcaaacccctgacctcaagtgatctgcccgcctcggtcccccaaagtgctgggattacaggcgtgagccaccacttctagcctaaactaactttcaagattaggtaaactgaggcacagagaggggcagccttgcccaaggtcttgctcagtcctttcctggggaggccccgggagcttccccatcctgtggtcacgggtccctgtcactcctgccactgttcctacgaggctcccagctgctaccgagctgcctgtggggtcatgaattatgcatgaggcctgcaggctccagtgacaagcctggcctctagaacatgccaaggacactgcctgtccgtcccctgccgggcggcctgacccagcctcttgtgcagagacacctggggctccccggcaagatcccttctaagcattccttcttattttgcagatggggaaactgaggcacggagctggacagtgactcagacaccaggtgaacactggcttttgagggcagggttgggactcgtgggggcagcaatgccagctgggtcatcacagtgaggagtgagctctgactcccaggagggtacataaggtgaggactgtcctagaggaatcagaagaccccaggggaccctcagggatacttcagggaccccaacccccatgtggctgatcacagcccctgcatctatttctcttcaaacccttttcctgcaggagctgcctggagtggagctgagagctcaggtctgggctcagccagtccagagtgcaaatctactgtcccttcctagctgtgtgatcttggcaagtgacttcccctctgggggaggggagggctcagttttcccatctgtgaagtggatcagagctttcctgtcaaggttaggggtcatccagcactgctcctacccactgctatgaactcttatacatgcctaaaaaccccacattccatgccccctcctccaatctagactccctcagctcttgtccctccacctagtccagttctgactctgtggaattgggggcatctgtgtcttgttctgtccccctctactggagctacttgggaccagcactggggctgaattatctcaggggtcctggcatgctcttagcattggagctttcagttcctccttcatcctttctctccttcctctacagggagggactttccccccaccaagcccacactggcaatgactctgtagctcaaacttgcctctctcttcagacaggcactggacggggcctgcaggggtctccacagagaccatcaggatgtcgtattttggggagcatttttgggtaagacccactcttatttaggcgggggatgctggcagggctgtggggacttttatggagatgggaggactgggtgagttgcggttacagccttggacaggtagaggatctgcaagggatggaagttaaagtgggaagagtcaggctgggtttgaatccacacccaccccagacctcacaggccttacaaccttgggcaagtcatagcttgtgtcatagggagaccaagggccagagtgggaacgtctaggcaacctgaagttgccccatgaaaaagtgcagagtcagtgctcaaacccagggccaaactgaacttccaggacccagggtcattccagccagggaatttccacccccttcccatcctggagaattggggggttttcctgacctggcgtctcatggcctgtgcacccctccactgtccaggctggagatcacctcctgtagcccaagggctgctgagtgagacagagttgtttttaattcattcatttcctctctccctgccactgtgacctcatccccagccagccctaggagatgctggggtctccaagagaatccatcccagccccagccccaagggaggagtccccagtctgggggacccagagccagcttagacaccttcagccctgcaggaccagggctgaacccagccttgggggtcctagagtaggaaccaggacacagaatcgtgtttgctgtgagaaagcctgggcaaaagaccagagatgtgacactgagtggcaagttcagggaacagggactcctcctgcagagccaggctaacagggtgccacagaggatgggtgaacaggggagggcccaggagtcagggaaggaccaggtcagaaagccccttccccagttgcaggccctgagcttgcagtgaggaagcctgttgctaggcgactggttgcccctggcaacaagccccactcctgcccttgctccctccccagctggggctcctcttgaaagcacttgctttcttaaaggggccgcactcccttgccacctgcaggggtgtgacctccgccctctctccaaaggtcagactccccgatttgcccctgaaaggctgtgtgactccagtgaggggctacccctttctgagctccttttagtactgccgtgtaatggaggtgaccatttgaggatcaaaagtcacctgcattttggaaccccgacagtggcacctacatttattttaaatcctttttaattgtgtgaggcgtgcaggctcgctgcagaaaattcagatcagcaaagagaaaatagaaaccacccccgacttccccacctcacccaaagatatcctggtagagaatggttaagagctttgagttcaggattcgaattgactctgctggaagcccttgagcaaatgactttgcctgcccgaacctctgtttccccatctgggaaaaagggatgaaattcctgcaccgccactcccaccccatgcaccccacacacccccagactcagggaggcctcctgtgacatctgtcatcagttgctagtattgaagccgccatagaagcctggttctttgctgggtggtgctggggagattaagccaaacagggatgccccagtctcactgcgccagggcagggccgaagcatgaagtgtactagggagccatgggggaagtgtgagcaggagagggacataaacaagctctgttacaaagaccacactcttggctgggcgcagtggctcatgcctgtaatcccagcactttgggaggccgagggaggcggatcacctgaggtcaggaattggagaccagcctggccaacatggcaagaccccatctctactaaaaatacaaaaattagccgggcatagtagcatgagcctgtagtcccagctactcgagaggctaaggcaggagaattgcttgaacccaggaggtggaagtcgcagtgagatcgcgccactgcactccagcctgggtgatggagtgagactccgtctaaaaaaaaaaaaaaaaaaaaaagaccacattttggctggcacagaggccaagtctgaagtctagaagttctggtgggagagacagacctgagacagcccctcctaggaccctcggctgccagcccagtccaagagaggcagacgctgctgggggtttgccaggtctgggaaacgggccagcagttggctctgagtcagacccagatgctgctctgggcggtggtgcctggtgcagcctcacccgaggatctcctggggccagcactgtgccagcctcatcccagcaagacccttgggagttgggtgctgttgttgtccccatttgtcacacaaggaaggaaactgaggccagagagacgaagtcaccaacccaaagtgaccctgtacgtataaggagattggacacttgaactttgaaaatataattccaaacacaagaagagaaaatataggtggagcgtggtagctcacgtctgtaatccaaacactttgagaagctgagatggcggatcgcctgagcccaggactttgagaccagcctgggcaacatagcaagaccccgtctctactaaaaatacaaaaaattagctgggtgtggtggcgcgcacctgtggtcccagctacttgggaggctgaggtgggaggatcgcttgagcctgggaggcagaggtttcagtgagccaagatcataccactggactccagcctgggcgacagagcaagaccctgtctcaaaaaaaaaaaaaaaaaaaagccgggtgcggtggctcacacctgtaatcccagcatttgggaggccgaggcaggcggatcacaaggtcaggagatcgagaccatcctggctaacacagtgaaaccccgtctctactaaaaatacaaaaaattagccgggtatggtggcgggcacctgtagtcccagctattgaggaggctgaggcaggagaatggcgtgaacccaggagacagagcttgcagtgagccaagatcgcatcactgcactccaacctgggtgacagagtgagactccgtctcaaaaaaaaaaaagagaaaacgtattcctggcgagctggagggagcaacagtgaagtgggggagggggttgagcagggttagggaagtttctagagcaggtggcaatgatccttgggaagtggaaggatgtggatgggtggaaggagatgcaagctggagagctgatggcgggaatagcctggacaaaatgtggtggtggaaaggcactgcctgtctttgctatttgctgttttgtgggtgaggctaggaagaagctaggagatgaggctggagcagcaattccaggccatggacttggacttcagcatctggtgggcaatagggacccattgatgattctagaatgaagtgtgaccattgggagatttgggcttgaggctgacctgggtctgccccagtcttggcttcggtgtctccattggtgcagcaggaaacgttacctagcagtgacttctggctttaaccttcaggcttctggccaagtgtggtgactcacgcctgtaatctcagcactttgggaggctgagatgggaggattgcttgagtccaggagttcgagaccaaccttggtaacatagtaaggccgtatctctactaaaaataaaaaaaactagccaggcatggtgtcacatggctgtggttccagctacttgggaggctggggtgggaggatctcttgagcccaggaatttgaggctgcagtgagccatgattgtgccgctgcactccagctggggagacagagcgagaccctgtctcaaacatagaaaaatatgtataacattcaagcttccaggtacctgggagggtgaacctggtaggttggaggagggcacaggaaactaccatttatggaaaacccgccaaatgctgccagagggatggcttcactgatgtgtgttgggacttaaatggcatcagatccctccacaagccttctcttccagtgttattataagacctgatttggtgctaaaatgtccccagttccctcagaccccagctgattacctttttttttttttttgagacagagtcttgctctgtcagccaggctggagtgcagtggcgggatctcagctcactgcaacctctgcctccctgcttcaagcaattctcccgcctcagcctcccgagtacttgggactacaggcgcccactgccacgtctggctaatttttgtatctttagtagagacggggtttcaccatgttggccagtctggtcttgaactcttgacctcgagtgatttgcccgcctcagcctcctgaagtgctgggattacacgcatgagacaccacacccatctagtcattgattttaaagttgtaatggtgagttttaagtccaaatctaaaggtgtccaattccaacagcgggcgcagaggaccaggtctccaaggggtggagagaagcgggatcagaaggtgtgtatgaggccgggcgtggtggttcacgcctgtaatcccagcactttgggaggccgaggcaggcagatcagttgaggtcaggagttcaagaccagcttgaccaacatggtgaaaccctgtctatactaaaaatacaaaaatcagccaggtgtggtggcacacgcctgttaaaaaaaaaatcctcatgtttaatctatattggtcttgcttttagccttttcctcagttctattcatattgtttattattttttgttttctgtagatggtcatataatctggtctcaattatttttcttaccttactgcatttgccaacacctctacatcagcattaaatattagccatgatttgaggcattcctgcctcatcctgaaatatgttgtgtctcctgttttgccatctttttttttttttgcattgggggacagagtcttgctatgtcacccaggctggagtgcaatggcacgatctcagctcactacaacctctgcctcccgggttcaagcgattctcctgcctcagcctccgaatagctggggttataggcatgtgccaccacgcctggctaatttttgtatttttagtagagacggggtttcaccatgttggccagtctggtctcgaactcctgacctcagataatctgcctgcctcggcttcccaaagtgctgggactacaggtgtgaggcaccgcgcccggcctgattaccatttttaatggacagcttagtagtgttcaggcatgatgcccttcccaggtgacagaatctggccggcgttaagatatagttgttgcctcattttttcctactcctttcatgcggcagagggtcccaattttccattgagagtggcagaaaaagttgccctttaacataaatgtctttggggaagaagcataagcaaatttaaaacaaatgctaactattaataactaatgttacgaattagcaaaaactagagtggcctttggggctttggggagcattgacatggattatcttgctgcttgtatcatctccatgtaagaggcagatgtctcccaggctgtagtgtagtgacatgattttggctcattgtaacctccgcctcccgggttcaagtgattctcctgcctcagcttcctgagtagctgggattacaggcacctgccaccatgcttggctaattttgcatttttagtaaacacggggtttcaccattttggccaggctggtctcgaactcaagacctcaagtgatctgcctgcctcagcctcccaaagtgctgggattacaggggtgagccaccgcgcctaacctccctgccccatcttaatgaggagctcctaaaagctcagagggggcagtgacttgcctgggtcacacagtgcagccctggcctcccccaccatgacaaccccagaaattggagtaaagagattttgtgaaggcattcgcaggcaccagggtagaaatactcagttcccagtggcactaacaggtaacagcagaatcatttgtttatttattcaacgaactcaaatgccctttctgtctctcattctgtgctgggctttggtgggtcctgggagagaactcaaacctggaccctaatttgggttctcataggcggaatttccatgttgacaagaacagaaaacacaactacagtgacttaagcaacggggactgtattggcttataagatcaaatgattatgggggaatgtggctttcagggttggtttgatccagcaactcaatttaacacactttttttttttttgtagctagtataaatgggatcactttcttgatttcttttcagctatattttattaatggtgtatagaaacgctactgattttcatgttgatatttgtattttgcaatttaactgaatttgtttatcagttctaggagttttttggtggtgtgtttaggccttcctatacataagttcatgttgcaaagagagacaatttgacttcttttcatgtatatacatatatatatatatatatatacacacacacttcccccccgccctgagacggagtcttcctctgttgcccagagctggagtgcaatggcgtgatctcggctcactgcaacctctgcctcccacgttcaagcaattctcctgcctcggcctcccaagtagctgggattacaggggtgcgccaccatgcctggctaatttttgtatttttagtagagacagggtttctccatgctggccaggctgatcccaaactcctgacctcatggtccgcccgcctcagcctcccaaggtgctaggattacaggcgtgacccactccaatttatttttatttttatttcattcattcattcattcattcattcatttattttgagacagtcttgctctgatacccaggctggagtgcagtggtaggatctcagctcactgcaacctctgcctcctgggctcaagcaatcctcctgcctcagtctcccaagtagctgggattacaggcacgcgccaccacgcctggctaatttttgtatttttagtagagacggagttttgccatgttggccaggctggtctcgaactcctgacctcaagtgaaccacccaccttggcttctcaaagtgttgggattacgggcgtgagccaccgtgcccagctcaacacacttttttttttttttaaatataaaagccctctggttcagcttctttctaaggttcacggtttccatttgacttccagtatcccctgtggccacataattcctcatttatggaaagacacaaagagaaaaggggaggagactgagacagaaacggcagagagactcagaaaaacggagagaaagacagagacacaaagacagaaggagacaaagacacagaacaaatgagattcctccccagcaactataggacaaaaagaaaatcccaggcttctctctgattggacaaatttaaggtccatagacaatccctatggcccaggggaaatgcagcaagctgattcgctcaggcccgaacaagtccctacagccaaggggatggacttctgctccttggccacgcccccgttgctaagcaactatgatgttctctccatcctttctcaatctctattcccatcccctgcagggcgagaaaaatcatggctttgaggtcctgtaccacagcgtgaagcaggggcccatctccaccaaggagctggcggacttcatccgggagaggtgaggtccccaagccccatccaccagaggccacgcccaccatcctgtagtcacgcccacctaatggctacgccctgcatggtcaggggctagaaccctggggattccaggaaccagaggggctcgaaaatcctggaaatgaccgattctcaacccggtcaggcccatatctccttttaaacaacaatcacctgatttcgaaagctcccctcctcaaaagaggatgatataacctactcacggttggaatttttttttttggagacaagatcttgctttgttgcccaggctagagtgcagtgacccaatcatagctcactgcagcctcgaactcctgagttcaagagatcctcctacctcagctcccgagtagctgggactataggcatgtaccaccacatctggcttttttttttttttttttttttaaacagagttttgctcttgttgcccaggctagagtgcaatggtgcagtctcggctcactgtaacctctgcctcccgggttccagcaattctcctgcctcagcctcccaagtagctgagactacaggtgcctgccaccacgtctggctaatttttttatttttagtagagacgaggtttcactatgttggccaggcgggtctcaaactcctgacctcaggcgatccgcccgcctcagcctccaaaagtggtggaattacagatgtaagccactgcactctgccttttttttttttttctttttggagacagagtctcactttgttgcccagggtgatctgatcatagctcactgcagcctcgacctactgggcccaagcgatcctcccacctcaggatcctgagtagctgggactacaggcatgcaccaccacacctatctaagttaaaaaaaattttttttgtagagaaggagtctcattatattgcccagggtggtctcgaacccctgggttccagtgatcctcctgcctcggcctcccaaagtgctgggattacaggcatgagtcaccatgcccagcctactactgttgttaataaaatatattacgtaagaaaaaatcttctatgaattttcaaaacatccctcagagtgttgtgtcatccccccattatggaaagccactgctaaggtgtttgagatggggaaactgaggcccagaggagcagtgcctctctcaagggtgtctgaaagcttcttcatctttttttttttttgcgatggagtcttgctttgtcacccaagctggagtgcagtggcacgatctcagctcaccgcaacctccacctcctaggttcaagcgattttcatgcctcaacttccccagtagctgggaattacaggcatgcaccaccacacctggctaatttttgtatttttagtagagacagggtttcaccaagttggccaggctggtcttgaactcctaacctcaggtgatccgtccgcctcggcctcccagagtgctgggattacaggcgtgaaccactgcgcccgggcagtttctccatctttacctcattctcctccccagggccaccatcgaggagacctactcgaaggcgatggcgaaactctccaagctggccagcaacgggacccccatggggtgagtggggtaggggtcaccaacatggggacattgggagcctcctccttggtggacatctcttcacactcggtgcatgtagaatagagtgtcatccacctcgattatggggctatttggatagagggatgtatatcattcattcacacactagctcattcattcattccacaaatattttttgagtgccttctgtgtgccaagcaccagcagcaacccagacagataaaaccccagccaccttcatgcaatgtacatctgggctgtgtgagaagagagatgttaaatacaaacaaaaacattttttttctgaggtgaaaagtgctgggaagggggccaggtgcggtggctcatgcctgtactcccagcactttgggaggctgaagtgggcggatcaccggaggtcaggagttcaagaccagcctgggcaacatggtgaaactcctctctactaaaaatacaaaattagtcgagtgtggtggcgggtgcctgtaatcccagctactcaggaggctgagtcaggagaatcgcttgaacccaggaggcggaggttgcagtgagccgagattgtgccactgcactccagcctgggcaataagagcgaaaactctgttttgaaaaaaaaaaaaaaaaaagtgctgggaagggaatgagataggagtgtgagagatcgggcactttctctggggtgggcccgacctccctgaactgagaccttaatagaaaggggcaggccatggggatgtctgagggacagagacccgggcaagtggctcagccagtgcgaaggccctgagttgacaggcgtggcatgtttacggaagagtgaggaggctggcctggctgcagggcttgggcaacgtggaaaggaagtaggaggggagatggcagggtgaggcctcaggggcctgacacacaaatgactttgcatgaaccttgtgcccgggcgcggtggctcaagcctttaatcccagcattttgggaagctgaggtgggaggatcacttgaggccaaaagttcgagaccagcctgggcaacatggagaaacccctgtctctactaaaaatgcaaaaattagccgggcatggtggcatgtgcctgcagtcccagctatttaggaggctgaggcaggaggatggcttgaacccaggtgatggaggctgcagtgagccatgattgtaccactgcacttcagcctgggtgacagagccagaccatgcctcaaaaaaaaacaaaaataaaaacaaaacacataatgtggtcccccgatggcatttgcagttttctttgtggctgctatgaggcaaaagttctgtggggcaggcagaagtggaggcagcaggaggagaaggtggagggaggctggatggggcttctgctgagtggggcaggccaaattgactcgattggggcatgtggtgtcttagtcactcttttttttttttttttttttttttgagacagagtctcactctgtcgcccaggctggagtgcaatggcgcgatcttggctcactgcaacctctgcctcctgggttcaagccattctcctgcctcagcctcccgagtagctgggactacaggtgcccaccaccacgcccggctaattttttgtatttttagtagagacggggtttcaccatgttagccaggatgctctctcaatctcctgaccttgtgatctgcccacctcagcctcccaaagtgctgggattacaggcgtgaaccatttttttttttttttttgagatggagtctcgctgtgtcacccaggctggagtgcagtggtgtgatctcggctcgctgcaagctccacctcccgggttcaagcgattcttctgccacacccagctaatttttgtattttaagtacagacgggggtttcaccatgttgctcaggctggtctggaactcctgacctcaagtgacctgctcgactcggtctcccaaagtgctgggattaccagggcctgcgtttaaattccagctctaatgttgatttgttgaggggccttgggaggagctatagagctccctatgcctcagtttccccatctgtcacaggcccgcctcttacagctgccatggagattatatgaattagtattcattcatgtttagcagggctcagcgtgcagcacatacctgagccagtgccagcgctgtcccggggtggggtgagcctgatgaaccctgggtgtgaccttgcccgcccccaggaccttcgccccgctctgggaggtcttccgcgtctcctcggacaagctggcgctgtgccacctggaactgacacggaagttacaggatctcatcaaggacgttctccgctacggcgaggaacagctcaagacccacaagaaggtgtgtgtcgtgggcgccgcccagcggctgggtgggtgtggaacaccggcagctcacaggaccccagatcttctggggctttataacctgcggatgtccgcctccgagaattccgttaattccacaacgtcaagcccagggtcttacggacctgagcgttgttgaatttcaaacttgcaaaattccagaccaggagttagcacactgtggcccacgggccaaatcccgcccaccccccaccaatgtttgtacagctaagaagggttttttttttttctgcttgtttgtttttaagagacagggtctcactctgtcacccacatgcagtggcgtgatcagagctccctgcagcctcaaacacttgggctcaagcgaacctcctgcctcagcccccacagaatagctgggactacgttgcacgccaccatgcctggctaatttttaaaaaatgtttgggcctggcgtagtgactcatgcctataatcccagcactttgggaggctgaggcaggaggatggctggagcccaggatcctacaggagtttgagaccagcctgggcaacatagggagaccccatctttaccaaaaaaaaaaaaacacccaaaactacccaggcatgatggcacatgccggtagtcccagctactcaggaggctgaggtgggaggatcacttgagcatgggaggtcgaggctgcagtgagccatgatcatgccactgcactccagcctaggcaacagagaaagactgtctaaaaaaaaaaaaaaaaaaaacaagagagagagatgggttatcactggtttttacattattaaagggttagaaaaaaatctaaagaaaaataaaatttcaccacatgtgaaaattgtatgacagtcacatatcagtgccagtaaataaagttttattggcacagagccatgcccattgatgtgcctgtcatctgtggctgtttggcactgcagcgacagattcaagtgtttgtatcaagccaaacacatttgctatctgtccctttacagaaaacatttgccaacagctgttctaaagcattggaagttacagatattcatatttactatttttacactcttataaacctagaatcagaagaaccatcttagactcttagaattccacaatatccaaagcttataattgtagaatcatagatgcattgtctttacagagttccaaaatctgcatgtttttatgtcttgtttaaaaagggggttggtaatactttgtttttgttttgttttgttttgtttttttgagatggagacttgctctgttgcccaggctggagtgcaatatgcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccagcaaacgcatgcagctgcatgcttatgtgactctaaggatacccaggctggtcttgaattctgactcaggtgatcttgccgcctcagccttccaaagtgttgggattacaggtgtgagccaccgcgcctggctttgctgatttttaaattttttgtatagaagggatcttgctagccaggagcgatggctcatgcctgtaatcccagcactttgggaagttgaggcaggcatatcacttgaagtcaggagttccagaccagcctggccaacatggtgaaaccctgtctatactaaaaacacaaaaattagccagacgtggtggcacacacacctgtaatcccagctactcaggaggctgagacaggagaatgacttgagcctgggaggtggaggttgcagtcagttgagatcgcgacacaccactccagcccgggcaacagagtgagactctgtctcaaaaacaaaacaaggcaaaaaaaaaaaaaaggagagagagaaggggtcctgctgtgttgcccaggctggtcaaacatctaacatatctgcctcagccttccaaaatgttggcattacaggcatgggtcactgtgcctggccaggagtgaatttttaagtggtaaaagcaggccaggcgtggtgtgcatgcctgtagtcccagctacttgggaggctgagctgaggtgtgagaattgcttgagcctaagagttagagaccagtttgggcaacacagtgagaccccatctcttaaaaaaaaaagctgggcacagtgacttatgtctgtaatcccagcactttgggaggctgaggcgggcagatcacctgaagtcgggagttcaagaccagcctggccaaaatggtgaaaccctgtctctactaaaaatacaaaattagccgggcatggtggtgcatgcttgtaatcccagctacttgggaggctgaggcaggagaatcgcttaaacccgggaggcggaggttgcagggagctgagattgtgccactgcactccagcctgggtgaaagagcaagactccgcctcaaaaaaaaaaaaaaaaaaaaaggcctggcacggtggctcaagcctgtaatcccagcactttgggagtccgaggcaggcagatcacgaggtcaggagatcgagaccatcctgactaacacggtgaaaccccgtctctactaaaaatacaaaagaaaaattagccgggcgtggtggcggcgcctgtagtctcagctactcaggaggctgaggcaggagaatggcgtgaacccgggaggcggagcttgcagtgagccaagatcgcgccactgcactccagcctgggtgacacagcgagactccgtctcaaaacacacacacacacacacacacacacacacacacacaaaacggtgagttaagcaacacagtctgccactgtttgtcataaaacttgggttagaacaagcatctttatccatatgcggattatttctagagaagtatcacagtaataattggggacttctaggctggagggcccatatatgggaggctttttcctggcttacctcttacaactttctgaaatatgaaccatgtgtaaatagtacttttttttaaagttaaaaatgttttgaaatgaaaaacgtacaggccgggcatagtggctcacacctgtattcccaacactttgggaggctgaggcaggtggattgcttgagtgtaggagtttgagaccagcctgggcaacatagcaagaccccattgctattaaaacacacacacagaggccgggcgtggtggctcacacctgtaatgccagcactttgggaggccaaggtgggcagatcacctgaggtcaggagttagagaccagcctggccaacatggtgaaaccccgtctccactaaaaatacaaaaaattatctgggtgtgatggtgagcacctgtaatctcagctacttgggaggctgaggcaggagaattgcttgaaaccgggaggcagagattgcagtgagtcgagatcgtgccactgcactccagcctggacaacaagagcgaaactctgtctaaaaaaaaccaaaccaaaacacacacacacacatagaaaaagactgtggagctgacatcacgtggagtgtttgggaggtcaggaatttcacagtctacccatgaaatcccctcctaccccgcagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggtgggctcacagtgggggggttctgaggaatttgccgcggggcggaggggctgcctgatcagagagtggaaacacatcccagagcgacggtcctggaacctgtgggtgatcacaccctgggtaccccgaggagttcacctgccaggtgatggggcctgggggaggccccctgagtatcgccctcccatccccgtttcctccctgtgctttgtaggcggagactaaaaccaagaaggcggcagagagcctgcggcgctcagtggaaaaatacaactcagcccgagctgactttgagcagaagatgctggactcagccctggtaagaaccaggcatctgtacctttaagacccacacatgcctttgccctggaggttatggactgcagaaatcccaggcagggtgtggtggctcacacctgtaatcccagcactttgggaggccgaggcgggaggatcacctgaggtcaggagtttgagaccagcctggccaacatggcgaaagcctgtctctactaaaaatacaaaattagccgggcgtagtggcaggtgcctgtaatcccagctactcaggaggctgaggcgggagaatcacttgaaccagaaggcggaggttgcagtgagccaagatcgagccattgtactccaggttaggtgatagagtggaaccctgtctcgaaaaaataaaataaattcaagcagattggaatctgaggattaggaatcagaacttttttcaagttacaagtgatagaagccttcattcaaaccgacaggtgtatataaaaaaaaaaaaaaaaagaaaagaaaaaggctgggcgcggtggctcatgcctgtaatcccagcactttgggaggccgaggcaggtggatcacgaggtcaggagatcgagactatcctggctaacacggtgaaaccccctctctactaaaaatacaaaaaaattagccgggcgtggtggtgggtgcctgtagtcccagctgctcaggaggctgaggccggagaatggcgagaacccaggaggcggagcttgcagtgagccgagattgcgccactgcactccagcctgggcgacagagcgagactctgtctcaaaaaaataaaaaataaaataaaaaataaaatttaaaaaaactgacaagctcagggaactgtaaagttttgtttttgagttgtggaggtttcagtcatagctgaatccatgtgctcaaatagtgctggcaggaaattgtgaatttctgcttcttttatttttttgagatgggatctctctgtcactcaggctggagtgcagtggcgtgatctcagctcactgcaacctccgcctcctgggctcaagtgattctcctgcctcagcctccctagtagttgggattacaggcacgtgccaccacacccagctaatttttgtatttttagtagaaacggtttcaccatgttgcccagactggtcttgaattcctgacctcagatgatccgcctgccttggcctcccaaagtgctgggattacaggcatgatacaccacagctgaccaccatttctgcttcttaagtctgtttttctctctggggacatcactcccacacagacatcccctttgtgtgtgtgtgtgtgcatgtgtgtgcaagcatgcacatgtgtgcatcaaactgggcaccagcaacccccacttacatcccatcagcacattggctcaggaatggaagtgccttttcctgtagagtcaatgaaagtcctagggcagactctcattggcccttccccaaatcaatcactgagccaagggcttagggtattctgattggtcaggctgagtcatatggccacttcttcttggccctgacctcctttccacctgcctctgccctcctgcttcagcgcttccaagccatggaggagacacacctgaggcacatgaaggcactgctgggctcatatgctcactcggtggaggacacgcacgtgcagattgggcaggtgagttgggcaggtgtgaggaatgaggctggggtcactgctgggcaaaggggccttgaccagttacacaccccgcccacccggcacaggtgcatgaggaatttaagcagaacatcgagaacgtcagcgtggagatgctactcaggaagtttgcagagagtaagggcacaggccgggagaagcctggtgagtcagggcagccattgggggtcgggcttcggggccacagctgcagacaggcatgtgccaccatgcccagctaattttttttttatttttttatttttaatagagacgaggtttcaccatgttggccaggctggtctcgaactcttgacctcaggtgatctgcctgcctcggcctcccaaagtgctgggattacaggcgtgagccactgcacatggccaggccttggtttcttcatgggaaaaatgggctgctgacaagtccagctctccagcctgatcttatgtgtaaatgtctttgaaccagatcccagaggagccttgaatgccaggcttggctgatcagacttcacccccagggcctaagggagccattgagggttgttgagcaaaagaacaatttgggaatgcgcagatgcaggactgggaaggagttaagagcaaaagttttagagtgagacgtgggtttgagtcttttcttcatcgcttgctgtgtgacctaggacctgtgctttgacttctctgagcctcagtttcctcatctgtaaagtgaggatgtaataatgttgtaacattcagtgatttcatgcaggtaaagggcaaagggtgtgccaggcacacagtaggcactcactaaatgctggtatacagttacgtcctcaagtcttgttaactagcaaaacctgttctttctccctcctgtcgctctggctcaggcctggctcaggtctcccctccctgcatggggccccactcttgcccttcacaggccccagatctgttttgtcctcctcctgctcacacaccttccatggctccccattgttcttgggagagagttcccactccttatcctgtcactcaaagcccagcccactgcacagacgcatggtccattccccgacccaacccaagttccagccacaaatgctggaagtatgtagaagtagctcatgtcaccccctgcggtggcactgccctgctggaaccagaccagccccttggtccatcccacttctgattatgtggggctggttcttgtccgggaacctgatggaccttgagttcagatccaggtgccattttgtggccaaaagtgtactaccctttccaagcgcagtctccccaccctcaatttagtttctttctctctctctctctcttttttttttttttaatttttttgaggcagagtcttgctctgtcacccaggctggagtgcagtggtgcagtctcggctcactgcaacctccgcctcctgggttcaagcgattctcctgcctcagcctcccgagtagctgggattacaggcgcctgccaccatgtccggcttttttgtaattttagcagagacagggtttcaccatggtggccaggctggtcttgaactcctgacctcaggtgatccgcccgccttagcctcccaaagtgctgggattacaggcatgggccaccgtgcccagcccctcaattgagtttccgtctcctgtctcaggacctctggacttcgaggcatacagtgcggctgccctgcaggaaggcaagtacgtctgggcctggatgcccaggctggaccatgggggtgagggaggctgatctgaatgtgaaaggaggctcacagtgctcaggtgccccccaatctatcctcagcgatgaaacgtttgcggggagccaaggcctttcgccttccaggactaagccggcgggagcgggagccggagccacctgcagctgtgtgaggaagcacccctgcccagtctggcccaggctagcccgagatcccttcccctgcccaggctatcccagaagtcccctcctaggatagcccaggagtatccatattccaggctggaccaggattccctctacctgagctagaccaggagtacctctgcccccggctagctcaatattaccgctgcccaagctagtccagaattcttccttttgctaggttaggccaggaattgcctgtcccagagtaacgtagcatcttccctgcccaagctggcccaggattgttctgtttgccaaggctagccccgactttccctatcttcacaaggcagcccttcaaatgagttccaggattccttccctcccaggctgtttgagaacactctctactcagctaacttcagattcaaccccctccccaagcaagccccatggtcccaccgcctctagggctagctcagggcagtatcacagtctgggagctgccccagcttccatgtccagtgttgggggctgacagggggcaccagatgggctgcggaagctgacaccaacatctcttcctccatccccagagatttcctggagcccgattcaggggtgagtgatgtgggaggggtcaggctgggctacaagtggaaggagtttgatcccactcttggctcctagagtcccgatccctactggaaactaaagagccgagattgaggggcgggctggagcctgggggctgggttcatatcccacctcagctgcaaagtcccatggactacgtgggtgtgaataatgtccctgccgaagctcagtttgtcccaggaacctgcccacacacccagggaagacagtcgttgccatcagggttggttttgaggtctgagtcaaggcctgggggcagggcggggggcggttggcagggtgagatggaaggttcgatagtggggcgcctgactcactgctgccccctgactcccctagacatgtccagaggtggatgaagaaggtttcactgtccggcctgatgtgacccagaacaatatccttctggcaccccctgggggcagttgttggcacagcaaggacaaaattctccgtaataaccagtccaccttcagcagtcctctctgtgtacatcctggagagagtctcctttgtggatgaagccaacctaaatgtaaacacccactctatggggtcagcactgggcaagagggagagagaaaaggagatctagcagggcttcctggaggagggggcaccagtgttggggttttgcagccgaataggagtttgccagttagttctgggcatgcttgtgcaaaggcttctcggggggggtgggagtgctggtgggacatggtgtcaggactgaaggtggcgcgtggtgagcgatgggattgggcaggacctcgaagggtttgagcagggagggacgaggctggattggagagctgactgggggaaagcttgtgttgggattggcttggaccttgactgcagcccacgcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccaggggtgaggcgtgggaggggtgccctgggtgttgctagagaggctggctggatgcactcgtgtgtgatgttgcccactttgtccacagggcaccatgaaacgccattcttcacgtgagtagcctttggtcttcagagtggggaggatcctaaggaagggaggctatgggtttgggcttgaatcataactccgttttgtaactttgggcaggctgcttaaccacactgaccttcagtctccttttctgtaaaatgaggtcattatgaaattaagtgagagctgaaaggggtagctggggccaggagaagctagcatctggagacaggctcgcttaggcttgaatccatgtctgcctgatttgctgatcaccttgggcaactggctggacacccccgagcctcggtcccttggtctgtggagtggggagcattgcaggcagggtgacaagaaggctgaaggaggtgcatctcttgtaggggacgctgctgggaaaccccagagacctcggtctgcccccagaaccagcaggtgggttccacacgagtgggcaggtgggggctgtccccacctcctccctccacctccccatgtctccgcctggtgttctcttgtcccggctgggagttgacgtcatgctggggtttttttgtttttgtttttgttttgagacagagtctcactctgtcacccaggctggagtgcgatttcagctcactgcaacctccacctcctgagttcaagcgattttcatgcctcagcctcctaagtagctgagattacaggcacccaccaccacgcccagctaacttttgtatttttagtagagacagggtttcaccatgttggcccggctggtctcgaactcctgacctcaagtgatctgcccacctcggcttgccaaagtgctgggattacaggcatgagcccttgtgcctggcccatgctggcttttgagggaccatttagtcattcatttgatgaacatttattgagtgcctgctgtgtacctgtgctgttctagggtctgggttctgagacaggtctcccttctcagagtcacattctagtgactccagattttaagaatagcaaatagggccaggcgtggcggctcacgcctgtaattccagcactttgggaggccaaggcaggcggatcacctgaggtcgagagttcgagaccagcctgaccaacataaagaaaccccatctctactaaaaatacagcattagccaggcatggtggcgcatgcctgtaatcccagctattcgagagggtgaggcaggagaatcgcttgaacctgggaggcggagcttgcagtaagccactgttgtgccattgcattccagcctgggcagcaagaggaaactccgtctcaaaaaaaaaaaaaaaaaaaaaaaaaagcaaataagttagagcatattcgatacttctaagtgctacgaagaaactaaagcagatgacgcgaagacaggaggaggtgacttcccttgaggtggggttgggaacctccctgagggggtgacttggagctaagccccaaagaggagctaggaggtgactgtgaagagagctggggaaatggaactccagactgggaacaggctgcacacagtggctcacacctgcaatcccagcactggccaaagcagccagatcacttgaggtcaggagtttgggatcagcctggccagcatggtaaaaccccgtctctgctaaaaatacaaaaattagccgggcatggtggcaggtgcctgtaatcccagctactctggaggctgaggcaggagaatcgcttgaacgcaggaagcggaggttgcagcaagctgagatcgtgccactgcactgcagcctggccgacagagcaagactccgtctcaaaaaaaaaaaagactgggaacagcatgtgcaaaggccccagggtgggatgaggcttgggaaaaatagaagcagccctcttggcctcaccctctctagctgtgcagagagattgcagtcagaggagcaggtgtccaagaacctctttgggccgcccctggagtcagcctttgaccacgaagattttacaggtgatggggataagggattggagggcatgggtgtggccggagggaggttgggtggggccattgcagagttaggccaatgaggtcccctggaagccaggctggagggaggactagtccgtgtaggggtgggcggggccagagtgcgcgtgggaggggccatagatagggtggggccttggccagtgggcggtgactgagtggatgggccggacatttgtggagagggaagtcaccagaaggtgtagccttgggggcgtgcacaaggactttgaatgggggcccccctgaccttccctcgacgtggccgtggcctgcaggaggatgggcagggactctgagtgggcgagggtcggagctgaccgcccgcttccctccccaaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggaggtgagtccagcgggcctgggcctgagagttgctggaaccctgggcgggggattgagcgcctgctttgggcagggcctgatcaggctgctggagacacagccaggaccaggcaggcagaacctcccaccgttgcagggacaacaatgagatggacatttagcaaggcaggcggtagcgggtgccaggtgggggccctccctgaggaagggacatctgagctgagatttgagggaggtgaggacagaaccacgtggacatgaggggaaaggcgtgctgggcagagggcacagcccctgcaaaggtcctggggcaggagcgcgctaggcctgtctgaagaacagcaaggaggtctgcctgctggaacggggtgatcacggaaggaggaggaagagaaggcagggaccaggaagggcctgatgggcccagggagggcttgtgaatgttaccctgagtaacgctgagggccatgagcaggggaggggcgggacctgactcaggggtcacaggctccctctggcagcttcgggagtgagggcagaaaccagagactggggaggcaaccagggaggcaagtaggcgatgggggtaagggtggcagtgggagaagcaggtggaaaggtcgctgcaggggagagttcggaggagtaaggatggggaaggggcggagtcaagggagggaggaggatggggaaggagcggagtcaagggaaggaggaggatggggaaggagcggagtcaagggagggaggaggatggggaaggggcggagtcaagggagggaggaggatggggaagggacagtcaagggagggaggaggatggggaagggtgcggagacaagggagggaggaggatggggaaggggtggagtcagggagggttgggggacagtcgaggctgtgcctttaggtgtcaggtgcacagtggaccctgagtgtggggaaggtcaggtcagagcaccccctccttgaagacgtcatcaaaacaggaggagcagccgcccagggagagcagaggagaggacagccggggagcccagaggggttggagacaggaggacagcaggagatggggggagagcggcgggatgggctcctgggggctgtctgaggagaatgggaagcccccgagtcagagggactgtgggctgtgaccacccgaggtccccagtagtgtcaacaagggctcctggcaccctccataggaaagggccaggctggagcccgttcaagggagagctgagtgggtggagaccacagagtgggggcagaagaagctcttttttttttttttttttttgagagggagttttgctcttgttgcccgggctggagtgcagtggtgtgatcttggctcactgcaacctctgcctcccaggttcaaacagttctctgcctcagcctcccaagtagctgggactacaggtgcgtaccgccacacgtggctaatttttgtatttttagtagagatggggtttcaccatgttggacaggctggtctcgaactcctgacctcaggtgatctgcctgcctcggcctcccaaagtgttgagattacaggcgtgagccaccgcacccggcctgagtagaggctcttatccaaccctgcaaattctgcccccccaggggacattgtcagtgtctggagacatttttggttgtcaccaccaggcaggagtggtgctcctggcattcagtgggtggaggcctgggttgctgctcagcaccctacagtgcacagggcagcccccgcccccgagaatggtccagcccccaaatatccacagtgctgaggctgagaaagtcgggtagagcggggagcacagcttggggtacaggtgagaggggaggtaggtgggaggggaggtgggcaagcaagggagcacgttcatagatggaacagaaccaggaccctgaggaagcaggagagggaggggagcttgggtgttaaaggcatgagactcagacacagaccacagtaggtggctgcagtcaggttctcggaaagggtagaggtcacaaaatggctgaatgttggctaaaaatcctctgctgaaccccccttacagcatgcctgcgtcttaagccttcagtgcttgcttgcatacccccagtgatggggagctcaccccttattgggccaccattctggtgtctgggagggttgggggtgtggacagtatctgcagtcctgtctggcaccttttctgcaacaccaggacttcagacccattgggggtctctgcagaaaagcccacctcctaagattttggctgagtttgtgcccctggggaggccccagaggccccgggcagcatctcagcagtgcctctttgtactcgctcctagacctgatgcctgcacctgctgaccccacagccagggagggcctggcagccccacccaggagacttcgctctaggaaggtgtcctgccctctcacacgtagcaatggggacctggtaggtgagggggcgtggcaggagctggactgggggtcgcctctggggtccgcttttgggcactggtcctggggcactcacagccaagattgtctctttcccttccagtctcgttccctgagcccctccccactgggctcttcagccgccagcactgccttggaacggcccagcttcttatcccagacaggacacggtatgtgagggcggtcctgggcctggctttgggcctcagtgtcaccttctctggtctgggtgggtggcttctctgttggcagaggtgtggttgggcggagggagtctcgagcctggagcctatattcacgctgtctatccgttgttccccattccctctccaccacccccaggagtctcccggggtccgagccctgtggtcctgggctcccaggatgccctgcccatagccacagccttcacggagtatgtccacgcctacttccgtggccacagccccaggtacccagtgatgggcagacagggcccgtgggaagtctgtgttgggggagtccagcagggacagctttcagatgtgcttcatggtctgtcttatagtgaaagggccttgaacactgagccaagtgaccaggcccctgtcctgagggcagtggagccataggagggcctttttttttttttgagacagagtttcgctcttgctgcccaggctggagtgtgcagtggtgcaatctcgcaatctcagctcactgcaacctctgcctcccgggttcaagcaattctcctgtctcagcctcccgagtagctggaactacagatgcgtgccactgcacccgactaaattattgtgctttttgtttgtttatttgtttgtttgtttgttttgagacagggtctcactctgttgcccaggctggagtgtagtggcgtgatctcagttcactgccacctctgcctcctgggttcaagagattctcctgcctcagcctcccgagtaattctgggattacaggcacatgccaccacaccctgctgattttgtgtctttagtagagacagggtttcaccatgttggccaggctggtctcgaactcctggcctcaagtaatccagctgcctcagcctcccaaggtgctgggaggatagacatgagccactgtgcccagccataggagagcatttaagcagggctatgcattgctgtagacgccaaggctgccgtgggcattgagatgaagggagtaatactagaagttaggcccagtaagtgggtaagggcgtgggttagggacaagcggagtgcagggatatatattggggtggccttcagcagaaaagatctgaaagtcaaaccatgaagaagaggagagtgtcagatcaaaaacccaagcaaaggatagctaaaaaactgaacattttaatttgagcttcctggtggcctaggagaaaagagaactagggatggagatgttcctgcctccttcagcccagggtggattcttcctgtccaggcaggaatgaaagaggaggttgggggaaaggatacgggggatcatcagggccatcctcctagatccgaggagtctggggagccacaggcaccagtgaaaccaagagaaggggaaggatgaggcaccaggcagagccctaagccaacacccagtcccctcatcctccctagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcaggtactatggaggggcagtgggagagggcctcggaggctgctggggatcaggcttccggactctgagttccctctctgcttcctgggattttttttttttcttttttttttgtagagacggagtcttgctctgtcgcccaggctggagtgcaatggcgtcatctcggctcactgcaactccgcctcccgggttcaagcaattctcctgcctcagcctcccaagtagctgggattacaggcacgtgccactacacccagctaatttctttcgtattttagtagagacagggtttcatcatgttgcccaggctggtctcgaactcctgagctcaggcaatccgcccgccttggcctcccaaagtgctaggattacaggcgtgagctaccacacccggcttgattttttttttttaattattatttttttgagatggagttttgctcttgttgcccaggctggagtgcagtggcgtgatctcggctcactgcaagctccgccttccggattcaagtgattctcttgcctcagccacctgagtagctgggattacaggcatgtgccaccatgcctggctgatttttgtatttttagtagagatggggttgcaccatgttggtcaagctggtcttaaactcctgacctcaggtgatccacccgtctcagcctcccaaagtgctgggattacaagcatgagccaccacacccagccacctcctgggatttgctgtgtggcgtggggcaagtaacttgccctctctgacccttgttttccatccctcctttactgcccgcaccacaaccacccaggtagggctttgctgggcccagggtgggccaggaaattgcatctttaggaaggggtagattgaatgctgggagccctgggagggcatgtcctgaggattggggtgatcagtccgggtctctgcagtgacccctcccagagtgaccctgagaccaaagacttctggctcaacatggcagctctgaccgaagccctgcagcgccaggcagagcagaaccccactgcctcctactacaacgtggtgctgctgcgataccaggtgcgccacccgcatggggccgggaggaggtggtggagtgggggacacggtgagccggcagcagacatggaggcgcctgcgtgttggccaggctggtctcgaattcctgacctcaagagatccaatctgtgagagccgatgagctggagggagtaggcagtgtgggtcgggaatgaacggtggaggagtaggcagtgtggaagagcatgcatcccctgttgcagatagtatgtttctgtgaactagaagcagcccagccccggaaccttacacttgaacttccctgggagactttgttagaatgaggcgctctcctgccccctgctggaaacctggtgtaatacagcctctcatccatcaaatctccctgtgactggacccccttggggcggtgcgtgcatcgcagggtcaaggtggttgaatagcgcatggtgtggcaagacaggatggcccaagctgtgtcctctctctcattctcattcttcctagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggtgagggcttgcgggaggccaaggaaaactcagcagtttcccccataaccccagaccttctccctgatgcattgattaaagggtgcaccctcggcctgaccgttaactgtgagcccaccctgcttagcactaagggtgatattatgagtgccaggtgcagtggctcatgcctgtaattgcagtgctttgggaggctgaggtgggaggatcacttaaggccaggagtttgagaccagcctgggcaatatggtgagatctcatctctacaaaaaatattttgtttatttatttatttatttaatttatttactttgagatgaagtctcgctctgtcgtgcaggttggagtgcagtggcacgatctcagctcactgcaatctccgcctcccgggttcaagcgattttctctgcctcagcctcccggatagctgggattacaggtgcctgctaccacacccagctgatttttgtgtttttttagtagacatgaggtttcaccatgttggtcaggcttgtctcgaactgctgacctcaggtgatccacccgcctcggcctcccaaaggactgcgattataggcatgaaccactgcacccagccttacaaaaaaatattttaaaaagtagtcaggccgggtgcggtggctcacacctgcaatcccagcactttgggaggccgagatgggcagatcacgaggtcaggagatcgagaccatcctggttaatatggtgaaaccccgtctctactaaaaatacaaaaaaaaaatccgggcatggtggcgggtgcctgtagtcccagctacttgggaggctgaggtgggagaatggcgtgaacccgggaggtggaggttgcagtgagctgagatcatgccactgcactccagcctgggcaacagagtgagactccgtctcaaaaaaaaaaaaaaaatagtagtggtagtgtgctcttgtagtcccagctactcgggaggctgagacagaaggatcacttgagcccaggagttgaggcttcaaggagttaccctgggtgacaactgtctcttaaaaaacaaaaattttaaaaaaaaaaagtctgttgtgaagaagccagacttacaggacagaatgcgtcatctaaaagtgctgcaaggaagccgggcatggtggcttatgcctgtaatcccaacactttggaaggccaaggcaggtggatcacctgaggtcagcagtttgagaccagcctggccaatatggtgaaaccccgtctctactaaattacaaaaattagccaggcgtggtggcgggcgcctgtaatcccagctactcaggaggctgagggaggagaatcgcttgaacccaggaggcataggctgcagtgagcagagatcgcaccaatgcacaccagccggggcgacagagggagacaccatctcaaaaaaacacacaaaaaaacacaaaacaaacacacacacacacacacacacagaagtgttgcaaggctgtgtggctccacggctgttccatatctcaccctcatttcacagatgaggaaattgaggtgaagtgggggagaaggtttgttggggtcacacagccaggaggcagctgaggcaggaccctgggctctcagcatcctctctggggaagccctgattaagattctttctctgccaggaacctggaggagaagcggctcacttggaggcttccagatgtgtccgaggcaggcggtgagctgtggttgtgtatgagggctgggtgggagggactggggtcaggtgggaggcacttatttatgttggggaagaattggggacatactgagggcgggcaagtatgggcattgaggaagtctttaaaagctggaggagggccgggctgagtggcataggtctgtaatcccagtgctttgggaggcccagaatgcaggatcacttgagtccagcagttggaggctgcagtgacccgtgatcgtaccactgcactctagcctgggcaatagagccagactctgactcaaaaacaaacaaacaaacaaaaaaggccaggtgtggtggctcacgcctgtaatcccagcactttgggaggccgaggtgggtagatcacttgaggtcaggagttcaagaccaacctggccagcatggtgaaaccctgtctctactaaaaatataaaaattagccgcgtgtggtggcacgcacctgtgatcccagctacttgggaggctgaggcaggagaatcgcttgaacccagtaggtgaaggttgtagtgagccgagatcgtgccactgcactccagccagggtgacagagcgagactctgtctcaaaaaaaaaaaaaaaaaaaaaaaaaaagctggaggagggccaaggacagtggcataggtctgtaatcccagtgctttgggaggcccaggtgggaggatcacttgagcccaggagttagaggctgcagtgacctatgattgcaccactatactccagcctgggcaacagagccagaccctgtctctaaaaaaaaaaaaaaaaagctgaaggagagggcgtcccagggccagatggccagacacagcaggtgcaaaggccctgaggcaggactcccttgctagccatacaaagcccagtgatgccaggagagacagatgcaggggatcaaagggaggtctgatggggcacataaaggccacagaacagagggcttcaggtgtgggccaaagatgagcctggttcacagctgggacgggggctggtgccagggcgcagctgactgcaggtctccccaggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacaggtactccccaaccctgctgctgggtgacctcaggagccgagatcttacaggggcaagccccggggtgtggggagggattggggtgtggggatccttgggaaagataggtgggtgttggggccaggagaccccagatggggggcacaggtgggcaaggaggcagggccctgtgtatctggggctggcccttggaggacgtccttggaaggaccccagccagggagcccgaagtcccccctgccaccccctcctccagccccaccctgttctcctgcccccaacaaggggctcctggggcccagtggcaacagggactatgagttacaggggtgttttgaagaggacaaggatgattgaagcatcccagggtcagagccggggaacccctcccgtacccctcctccccacccctccccctcacagctgcacccccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttttcctgctccaggaagtatcctttgcgttgccagagaggggaggaagagaaggtggatggatacgagagacctaatgtacctccctccctgcactgcgctcaaccggtacagggccattctgggagagaaagaacaacacagataccccagccccatgggctcagaggtgggctatagggagggaggaggactacagaagcccagaaaggggtgtcaggagtcttcccaagcagtcaggaagactttctaaggagggggcattataaatgaggttttgaggtatgagtaggagtttgcaagataggaatgggcatcccaagcaaagtgatggaaggttgttagttcaatgaggaagcaattagtcaacctacaaatattaattgagtatctactgtataccatgtagcagagagagagctatgagcaggacaaagttcttggaacccaggaagtggagataggaagcctgagtgaggagcctgcttggcggccactggctgtgtgactttaagcacgggacttgagcctcagctcatctgcaactcacctcactggatatctgtgggaggtcacacacttagaagagtgccaactacagggcaaaacccccactagtaccaggcagctttgggagccccaggaggagggtggaccttggtgcaggtgtgcaagaatggcccactggggagggcaggacagaagcagtaacagcagactgcagtggggagcaggtctgagcccagtggacagtcttgggtcctgatggatattcagggaaccagggcctgtgttcctgaccttgaggctgtacagaccccagggagcaagcccagactggatgaagctcagaaggaaggaagtaggaggcaggatttggcctgagacttgctgtgcgctgtctctgatcatcccaccctgtcctccaaagagagagtgcctctggctgtgcgtcagtttccttgtctgtaagatgggaggaatcctgtagttgggagaggttcagggagcattcttggcacaaagcaagtgcataattaacattggctgagagtcgggcaccgtggctcacgcctgtaatcccaacactttgggaggccgaggcaggaggatcacttgagagcaggagttcaagaccagcctgggcaacatagcaagaccccctgtttctacaaaaataggaaaattgacccagcatggtggcacacgcctatggtcccagctacttgggaggctgaggcaggaggatcaattgaacccaggaggttgaggctacagtgagctaagatcacactggtgctctccaaggctctgggcagccacagagtgagatactgtctcttaaataggccaggtagggtggctcatgcctataatcccagcactttgggaggccgaggcgggtggatcatttgaggtcaggagttcaagaccagcctggccaacatggtgaaaccccgtctccactaaaaatacaaaaattagccaggcggtagtagtgtgcacgtgtaatccctgctacttgggaggctgaggcaggagactcgcttgagcctgggaggcggaggttgtgatgagcccagattgtaccactgcactccagtctgggtgacagagtgagaccctgtatcaaaacaaaacaaaacaaaaacaacaaaaacgtcagctgtaggaaggaaggatgattataggagttggggcatcaaatgggggcagaggtggctgcagcacctgccctgtctggctacaaacagcccagggacttcccagcccttcatgtcttctcccttgcaggtcttagcacctaggctgtaaattcagagaccacacctgcccagtgggtgtggctctgggtgtcagagagtagtggcatccatggggccactgggtgtcagacatccatggggccctgggtatcagagctgagctttatagaggtgacaaaatcaaaatctgtttgccaccacctcctcataatgtagcctaatctgggcatgggttcttccctgtctgataagtggcgggtacatggcacctcctagtagcttttatttgccttcctggggacacaaatgaggctgggcaccttttaaaatgaagaaggcatctgggcatggtgactcatgcctgtaattccagcactctgggaggccaaggcaggtggatcacttgaggtcaggaattcgagaccagcctggccaacatgataaaaccccatctctactaaaaatacaaaaataagccaggcgtggtggtgggcgcctgtaatcccagctattcgggaggttgaggcaggagaatctctggagcccaggacgaggaggttgcagtgagctgagaacatgccactgcactccagcctgggagacagagactccatctcaaaaaagaaaccaaacaaacagggctgggcgcattggctcacgcctgtaatcccagcactttgggaggcccaggccggtggatcacttgaggccaggagttcgagactagcctggccaacatggtgaaacccccatctctactaagaaaacaaaaattagctgggcgtggtggcaggtgcctgtaatctcagctactcgggaggctgaggcaggagaattgcttgaacccggcaggcagaggtttcagtgagcccagatggcgccgctgcactccagccttgatgacagagcaagactccgtctcaaacaaacaacaacaacaacaacaaaaaaaaaaaaaaacacaagcaaacaaaaaagcgcagaaggcacttttcccaggtgtggcctcctaactgcccagccttccagagcaggtgtgacgtgacctatctcagaagagtgaattccaagagagagggcgcggaacccgttaaacctgccaaccccgggcaggcgtgatgccattatgcagtttacatgccctggtctcttccacccgggtggccttaaaacctcagctgtggtacagagtgatccactggcacagcaccatcaactgggccacatgtcagaggccacccccagctgataagtggcctaattggattttcttttgagctgaaattcacaaaacaaaaaatgaaccactttaaaatgaacaattcagtgagtttcagtatattcataatatgtgcaaccacaccctttatctaatttgtgcacattttcatcccctccgaaaggaaaccctgtccccttcagcagtcatgccccatttcccctcccacagctcctggcaaccactaattagcttcctgtctctgtggatttgcctgttctgggcatttcacataaatggaatcatacgacatgtggccttttgtgtctggcttctttcactcagcatcgtgttttttatttcatccctgttgtagcagggatcaggacttcaatctcttatcaggacttcaatctctctctttttttttttttttttgagacagagtctcgctctgtcatccaggctggagtgcagtggcatgatctgggctcactgcaacctctgcttcctggatttgagcagttctcctgcctcagctccccgagtagctgggattacaagcatgcgccaccatgcccaactaatttttgtatttttagtagagagggattttgccatgttggccaggctggtctcgaactcttgacctcaagtgatctgcctgcctcagcctcccaaagtgctgggattacaggcgtgagctactggccaggacttcagtctttctgatggctgaaaaagactccaggcagggcacagtggctcacacctgtaaccccagcactttgggaggctgaggcgggtggattgcttgaggtcaggggttcaagaccagcctgggcaacatggtgaaacccccgtctctactgaaaatacaaaaagtagccgggcgtggtggcaggtgcctataatcccagctactcgggaggctgagacaagagagctgcttgaacctgggaggtggaggttgcagtgagccaagatcctgccactgcactccagcctgggtgacagagcgagactctgtctcaaaaaaaaaaaaaaaaaaaaaaaaaaaaaaaaaactcaagactccactgatggaccacatgttgtttatccattcatccattggacacttgggtcggtgatcaccacccaagcagctgaaaagaacactgtgaatcatgctgctatgaacttccctatgcaagcatttgtttcaacacctgttttcaactcctttgggtagatacctacaagggcaatggcgggatcatagggtcattctagtccggatttgaacccgggccctccagcaccagaattcactctattgcgtccagtgaaccccggaagcacccggtttaaaaggtctgggggctcagggtatctgtatgtcttacacatgggaaaagggtgggagggttcagtttccctgggtgagtggggcggggctagagctcacatcctcccagcagcctgaattctggagggccagtacctggtggaggaggggatgggcggggaccctgtcacaggatggtacttttttttttttttttttttgagatggagtctcactctgtcgcccaggctggagtgcagtggtgcgatcttggctcactgcaacctctgcctcccaggttcaagtgattctcctgcctcagcctcctgagtagctgggattacaggcgcccgccaccacacctggctaatatttttgttttttgttttttttttttgagatggagtctcactctatctcccagactggagtgccgtggcatgatctctgctcactgcaacctccacctcctgggttcgagtgattctcctgcctcagcctcccgagtaggtgggattacaggcacccgccagtatgcctggctaatttttgtatgttttagtggagacggggtttcgtcatgttggccaggctgatcgcaaagtcctgacctcaggtgatcccctcactttggcctttggaaggtgctgggattaccggcatgatctgcccacttcggccttccaaaatgctgagattataggggtgagccaccccgcccgcccaggatgggacttttggttccggctccttcccggccgacaaatcccttcctggggccatgacttggtgaacccagggacccaacagggtgagcatagactctgaatcaaagtccaaggatgtaccacagtaagaaagtgtgtgcatccagaaccgaggccagtagtgccacatttgacactatgacatttccggtaattgccctccatacagttttaatcatgcatttgctctgagggttcactccccagacctctcccatccagagtacccaggggctatttcttacattttacaggtgaggaaactgaggcacagacaggccacatatacacctcggcttcctcctcgggaagaaacagggatgaaggaggaaggaggggtttcctgaaaccatagcccagctcacacacctggacttccccaaccccagagctcccaacgctgggtccaggctagaatctcctagagattcagaggcagcacagggcagggttcgaatcctagccaacccaaccctaaaaatctacaaatctgaggccaggtgcagtggctcacatctataatccagcaccttggggatctgaggcaggaaggtcacttgaggcccacagttaagaccagcctgggcaacatatcaaaaccccatatctagaaaaatgacaaaaattagccaggcatgctggcgggtgcctgtagtcccagctactcgggaggctgaggtgggaggattgcttgaactggggaggtcgacattgtagcgagcggagatcacaccactgtactctagcctgggtgacaaagcgagatcctgtctctcaaaacaagaaaaaaagaaaaagaaaagactacaaatctgtctgattgttgacttccagaacccttccaaatgccagcaggtggcatctggatgtctgggggcacatcgtaggttttcgggtcctggaattattttcaatatagagatggaatctcactatgttgcccaggctggtctcaaactcctgggttccagcgatccgcccccctcggcctctggaagtacaggagtgagccactgcgccgaccccagcttcaggaatctttgaactccccgcagagagcagaggtgccgcaaggtttaacctgcctccctccctccttatcgccatgggcttatccaatcatttcttcacggaacacacgtgggccaacgctgaccgggctctgtgccgggaacccgcaaggcgctgcttgttcatctccagccacggggagctcattccctagcagcgggccagacccaaggtggggtcgtgagccccgagaggggcgagggtggcaagagcgggatggcagaggtggcagccgggaccggagaggggaagaggcatggccggggagggaggagccggcagagaacttcgcctgggccaccaggaaactcagccgagctgggaagagggggactggcaagcggccaaggcggagggaggcaggaaggcgtgaggcccggtgggagggaggaagcgggagaggggcgggagctctggctcaggtaaaaactctttcttcggctcgcgagctgagaggagcaggtagaggggcagaggcgggactgtcgtctgggggtgagtgtcggcagcccccggaggatctggcggaccccagtggtgggggtttgggggtggggaagttgtggctctggagaagcccctgccggtctccaccgcgcataccctgcagatgtgggaacattcgggagccccgagtctcgagaacccggttgccctcacccatccgtaattgtctccggcgttcccaaggccagctcggacctgggtcggggaggaagcctcccccacagctggcgacccgggaccccggcgcccctcccagattgggcgggatcagacccccgaggcggatgccgcttagtcagacttggctgttactgttacctgtgttgttgagattattggccccttggttgggagtatctgggcaagccagcgctggggtccccggttgggtttgggaactgcaggtgacccccagtctctccctgcggttccggtgctgcaggccctgccaggtggctgggcggcattccaggggccctggctgcgtggcatggacacattgctgaaccggcctcagtttcccctccgtgaggtggaacaatgaaccagctgggatgaggatgcccgaagcgtttagtcaaaggaaatttttgtgatgaggtgtactgctggccactgggggcccttgcgtgactggcgttaggtctctgagcctcagtttccctgtgtgttaagggggggtctcatggcatgggaccttggcgaggatgagttgagtggataggagctgtggccactcagtgggtgcccagggacagtcagctgtcatcataattatattaattatgtctgtagccactgttcagattcattcctgttccaagaatcccgaccatcttttcctctgggtcagatttaaactttttgtttgtttgttttatttgtagaggtgggggactcactttgtcacccaggctggagtacagtggctccatgcactgtattcactgcagcctcaacctcctgggctcaagtgatcctcccacctcagcctcccgagtagctgggactacaggtgcacaccacaggcagctaattttaaaatttttttgtgtgtggagacggggtctcactatgttgtccaggctggtctcaaactcctgggcccaagcaatcctcctgccttggcatctgaaagtgctgggatttcaggcatgagccactatgcccagctctgatttttttaaatggacacttctcaagaggaaactgaggtcgcccctcaacttgggcgggggactcctgcagtccagatctgggattcagggcccatgggaagccacctggccgtctaggtctggggccagccctgggggccatcacttcctcccactggcctgttctcaaggtgacaccaggcagggctggtgtcaggaggaagaggtgtggcccccaggtcaggcagctgggcccccacatggcctaggtgagcagttgggtgtttgctcagtccagcctggacaccctccctcactctcacccctagggtgtggcatttcctggcaggtgctctgggtgtgggagaaccaaaagggggccttggtgcttctctgttccaggccagagttcaggaatccagacaagccaggtcagcccaggaggagcaagtaagggctcactgagtgacatttcctcctgccaccagcctctgaggcccagagcaagcaggaatttgctcactcccccaaccccatgagccagggaggatgcctattgtggaccctcttcctggtgggaatctggcttgccttgattgctcctcatgatggtgaggtcactaccaacgtggcaaactaaaggaaatctcatcagctgggagttaaagacaggaactaggctcccacccaacctttcttaggtggatttctaggcctctctgtgcctcaattttcctatccataaaaatggagctaatgcagccctacttctcagcacacatatagagtttagatggacagatggtggccaggctgcacacaggacctggcatattgatcctagtcctaattatgcagctcattatgttatcatttatagcatgtatctttgcacacagaaataatatcatgaatatttctgagctctaagtacaagacttggagaagagctctgaccagcctgaaggtgtgggggtccaggaagtccccagaggaggggcccaggagacctcagttcccccatcactcctggattgtgggaagggtctgaggttgaactgcgatgcacggcctggcttcccagcctgtttccccatctatggagtgagcccaaagatgccctttgagactccactgggccagggctggtgttattcaggggcccctttccagtctcacataggtgccccaggcagttcctgcaatggggtagggctggcatggatgacatacaattagtcatccatgacagagcctcgggacctagaaacccgggacaccaaagtctaaagtgcatgtgtcaccgtgcccaaccccacccctttttccatacccaggcactccctggtgcagatattgagtatatattgacagagaactcactagtacacatggtttcactaaagcagggtccggccattgtgaacttaaaggatttactgggctatttcttcttcttttcttccccttctgtttgcaaaagcaactcctgctccttgtaaaaagggaccagcctatcattactgggaaacccaaactggtaagaactggtgaggaaccacccacaggggctggcagatcagggttcaaatcccaccaacccgccctggcctcagtcggctgtgtgaccttgggcagagttgcaccctctctgcacagatcgtccacctggaccctaggctcccctctggaaggctcagtgagactcctcgggttcctccacaggccaggggctcacaccctctcctgcaagcgtccccaacttccaccctggagtttcttcacccctagaggttgcactcctctggaaaattgtcctgtttgccacttctctgtcccctgttagtggtgtatcagcgtcctgggcacacgagtgtttctctccatcatcttggctgtgtcctcggaacctagacccagatgtggcatacgctaggtgctcagcacttgctcagagcagtcacaactctgcaggtgataagggtggtggcagctgctattaaatctcattgtggctgggcgtggtggctaacacctgtatttccagcactttgggagaccgaggcgggcggatcacctgaggtcaggagtttgagaccagcctaggtgacgtggtgaaaccccatctctactaaaaatacaaaaattagctgggcatggtaacgcacacctgtaatcccagcttc

SEQ ID NO: 53 - DNA, 2936 bp, Homo sapiens
gcgccgcagccgcggagggaggggcggggcgggctccggtgtcagcgaccaagccgcaggtggcggcgagcgcggggctcggcccgagctcaggagatggggaaactgaggcacggagctggacagtgactcagacaccagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaaggcaagtacgtctgggcctggatgcccaggctggaccatggggagatttcctggagcccgattcagggcgactccgacttcgacgatgaagagccccgcaagttctatgtgcacatcaagcctgccccggcccgggctccagcctgcagccccgaggcagcagcggcacagctcagggccaccgcaggcagcctcatccttcctcctggcccagggggcaccatgaaacgccattcttcacagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagctgcacccccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 54 - protein, 889 aa, Homo sapiens
AAAAEGGAGRAPVSATKPQVAASAGLGPSSGDGETEARSWTVTQTPDRHWTGPAGVSTETIRMSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAESKGTGREKPGPLDFEAYSAAALQEGKYVWAWMPRLDHGEISWSPIQGDSDFDDEEPRKFYVHIKPAPARAPACSPEAAAAQLRATAGSLILPPGPGGTMKRHSSQRLQSEEQVSKNLFGPPLESAFDHEDFTGSSSLGFTSSPSPFSSSSPENVEDSGLDSPSHAAPGPSPDSWVPRPGTPQSPPSCRAPPPEARGIRAPPLPDSPQPLASSPGPWGLEALAGGDLMPAPADPTAREGLAAPPRRLRSRKVSCPLTRSNGDLSRSLSPSPLGSSAASTALERPSFLSQTGHGVSRGPSPVVLGSQDALPIATAFTEYVHAYFRGHSPSCLARVTGELTMTFPAGIVRVFSGTPPPPVLSFRLVHTTAIEHFQPNADLLFSDPSQSDPETKDFWLNMAALTEALQRQAEQNPTASYYNVVLLRYQFSRPGPQSVPLQLSAHWQCGATLTQVSVEYGYRPGATAVPTPLTNVQILLPVGEPVTNVRLQPAATWNLEEKRLTWRLPDVSEAGGSGRLSASWEPLSGPSTPSPVAAQFTSEGTTLSGVDLELVGSGYRMSLVKRRFATAAPPQGCTW

SEQ ID NO: 55 - DNA, 30659 bp, Mus musculus
  misc_feature (1)...(30659): n = A,T,C or G
gtctcagggatcagactcagatggtgagattttgtatggtgagtgcctttcccactgtgtttctgagacagggtctcacagtggaactttggctggcctggaacttgctctataaatcaccttttgttttctgtactttttttccctctctgttgaggcagggtcacatatgtccattcttgccatgtccttgctgattctgagtcctgattattctgactgcacctcttgagtgttgggacaccaccccacattggttcaccagtgtgccccctcaaatactttcccttctttacagtatcacagaaaaaggatttgttcccatcattgcccctcagcgtaggacagatgtttttggagacagatgttgctgtatacctctggctgtattctcaccacataatccaggcatccaagtcccatccagcctccagcctcagcttgtaaagaattacaggtaaagaattacaggtaagtgccaccacgtcaggctgacattgctttgttttctttttttattacatcaagaactttcaccttgccgggcagtggtggcacatgcctgtaatcccagcactcggaaggcagagacaggtggatttctgagttcgaggccagcctggtctacagccagaactgcacaaaaaacaaccctgtctcaaataaataaataaataaataaataaataaataaataaataataaaaccaaaaaccaaaacaaaacaaaaaaagaactttcaccttttacttcaaggaggctctttatagcttttgtctggcataaccatattgccagcatcaccctactgatgtgctttgggcatcttataaaacttgaatgtaggcatagcaacataggacaatcttcatctataaacaagagggttatgttcaagttggatggtggtaaggcatacttttaatcccagcatttgagaggcaaaggctggcagatctcagagtttgtgaccagagcaagttctaggacactagggtgacacagaggaaaccctgtgtcaataaacaaacagttatgttcaggtgtggttcagcactcctgtaatcccagcacttaggagacaaagacaaggggattgtggtaaatgccaagctagcctgatctatgtaatgagctccaagacattccgggccacaaactgagaccctagctcagaaagcaaggaggggaataaccctgaaaagcaagtagcatcagaaatctgctttctgcaagcaccagatagacaagtagagcacatacatacacagaggcaaatgtgtgtgcaatgtggacacaaccattaaaagggtaaaacagagtgggttggccaaagaaattatcactgctcagagagatgtgcaatttaaaatgtatgaattggtattcttctgaaaattttcactcaatattttcagaccaaaactgaacacaaaaagcttaaaaagtaaaaagggggcctactgtgtcgcctctgtcagttgtgatgttcttaataaaaggaaagttgggtgtggtggtgtatacctatactatcagcaccccagaggcagaggcagggagagtggtggctcctacctgtgatttcaacagtcaggaggcagaaacaagaagatggttgtgatccctctaagttcagcctaaccatggtcaggctgttgaatttcaggctagtcagggttatgttgtaagaccctgtctcaaaaaataaaataagggctggtgagatggctcagcaggtaagagcacccgactgctcttccgaaggtccggagttcaaatcccagcaaccacatggtggctcacaaccatccggaacgagatctgactccctcttctggagcgtctgaagacagctacagtgtacttacatataataaataataaataaatctttaaaaaataaaataaaataagggctgaagagatggctcagtagttaagagcatttgtccttggagatgacctgggtaaggttcccagaagtcagtcacatggttgacagtgattcataatccccatcaataactccagctgcaggagttattgccctcttctgacttgtgcaggcaccagatatacaagtagagcacatatatacacagaggcaaaacacttatacataccaataagataaagcaaaaaaaataaataaataaaagaccaagcgtggcagcatctgtgtataatcagagcattcaagagatgaagcagccttcgttgtatagtaagatcgaggtcagcccgggttacatgaggcccagttactcacatgtctgagtgtttgcgtgtatgtgctctcggaggccagaagagagcattggatcctctggacctgtaggttgcgagctgccagctagtgctgggaactgaatctgggtcctctgcaagagcagtaggtgtccttagtggttgagccatctcttcagcctgacccagtcacttactaaacttatatgtaaattttcatctctgtgtgtatgaaggtcagagctgagtctctccttccacttgtatatttcaaggatcaagctcaagtcctcaggctcaacagcaagcatctttacctactaggctgactccccagtgatcctgtctcaaaacaaaacaaaataaaacaatgtgaaaatgacaagaccatgaaatagaaacaatgctctgttcctggaaccacaaagttagaaaagaaactcagagggatcgatataaagagggaccaatatatgggcaatgtggtgtatatcttcatacatgatgttcattccgttacttaaaatctaacacatgtgctgggcatggtggtgcatgcctttaatcccagcactcgggaggcagaggcaggctgatttccgagtttgaggacagcatggtctataaagtgagttccaggacagccagggctatacagagaaaccctatgtcttagtcagggtttctattcctgcacgaacatcatgtccaagaagcaagtaggggaggaaagggtttattcggcttacacttccatactgatgttcatcaccaaaggaagtcaggactggaactcaagcaggtcagaaagcaggagctgatgcagaagccatggagggatgttctttactggcttgcttcccctggcttgctcagcctgctctcttatagaacccaagactactagcccagagatggtcccacccacaaggggcctttcccccttgatcactaattgagaaaatgccttacagttggatctcatagaggcatctcctcaactgaagcttctttctctgtgataactccagatgtgtcaagttgacacaaaactagccagtacaccctatcttgaaaaaaaaaaaaaaaccctgattgttgggattgttgggactggagagatggctcagcagttcagggcactgactgctcttccaaaggtcctgagttctattcccagcaaccacatggtggctcacaaccatctgtaatgagatccaattccctcttctggtgtgtctgaagacagctacagtgtactcatatatataaaataaatctttaaaaaaaaaacaactgactgttaggagctgggtggagctctataagtacagtgtttacctagtatgagcggccttaaggtccacccacaactcctcatatacctggcatggtagcctataatcccaggattcaggaggtggagacagaaggttactaccctcttgtgctaatgcagatgcttaggagtgtgcagtagaagagcaagtacccagcatgcactgggctatgagtttgatcctgagtcctctccaaagcctgagattctatattgcatttctgtgtaggcttgatcagccagtgccttcacatagccctaaagcaagcagtcaatatctgtaaagtgaatgcatggataaaatgatgagagactatggtgacatcagcccaaaatctcagtttattacagaggcagaaggaataagaggctggcagatagattccctgatctgaaagtcagcctggtctacaaagcaagtttcaggacagccaggggtacacagagaaaccctgtctcaaaacaaacaaaagcaacaaggaaagatctgaggccagcctcgactatatggtgagtccttggagtctaaaggaaagaagagcaagcatagtagcccaggcaggcctgcaatcccagcatttaggaagtagacaggagcatacactgcaaactcaagctagctcggttcctggtctacatagtttggggcagctacatggctagaccttaggggcaaggtctagcaaagggtggaagagaaagaaagaagaactaatttgcagggatgtccaccctcttgccactgccacaggacattgtcatttacaaagttcacacctgaggcttgagaattgagcaattaaattacaaaagaaaactacaaaaggaaagcttataatttttttgtttttctttgagattgagtttctatgtaggtctggatggcctagaacccatggtgtagaccaggctggcctcaaacttacagagatccacccctatctctgcctcttgaatgctaggattaaaggcgtatacgaccacctttcatgttttaagtaaagttttgtgttggaacaagtcataactgtccttggtcacctgtgtcctgtgagctgcacattcttagatatgcttagtctcagggtgaaagcttttttttttttaaagatttatttatttattatatgtaagtacactgtagctgtcttcagacactccagaagagggagtcagatctcattacgggtggttgtgagccaccatgtggttgctgggatttgaactccggaccttcggaagagcagtcgggtgctcttacccgctgagccatctcaccagcccgaaagctttttatcaatgttttccaaagggaaacttttcagagaagtgccagaaggacagccaattctaaccccaggtttccagggtactcaggctagcaatgccaggcacagcccttgcgtagcacccagggagtatatacccctattttctcaggtctaatgagggtgaactcagcactcacccagtggctgcagagaactcaggcttgggtctttccaccttgccagggattgagttctgaaggtgaacgggctgggtacgtgctctgagattgaccccagctccgtcatgattgccttgggtctcactatctcaacccttctgaccaccacctcgcccaaggctctcaacattccttagctggatcaaattcctctattccaaaggctctccaagtgtggttcctgggaattaatgggaaatgtacattatccagctgttccccaagcctttctgctcagaactcagagattgggggtgggacccagccattggcggtttcatgaaattgtccagatgacactaatacctgtccaagtctcagatctgcttcttaactctggtgtagactctcagagggacaccatagtctggtttatgcccttccctgttatcagtgcttggcctctggtgggcatttagtattttctgggagcttttgatgtagctcagtggcatagtccttgccaagtctgtgtgaagatccagaaccaatcctccacaccaaatgtatagaggagatagaaaaagaaaaatggttgatatattcgataggtagatgtaccctatgtttaacagcaatggggtggacagcaaccagcaactgtggaagacctgtgctccaggctctgagctcaaaagtttggggaggctgaaaaccgcagcagccaccctagataatacaattctgtgaaactgaggctcagatgggacaagtgctttatattcagggtctcccaggcagagacttggaatcttactgggttgctcagagcggttcctggaacgcggcggccgcgcgtgcgctgtcacgagaaccgcggctgggagtgtggcgaaagtgcggctgcggaagcgcagcgagacccgggtggaggaagcgagcgtcgctgcccggttgcggggttcctggcaccatgggccgcctgcactgcacgcaggacccggtgcccgaggccgtgcgcggagacatgcagcagctgaaccagctgggcgctcaggtggggctcgcctgaacgggggcgggcgggctcaggaatgggcggacgcactccggaggtggggacttagatttgtaggctcctagaggagggaatgaggggattccaaacggcccccggtttgaatagattagggagggcaaatcgactgcaaacgggttgtgggtgtcagtgtggtccggcctaagtggggccctgggcctgagccggaagaggctcagacaggaccggtgaccacacccctttccaatccaggaaaggaaccatgcctgttttgaaggcccggtccctgttgcagagctccgaatgccacctcctattcacattgcaggaattggccaagtgaggggcgtctgcacggaataaacgggtgacagtggtccttgtcaatgccggcacttaggaggtgggacttaagatccagctttcactaagtatcttttttggttggttggttggtttggttttttttttttttttttttttccgagtcaggatttgctcttgctgtgctggaactcactctgtagaccaggctggcctcgaactcagaaatccgcctgcctctgtctcccaactgctaggattaaaggtgtgtgccaccaccgcccggcttgattaagtatcttgttcaagcctcgtctgaacatcatgagacctcctgtcaaaaaaacatttaaaatagataaataacccttcgtccctcaagatgtttccctgacggggtcttagcttcccaggaagtggggccctcaaccccagacacacacaggccagtttgaagaattaaaaacaaacaaacaaacaaacacagagtagtactcaccttaacttcagcatttggaaagccaaggcaggtcggtctcttaattcatgagttttagactgtccagagctgcatagtgagaccctatatcaaaataagtaaataacaaaaatagaatttattagtagtccatacctgtcattgccacctcttgaaagaaaggtggaagcagaaaaattgcaaaactggaaccaggaattcacaaccaaatgtctaacttcaaaggccagggaaatggctagattttgctgttgccactgatttctggaagactcctatttggaggggttagaggaggagaaagagagattctactgattttttttttaaaggttatttcaaagtattacattttatatgttgtgggggaggtcagagaacaacctaaggaagtgagctttgacacttctttgtgtaggttccagggattgaagcaagcatctttgtcagctgagccattttacgagccccaagatttttcttttttggctttgagacagtctctctgtcccctggctgtcttcagatttaagttctccctgcctcagcttccccaagtgctgcgattccaggtgtgtgacactgtggtcagatatctattaatccccactaggttctgtgtggtggcttgctgttgtggttttctcttttatttttagataaggtcttgtaaccctgactggtatggaactaaaaaccatcctccactctgccttccaaggctaggattctaggcgtgtaccattcattatgcctggccttgtttgagtcccattctcaataatttgctcagtctggccttgaatttataatcctccttcctcaacctcctgaggacctgaatttatatacctgtgccaacaggctcagtcagctctttaataaataaataaataaataaataaataaataaataatttagccatgtagcctagactacaagtttgtgattctcctgcctcattctctctgctggggactggtttatttgttcctggatgtaaggtctcactctgtggtccaggtagcctggaacttgccagtgtctctgaggccccagtgagaggttttcaggagtgtactaccatgcctcgctgaatttcacttatttgttcaaataaacaatatttgttgataggttttctccagtgatgaaataaatcaatttaagtgaacttaaaaagtacaaaggttggggcaagggggtgcggactggagagatggttcagtggttaaaagcactgactgctcttccagaggtcctgagttcaattcccaacaaccacgtggtggctcacaaccatttgtaatgagatccaacaccctcttctggtgtgtctgaagacagctacagggtactcacatacataaaataaaaagtacaaaggcacatttattgagggcagctctctctggcaggttcactagtcccaaggaaggaggccagagaagttgccatgcagacagggacacagaggggagggggaaagggagggagggaggaagaaagaaagagggagcacatgcatgcagagagagagaaatgcagagggagggaggaagagaaagagagaaggaatgcaaaatgtctagattatatacaagagcctctggggaagcccagcccttgggttggaaagttcagggtagaacatgggctgtggcagccatgccctgtaacaggtagggattgagggatgctgggagatcctggaggccaggtgagctttggttaaataggcacctcagctgcttgcagagaaaaagctctatacaagcgtgaatggaacagatatgaaccatatactttttgcaatggaattcataatcccagagctgtgattgataataaagttagatgtgcattatactgttgtcctctaggaaggctggccagtactccctagagccaacaaagtagagtttgtgttcccagacttggtttgtaggtccagtaaatgaagaggtatctactttcactggttaacgtttcccctaactgtagtctagagcaacctcgagcatcttttctgtttatttgggataatactttaaatagctgatgagcccggagcagtggtgaatgcctttaatcccagcactggtgaggcagaggcaggcacatctctgtgagttcgaggccagactggtctacatagcaagctttgggccactcagggctataaaatgagaccctatctcaaaaacaacaacaacagaaaaaatagagagaccctaactcaatgaggtagaagggaggaaccagcgcttgaaggttgttctctgactaccccatacacccccaaattaagcaaacaaacaaacaaataaataaggggggaggggtgagcatggtcaagacgcactgtataaattctcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcactgcctgctcttacaaaggactcaggttcagttcctagaacccacgtggcacctcacaaccctctgccgtttctgttccatagatcccatgacacatacatgcaggcagaatactcaggcacataaaataaacctgcttaatttttttttttgtggggcgggagggaggtgtttcgagacagggtttctctgtatagccctggctgtcctggaactcactctgtagaccaagctggcctgaaactcagaaatccgcctgcctctgcctccttcccgagtgctgggattaaagtcgtgggccaccaccgcccggctctcagatctctctttttaatatatatgtgcactgtagctgtcttcagacatacagaagagggcttcagatcccattttagatggttgtgagccaccatgtggttgctgggaattgaactcaggacctctgagtcagtgcttttaactgctaagccatctctccagcccaaattaaacctttttaagaggtaagtaaacaactggcttgtttgttctgtctcctctctgcaggtggagcgatttctggctcagctctctgaatttgccaccagcaatcagatcagtcttggccccctcaaaagcatcatgaaaagcctccttctggttccaaatggtgagttgactgtcgacaggtctccacagagacactgttgctgcccgagccttcctttagttagggagttacaggagcagtaaatagccagacctggcagggcatactgtctggagcagaatgcaggtgtggagttaagtgttacagctctccgtaagttccgtggtctgtgtctcaaccaaccatgaaaggaccaatagcattttataaatcagaagtgatagcatgcaccttaaacattctaaaaaaattgtgcctatatgcagcatggatagacatgcttttgttcattatttccaattaaagtggtataactagcgtttccatgtgtttacaatatgttaggggccctaagaaactgagagatagttcaaagaatgtagttgctttgattgtgtgtcagtactgtgtcatttcatctgagggacttgttagtctaagaggcctgcgacctggtgcccagaggatgccaggggcagtatgctgacacagcagaagagccatgccaagggggcagctcaaagctaggtctctgtccatcctatatttcctaaacccagaaataaaagggtagggttctccagtgtcacttgagtcaatcaatctctctctctctctctctctctctctctctctctctatctctctgtctttctcagagtctctttttctcagacagagtctcactatatagacctggcaggttttagttttctgtaggaagcaggatggtctccaactcacagagattttcttacttctgccagttcctctaggatcaaatgcatgccctaccccagggggtgcttttcctcttgtgatgtgatgctgggcactggaacccagggcctcgcccatgctgaaagctattcccctagcccctagcccatacttttgtttgtttgttttgagatagagtctctctgggtagtctcagctgccctgaagcttagtatgtagatcaagtggccttatttattgtatatgagtatattgtgcctatcttcagacacaccagaagagggcatcagatcccacatgtggttgctgggaattgaactcaggacctctggaagagcagtcagtgctcttaaccactgagccatctctccagcccatataatggattttttttttttttttttttttttttggtttttcgagacagggtttctctgtgtagccctggctgtcctggaactcactttgtagaccaggctggcctcgaactcagaaatccacctgcctctgcctcccaagtgctaggatcaaaggcgtgcgccaccaccgcccggctataatggattttttaatgcagtttttttttttccttttctcttttttgttgccattccatgtttgtatatgttcaggtacatgtgtgtgcacatgcatgtgtgtgcatgtgtgaggaggtcagagccaaacactttgtttttgagaagggtctctcatgggcacgaggctcatctattaagctagctggctggccaggccccagtgctgggattcaatcgagcatcaccaccaccacccagagctttactaagtgagttctcagggctctgactcaagcctcatgcttacacagcactttctgaccaagctgtttggtttgtttgcttgcttgtttgttttttggaaacagtgtctcactttgtagcccaggctagtgggatacttgctgtgtagccctggatggctttgaactgtcaacaggtctcctatctcagcctctgaggactgagatcacagaacttctatcttgtgtgctgtgccttttttattcatatctctagaaattaatttttattgcatttcatggaaatatcactgcagagctgcagatggtttttgtttgtttagttggtttggcttactttttgggtttgtttttgtttaagatttatttatttatttatttaatgtatatgagtataaggtagctgtactgattatggttgtgagccatcatgtggttgctgggaatgaaagttgcccactctggtcagccctgcttgctccagtcggcccagctcgatacctaagtacactgtagctgtcttctgacacaccagaagagggcgtcagatctcattacgcatggttgtgagccaccatgtggttgctgggatttgaattcaggaccttcagaagagcagttagggctcttaactgctgagccatctctccagcttggtctttgtgttttctgagatagggtctcattctgtagtcagaatggcctagaatttgccatgtagaccaggctggcctggaacccaagagatctgcctgtctctgcatccacagtgctgtgattaaaggcaaatggcaccaggctaaaaataaccttttatttggttctctagaacatactacttgccaggctgtgttggcacactccttctatcccaccactcaggaggccgaggcaggtggattcagagtttgaagccaacctggtctatagagcaagttccactgaaacagccacccacccttgtcctcaggtctcactgctcccagattgggtttgtttgcaagtagctgaccacagctcattcccaaatgcctacttatctatctgtgaaagataagctatcagaaggaaatcttgcctcccttgttcttggttcctcattgtctgctgaattgtgttctggtaaggccatagttctctagcacggagggggtctagatagggcctaacctgaactgatttggtgtctgtgcagggggtgcttcctgcattctgataatcaccttcttcagggatgaagtggagccaatgggggttccctcaatccattgttggaaggaagagctggtgataaatagctcagtggcagagcacctgtctagagtccacaaggccctggtttcaatctctagcaccagtggagacaaaacagaataggtggagagagataaagatgtgagtggaggctgcctttccgggttctcacctatgtggccttgtgcagggccctgcttcagctgctgcttttagttcctatcaagctgcctggtccttaggggtcatccattactgacctttcttttctattaaaggtaattttccatcccagctccccaaagatccccatcaaacagtggtcacaagattgtatatggctctctctctctctctctctgtgtatgtgtgtgtgtgtgagagagagagagagagacagagaaaaacagaaagagatttctttttcttacttttgctaagagacaaaaggactcattaaatttcacattgctaaggcatggatgtgctgttttcctacagttggtgtttagctgatgctggcctgtgggctcaggactgccagcttcctctgcttttctctggctgctgacctttcaatactctgtgtggtttgtttgtttgtttgtttgtttttgttttttcaagacagggtttctctgtgtagtcctggctgtcctgggactcactctgtaaaccaggctggccttgaactcagaaacccacctgcctgcctctgcctcccaagtgctgggattaaaggcatgcaccaccactgcccggctttatacttcttatattactaatatgatctgtctctcagtggaacacaagcctcactagggcccatgttactgtctgtgtgggttactaatgtctccctgtgtctagcatgctgctgacacacagcaggaattctgtcagtatatactgactgccaccctgctctcctctgcgtctcaaggggtggattcagctggccagcctccagggtgagtggttcagtgattactttacactctctgccacctactcttcctacccccaccaagccttccatacccaggtggagactgcaggcctgtcccctgaccaccaggctgacattgatttaggtaccaccaaagaatacagcttaaaaagcagccccagaggcctcagggagcctcatctttgtaaggtttggcttctgcttgcagaagtaactgcagaatggagagcctgctcgttggtgtctagagctctgcctgctgtgttcgtccatcccagctgggaagttgcccagaactggtcatcaggacagaccatcaagatattatgagttaaaggaactgctcccagggctcccccaagtctgcaagccacttagatattatacttgttggcatttgtgtttataatagagaaaggtacaagctgactcctttaatcccagcataagagaggtggatgcagaagggtcaggggcttaaggacattctaatctacatagtaggttcgaggcggcctaggctacaagagactctcaaaaagctgggtatggtagtgcacacctttcagtccagtgctcaggagtcagaggcaagtggatctctgtgagtttcaggccagctaggttagctagggctacatagtgagaccccgtttataataatgatgatgatgataatggaaatattattccacagttctaccaccttcacattagagaggaagagggaaggaagggaaaaaagaaaagttggcacgtggttgtcatcccagcactcaggaggtaggatcaaaagacagggacagggacaggtgctgtctcacacctttaatcatcacagcactctggggacagaggcagatgaagctccaagttgagaccagcctggtctacacaaagaaatcttgtctcaaaaaaaaaaaaaaaaaggcggaggaggaggaggaaggaaggaaggaagacaaaaagagcagaatatcctcagctatacagcaagttttcagctagcctgggctacataatactgtcacaaaacaacaacaacaaaagccttaatttttttgttattttttagctcacttgttttatgtgctgtgtacatgaatctgtctgtctgtctatcttccttcctttcttccttcctttctttctttcttttttttttttttttttggttttccgagacagggtttctctgtgtagccctggctgtcctagagctcactctgtagaccaggctggcctcgaactcagaaatccacctgcctctgcctcccaagtgctgggattaaaggcgtgtgccaccaccacccgactttcttttttctctctctctctctctctcccccccctctctctctctctctctctttctttctttctttctttctgagggtgttgctaatgctaggcaagccctctaccactgggctacactgtcacattcacaatgcatttagtttacttgtagttattcgtgtttgtctggggtggccggtgaatgcagatgccctcgcaggccagagacattggatccaactgaatccagagttatggggggttgtgggtcaccctagatgggaacaactcaagtcctctgcaagataagtcatctctccagcccttttttttttttctttttttcttagacagggtttctttgtgtagccctggctgtcttggaattcaatgtgtagaccaggctggctttgaattctcagagatctgcctgcttctgcctccctgggctgagattaaaagcaagtgtcaccactgcctgctctcacaggccatttttaagtgtccggtcctttctgaaggcttgagattcatagaggtttgaatgcagtaggggatgagccctgtacagatcagggaagactgtttccaacaaagggaccagtgaaagccaatacccagtggtaccttggatcaatgtggacctagggatactggcgtgatggccaccacttataattccaacattgaggaagctgaagcaggaggattatcaggagttaagagttttatttagccgggcgtggtggtgcacgcctttaatcccagcacttgggaggcagaggcaggcagatttctgagttcgaggccagtctggtctacaaagtgagctccaggacagccaggactatacagagaaaccctgtctagaaaaaacaaaaaagagttttatttagtcccagttcccacagctccaaggaaactaagtaagctatatctccaaactccaatctctttttttgggggggtgaggggggtgcgggggactctttcatgacagggtttctctctgtagatcaagctggcctcaactaagagatcctcctgtccctgactcccaagtgctgggattaaaggcgtgaccacctcactcagctgcactcagccttttcctagacttcctctgtgccaggctgccttggatctcctgtcctccatccctggagggcactgaaccccactgcgcaggtgcgcggctgccctgccccaatggtggcttccgggctgcattttctcgtcagccactggatcgagaccgttacttttgtcttctgtgtcgcatagtttgggtccaaaaaatacttgtaactgaccactgctttcatttacactttatgctctctcccctgcctccaaggtgcactgaagaagggcctcactgccgagcaggtgcggactgatctccagacgctaggtaggtctttatctggggttgcctggggaggtggagggcccgtgagctctttgttatgttaatatccttctgttctcttacaggtcttagcgaggagaaagccacttacttttctgaaaaggtataattctagtaatcaaggttaagagcctggcttttattttctgaaaagaaaaggaaaggaaaaaaaaatgctgagcaagacaaaaccattccgtccccccagcgtcgcaggaacgacacacctgcagctgccaaccagccctgcttaaggcagccctaatttttctcctttcgcttgacaaatattaatgccattgttccaataggattagatcttgggatgaaaaaagaatatttaaattgggtatagaggtgcctgcctgtaatcccagcactgggagtcaaggccaaccccagatacagagaaaatttaaggtcagctgggcttcctgatgccctgctgaaagaatgattgtattcccaccatgtcttggatatgtgcgagcaggtggactctgttcttggttctgctttcttctctgttgagagctgagcacttctgtgcttagagcagaggggtagggatgctggtccccacgctgacgctagcctttgcttttcttctagtggaagcagaacgcctcgacccttgcacagtgggccatgggtcagaccctgatggttaaccagctgattgatatggagtggaggtttggaggtaactggatagatccaatcccggttacttgtgtggctggcctggggctggaaagaggcttctggaaagcctggttggggaagacttgtccttgatctcagacaccgctgggggccagccatttttctggttcatgtttaccccaacatggctgctcaggacagcctgctaaattgagctcttcagaagtcctcgcttagtcctctcttctctgtgtgttacagtgacgtctgggagcagtgaattagagaaagtgggaagcatatttttacaggtaagtctgtggtcagtggcgatgggcagggtttcaacctggttaaaggttatccaaagctgggcatggtggcacaggcttgtaaacccccatatcaagaggttcgaacatcaaaagttcaaggtcagtttgggttttgtgagccactttctcgattgttttgtttttttgttgtttttttgttgttgttgttttttgttgttgttgttttttgttttggtttttcaagacagggtttctcttgggtagtcctagctgtcctggaactcactctgtagaccaggctggcctcgaactcagaaatccgcctgcctctgcctcctgagtgctgggattaaaggcttgcgccaccacacccatcttggtttttgttctagtcagtattctggctgtgaagagacaccataaccgaggcagctcatataagaacgcatttaactgagggcttgctcacaagtttcttgtcgacagttatcatcatgtcactgtacaggcagatggagtgctggaggggtagctgagaatgctacatcctcatctataggccacagggagagagaaatgaggcgggaggagggagggagagagagcagacccactctcaacaaggccatagctcctagtcctcctaatactatcaaagtgttgcacttctgcgacaaagcattcaaatatatgggtctgtggcagccattttctttcaaaccactacaggtttgatattgtcttaagtgatattcccccctaaagtgccctttgtacctcagaacagtgtgatcagcggagagcatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacctgggtcaccaggctacacactgggccatcttgctggcccatcattttaattttaaagttattatttatcttctcgaccttcttcttttcccccctttccttttagttaaagttggtggttaagaaaggaaaacaaactgaaaatttgtatataggtgagtctcaaccacactttgtagcttccgtctccttgcttcagtgccctgggctggtgacgtctccctcacagagcccgtctctctaaggcaaggttatcaccaggctctagagtggcctccactgccttccctctcagagcagggctgttgctaggctattgggaggttggaaagcccgagtggaaggggctgaggggtgaatagtgggagcagattggaggcaagacactggtttttaagatgtatttatttattttatgtatgtgagcacattgtagctgtttcacacaccagacaagggcatcacatcccattacagatggttgtgagccaccatgtgattgctaggatttattttatgtatatgagtacactgttgtagcggtcttcagtcacaccagaagaggatatctgatcccattacagatggttgtgagtgctatgtggttgctgggaacctctggaagaacagtcagtgttcttaaccgctgagccatctctccagcccctggaggcaagaaactcttgtggacatccctgaattcctttgaaaccttccatgcctctgtgtgacactgttatatacacacttcagtgtttttggaactgagacccttgaagtcaaggctgtaggttccttattctgataggttatatatacatcaggagcctcttagctgcatgtagctcaatgcagcccttgctataggcctgggtttgcttcccagcaccacaagaaggaagaaaaggctgctaagattaccagcaagtatagatgtcagcctggagatggagccctgcatacttaaggccctagatctgctccctatcaaatgaataaacaaacgatggctgcgggtagaaatggattttcctggtacttctgtggcattggaaacactcacctcaaactgacttttctctccccagaactaaccttgccccagttctacagcttcctgcacgagatggagagagtccgagcgagcatggagtgcctcagctgaccctgttcctgttcccttgcccctgcctcttccctagtggcagcctactccaggctcccagctgccttgagaggccgcggacaaagagcttctaaaaccaagagtctcagtgcttgaggagtgctgcctgattcttctgcaagccccactgggagccaccacctccggctcctgggtgactttacacctagatgctccgagagctactgcatctgggactgtttcctttctctgggaggcagtcttgtcacctcccatccaacagttaacaaacggctcagttccttcattcagatggttgggtacgtgcttgtggctgaggaagggcgggtggtgtggacagtgtgtcaggagtggtgtcacacgtgtcacactgtttggagggggaagggcattgccagccactgtctgccgtgtcgtctgtgtaaaagcctgtgcttagtcttctctggaaagaactgaggccagacgatttctgtgtttgtctctttggcttttgtgttataaggaggcaggcctttcgaggccatcttacattgtttggttccagaaaaccaaccaccttttggttaagtggtaaattaaaaagaaaaacagtttctaaagaaaagctctgaatccacaaaatgtctttctccatggtttaagagtcagccgacctgggtgtagcggcatatacctacaaccttggccctgcggagacagagacgggaagatcaccataagctagaggttagccagagcagcaaagtgagagcctgtctcaaaccaagccagccatgggggcgagactgacggctctgtggttaagagtgcttcctgctctttggggagtccctggttgctctgttcacagcatccacttctggaagctcacaacagcctgtaactccaacctcacatcttcttatccaagagcaggcatacacatgccatgagtatacacatacacatatacactctgacacacattcattcaataatgcaaatgaaataaatcttctttaaaaggccacagggtgtggcatagctcagttgggaaagtgtttgcctaacatgcataaaacctggcctgggttatgtggccccttgtctcaaaagaatgaaaccagggccagtgagatgacttagcaggtcatctaccccgatgcccgagttcaactcccaggatccacttggtggaaggagaccactgatccccacaggtgtagtctaacctgtacacacccgtgcacacccaagcatgtctactaagtaaagacatcaaattaatataaatatcttaattttagatttggttttcatggtacacctataatagcttacaaccctctgtaagtccagcttcagggaatttaatgcctctggcctccatggatacctgcgcaaatgctcataattaaagataataaatctctagcctgattgcttaaatattcctttaaattctctctttggaccatagctaatctcataagagaactaggggctttcaccaaaaagagaatggtaacttgttgtttgaaaaagaatgtagttaaggcatttctggatggcttggtgctcactgtatacccagggctgtcctcaaactcatgacaatcctaccttgccctccaacaaatgagtgctgggattacaggcatggactccacgcctactctttacaagggaccaaatacagggctttcctgcatgttaagcaaaacacagctgtgttcccagcccaaaaaagttttgttgttctcacatttatttatgtggagttggctgagtcatgtttagggccttgtggattcaagacaaccttcaggatgtgcactcttccttccatccagcagtccgcagcaggataggtctgagtagacatggggaccccttcccacctttttttttttaaaagatttatttattattatacataagtacactgtagctgttttcagacacacagaagagggcgtcagatctcattatggatggttgtgagccaccatgtggttgctgggatttgaactcaggacctttggaagagcagtcagtgctcctacctgctgaaccatctcaccagccccccttcccaccttttgctagctattcactggaggagatctgctagttcattctgtgttctggagctatttcttgcatttgaatctatgtgcatatcttctgtgtgtactatctcacacagacagcagcgtgtataaacaccaacctgcaccttgttttttccagttcacatggagatctctctttatcaaaagcaagagccgcctcagcctttgcttcccccaatgattgatcggaccagtttcctgctggtttgatacaaggtctttttgtaacaccctggatgctctgaaatttgaagattaaagatcttcaccaccattttttatgggtttgtttgtttgtttaattgtaattgcatattacaaatattttcactaagcctaccttggtggtgcacgtctttaatctcagcacttgtgaggtagaggcaggcagatgtctctgagtttgaggccaacctgatctacatagtgagtctcaagacagccagggctatgcagagacaccctgtctcaaaaacaaacaaaacaacaacaaaaaacacccagactttttatttacattgaagggttagttttgtttttttccccattcagtgcataaagattctccatccctttctggctgtaaagcaatttaatgtgttcatgcattataatgttatttgttactttggttactgccagtattcatcagggttctctagagaacagaaccagcagggtgtacatacatgtcactatgtgtgtgtgtgtgcatgcgtgtgtgtgtgtgtgtgtgtgtgtgtgtgtgtgtgtgtgtgtgtgtgtgtttgagttgttttctttcattttgggccattttgagacagtctagaactttttttttttttttggtttttcgagacagggtttctctgtatagccctggctgtcctggaactcactctgtagaccaggctggcctcgaattcagaaatccgtctgcctctgcctcccgagtgctgggattaaaggtgtgcgccaccaagcctttatatttttttcatattaataccgtaagctgattagatgaggctactcacagcacagagtctgctgtcctccaattcgcctcatttaaatttaattccatctcaaaaacacccttaccaaaaccacccagaatggtatttaaccaactgagttaaataccagccatcctggtggatgttcagtgctacacttgactgtctctttgttcttttccataatctttctgtgaagccctgatgctctgaaacttgatgtttgaatctttgttcccaccatcatcaaggtcaccattagaagttccaaggacaacaagtcagttcccttgggcagggtccaggtgtgctgatgagacctcaggggaccttgagaatctaatgtaagaattcacaaaggacgcagtggtgccttaaatctcagcactcagaaggcagaggcagcaggaaagcctggtctacatgcatagcgagagccaggccacttcatagactgttaaagccagggccactctattaaggcaggtgtagtggcacacacctgcaatcctggcacttgggacgctaggacaggaagattggtgcaagttcaaggccatcctggaatacattgtgcacttgcacatgcatacaaaatcaaagcccactcatttcacagcaagggaaactcaggtcactgaccagtggtcatgggatgctgccctgcggtcctctctaagaccagtaaatactctttacctgctgagccatctctccagcttctgttttctccgacacttgcttattgtgggtttgtgtgtagacacatgcggagatcaaaagacacctttgtagaagttggttcttgggactggagaggtagctcagtggttaagagcactgactgctcttctgaaggtcctgagttcaaatcccagtaactacatggtggctcacaactgtccgtaatgagatctgatgccctcttctgaggtatctgaagacaactacagtgtacttagatataataataaatgaagaagaaggagaagggaagaagaggaagaggaagggaaggaagaagaagatgaggatgatgattggaacactagctcagtggttaagagcacttgctgctctttcaaaggatctgagtttggttaccagcacctacatgacagcttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggctatacaaagaaaccctttctcgaaaaaccaaataagagaaaaaaagaaaaaaaaagaaaggttagtccaggagaagaggaaccataactttttgctactcatacacagtagcaaagtgtatagagtgccctaggttgcccggtagggctaaggaggcagtgccctgccattcttcccttcacaccggccaggctcaattctgtcagctttgtctgggagcagcaaccccagactcagcctgctggcgtgtccctttgaggagcagcattcttgtgagatctttcctacagttctggggtgtagagcaggggtctctttggtacccaggggtgctggagtgcagagactgaagagaccaggctacacccttggagaacatgacatcaagtttgagaaacttgagcagcacccaggggaatcataaattctggtagataggctgtgagtggtgtcagaggtccgatgtctagggaacagagggcatgaatgatggggagcagggggcctctgcaggctgagtcagagtgagttgccctgacaggtgcaaggggcaggggtggcggggttcatctttgaactgtatgttcccttcccctgacctgtgcatggaggaagatgggagctgcctggagcctatgggaggcccagtacctgatggtgactgaataagggcttacggaggcttatggagaaaggctgcttccacttcaaagagcccttgcaaagcagctcggtgaagagaggggaatttcctagacaatgcccctgggcttccgctagtgcttagcccagagattgctggagggtggggtttacagatcccaaaatgtgcacaaggattttaggtggaactcagccaagatgctggaagtgtgtcagactccaggtccttagaaacctcaggcatctgctgttcccctgaaaggagcccagaccacaccctgccccagcccttccctccctgttctgtgtaaatcctggatagaggtattcccttcttcctctttcctgggtggttccctcaactataaaacagggatttttaggaagtggggtaaaaagagcaggaatccaaggcaacccctaactacatataaagttccaggccagcctgggctacctgttttaaaaaccaaccaagcaatccacaagcaggaattcattcagatgatctctaaagacatttttgaacagtcgggtgtgtgtgtgtgtgtgtgtgtgtgtgtgtgtgtgtgtgtgtgtgtgtgtgtgtgtgtgcgcacacacatcggtcaaatgtaggcttggtaaacttccagtgtcttcatattttcatttattaaagattttgtttatatatataatatatagagagatagagcaatcctcctgtttgtctcccactaagctagagttataggtgtgcattcatgtccagtttttaacagggatgctagggacttgaactctggtcctcatgcttgctaagctattggggagcgacagcttccttttgagatactgtctcactgagttgcccaaactggtcttaaactggctctgtaacctagtcaggcattcctcagaatcctaaatagctgggattgcaggaatgtagcaataggtgggggctctaggtggggggagggggtaacacagagtgggagtttatggtgttctgggaaggtctatttgagaagctgatctgatctagtcttgcaggatgaagaagcctaacctagtaatgaggcacagaggaatggcacctgcaaaggccctgaggccagtgcatactttgtatctttaggaaacaaagggccagggtaggggaagagaaaacaagggtaattggacagaagtcagcagggggctggggtggggtggggtggggacagatactcagggctaagattaagagctcaattcttcctcataaggctagttcccagattccaatggcgttatctacccttgggagtctctggtgacctagggctggtcatttcccttccatggatctgttttcctttaaggtagattgatccagttataatgtgccaagctgggcccagggagaatgctaggagacttgactctagacgtccacccattaaataaataaataaataaatgcccatcgccatatggtgctggaaacctttggaagctgtcagtgacacttgctcgcgtgttcatacttgagtgaagtccttcttgaccccactcttgtccccagggtggatgctccaccagggctggtttgctgggctgagctggccttacttcatgtgcttttcgtaggtctccttccaggaggaggaaaaagaggaggtctggggaagctggagacaggggctctggccctgaggctgtgtggccgaggagagggccctgtgaaggtgtcattttttatgaatgatttcctgacaggactgactaagactcagccagagctacaagggctggggcgcaggcctcttttccggagcctaatctgcccagggcaggcagctggctccagagacggaaaggcctgcacagctcagaactctgcggtttgggacatcggtggtctttgtcggtttttctcctcccagcttctcttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaagcgggtgggggctgagctcctaggaaagcaggagggagagataagcaaagattctgccttctccacccacgtaccagaccccagctcttccccctggtttattctatcactgaatctaggaatattcaaagaaatatccaaagttctgagaaatcgttcctgggagaaaccctgtgcttgtggctacagtggtagggttttcagatccatctcaaagcctgggcagagcccacagtggctcatgcaggaagtagaggcaggaggggcacttagtgagttctaggatagccagggttatagaagctatagtgtgagaccctatctcaaaaaaacaaaacaaaacaaaaaacaaaaaaaacctaagcctgtgtggtggtgtgtctcagtctgagcgcttggaagacagagggaggtgcatctctgagcttgaggctagcctggtctacatagagagctccaaaccagtcaaagtaacaaaatgaaactgtctcaacaatgacaacaacaaacaaacaagcactagaataaaaagaagtcagcatggtgtcatgtgcccgtcatcctaccacttggaaggagagaagccagtgcaggaaaattagggatccaagactagcctcagctacagtgaatttgaggccagtctgggctccataagtcctgtgtcaagtaaggagaaacagaggctgagctagagagagaggcagctaaggggagtcagggctccggaggtccccgctagggtaaggggtctttccttctgcatgagttcaggaagctttgagaaggtcagccacctacttgccagaagtagggcttcttcctcagtctaccctttattcactctgtggcctgcctcactgggctccgtaagggcgctgagatgagcccaggaaggccagcccctgcttagctttgcccctgccctccagcacaggcctcagagagcagagacaaagaccttaggggctgctgaggtgatggtgcccgccggctccgagactctaatggcaggggtcactgggctccagccccctctagcggtcagcagtggcgatgaattcagagtggagtggggaggagtctctggcgcaggcctcctcccaccgccttgtcagcaggccaagccttggaattttgtgccaagtctctggaaagaggcctgtcctgccagccaagggacagaaaaacaagatgaaaggttccaggagtggcagtagtggtgcatgcctgtaatcctgacccttgggatgtgtagagaagacgactggggattcaaggccagctttgcaaatctgaggccaggttgggcaacatgaaatcctgtctggatagatagatagatagatagatagatagatagatagatagatagatagatagatagatagatagatagatagatagacctaaaaaaaaatacacaggcctggaagctggccccagtctttccttggggactacctctgaatcagtgtgccaactcctctctccggccttactcatgctgaccaggagccaggcaggggtgactacttccatgagtgtagaccttggctggaggagtgagtccgcagaagcacgtgcgtctgttgggactcagtccgctgcccttctggatagccagcacggctgggggtggcaactgatgtcactgcacttttccctgttcagcctcctttgcgttgtgacagatactgacctccccatggaggtcaccatctctttgtttcgcccacagtgctctggtggggacttctgtccctgtacttaattcttcaacacgcctgcttccctaactaggcattccatttcctagggtttgggtctattgagccccatagctgacacccgtttcttgtgaaaagatctttcccgaggagggagagggggaagtgaggtccctctccctaccctttactgggcacttattttttttttaattaggtattttcctcattacatttccaatgctatcccaaagtcccccataccctcctacccagccaccccctgggcacttatttttatggtattagttactgaatccaaggttgctcgctgctccctccccaccccaccccccttttttgagacagggtttctctgtgtagccctggctgtcctggaactcactctgtagaccaggctggccttgaactcagaaatcctcctgtctctgcctcccaagtgctgggattaaaggcgtgtgccaccaccgcccggccactgctccccttttgcctcgggttcatccttggcagagtctggggctgtggtcacttcaaaagccctggacaccagaagaggcagggatgtcaccagggaacggggaagagccatggcttcagcccatatacttcctcttcttctcacacctgccatttcctgactgtgtggtttctgccctctgtgagagctgataaaccaagcctggaggcccagcgctgttcccccatgcctcccctagctgggcttggtcccttaccctgggcggtgcttggcatgtggttgctggatacaggcgtatggcactgtcaggtagactggcaagctggcatgtaacagcgtctgggtttgccaaggacatttgacacactgccctacaagcttgcgtcttggaaggctgagctgagctggctctttagctagattgctacagaatggcctttgctatggtgcggaggttatgagggcctgggctcatggctctttggaagcacgcagtactctcaatactgcctgggccggtgtttacagaaggcggc

SEQ ID NO: 56 - DNA, 995 bp, Mus musculus
caggtggagcgatttctggctcagctctctgaatttgccaccagcaatcagatcagtcttggccccctcaaaagcatcatgaaaagcctccttctggttccaaatggtgcactgaagaagggcctcactgccgagcaggtgcggactgatctccagacgctaggtcttagcgaggagaaagccacttacttttctgaaaagtggaagcagaacgcctcgacccttgcacagtgggccatgggtcagaccctgatggttaaccagctgattgatatggagtggaggtttggagaactaaccttgccccagttctacagcttcctgcacgagatggagagagtccgagcgagcatggagtgcctcagctgaccctgttcctgttcccttgcccctgcctcttccctagtggcagcctactccaggctcccagctgccttgagaggccgcggacaaagagcttctaaaaccaagagtctcagtgcttgaggagtgctgcctgattcttctgcaagccccactgggagccaccacctccggctcctgggtgactttacacctagatgctccgagagctactgcatctgggactgtttcctttctctgggaggcagtcttgtcacctcccatccaacagttaacaaacggctcagttccttcattcagatggttgggtacgtgcttgtggctgaggaagggcgggtggtgtggacagtgtgtcaggagtggtgtcacacgtgtcacactgtttggagggggaagggcattgccagccactgtctgccgtgtcgtctgtgtaaaagcctgtgcttagtcttctctggaaagaactgaggccagacgatttctgtgtttgtctctttggcttttgtgttataaggaggcaggcctttcgaggccatcttacattgtttggttccagaaaaccaaccaccttttggttaagtggtaaattaaaaagaaaaacagtttctaaagaaaagctctgaatccacaaa

SEQ ID NO: 57 - protein, 123 aa, Mus musculus
EAADKELLKPRVSVLEECCLILLQAPLGATTSGSWVTLHLDAPRATASGTVSFLWEAVLSPPIQQLTNGSVPSFRWLGTCLWLRKGGWCGQCVRSGVTRVTLFGGGRALPATVCRVVCVKACA

SEQ ID NO: 58 - DNA, 61103 bp, Homo sapiens
  misc_feature (1)...(61103): n = A,T,C or G
agacatcaaatgaatgaatgcttgttatttatcataatagtagcagttattattattggatgccgtacagtggccctcgtgagaaaaggcttaactgcaaatcaaaatctgtgatttgtctttctggcttttgacttggggtccagagctgaatccactgatttctttctccatcctggcccttgaaagagatgccatgcctcactctgttggacatcacctgtttttgccccttggagaataccccatggccccctccaaatttgatgttgttcatgaaatgaagtaacattgactttattttgttgttgttgttgtttgtgttgttttatttatttattttttttgagatgaagtctcactctgtagcccaagctggagtgcagtggcgcgatctcagctcactgcaacttctgccttctggattcaagcgattctcctgcctcagcctcctgagtagctgggattacaggcgcccaccaccacacctggctaatttttgtatttttaggtgagatggggtttcaccatgttcaccaggctggtcttgaactcctgacctcaggtgatctgcctgcctcggcctcccaaagtgctgggattttaggcatgagccaccgcgcctggtcacattgactttaattcattcacactttgagctttctgagagcagggaccacatctacccccacattaggtaatcagtaaatgttcgtttccctgaagccctgactcatcattatctcatccctcaccctcagacaaaacagaaagtttccctggacctgagttccttcatttttggaagctcaggcttgacttctgaggagggtaagatggttaaggggaaaagttcagcggtctaggttctgttctcattctcctattaacccactgtgtgacctcagacaggtgtcttcccttctctgggcgtctgcttccttcactgtcaaatggggcagatagtgtagcatggaatgaagcccaaaaccttagtgtcattcttgattcatctctctgcttcttggattctacttcctggatttgttctgggtccagactcagcctgctctaccgttttgagataaacatagaggggatggattcttcttgtccaaacctgttcttatctcctctggtcagggccctcagcctccaatcttcacgacgtccatatacacagcatgctgataaccctggctgcaggccaggaaatgattaccaagttatgctgacctgcagagtagagggagaaggtaggggtgacatgcccaagaccccagggcttccccctcaattgctcctttcctaaggccccacagaggctaactgctccatctgcttaccttccctccgccggacaggtttacccccattacacctgttgacagccccccactctccttcctagcatttttctcctttgcaatgtctttccgtgactcttcatataaggtgtgcctccctcattagattttgagcagtgtagaggcagagcagtcatctatcttattcattgctgtgtccctgacacccaacacaggacctggaatatagtaggtgctcaacaaatacctactactggaatgaatgaagcgactcctctatctttcagatgataaaaatagtccagaaaagaaagttctagaggtcagtcccccaagattacaccccggattgtgttcacagcacccagcagtgatatgcattgctggcctaaagcagggcaggccaggcattcactttataatggttctgcagagaaaaacaaagcggacaatagagatccaggcctcattttctcaggcaaagtgattcctaccatgaatttgaaatgaggggtgagattcccaaaaggtagagacattgtcacccacaccctcaaagtaggaactgccaaagggctctttaaaaagcaaatttctagagggacagcttaaacatccattggagcttaggccagaggatcttaaaaaggcttaaactttaccccagaaatcctgccatttgaaggaagatttttgaacaggtaaacaaattcatcaccatgtcctagataaaaattggagaattggaactctcctgtaagtccaacaagagaaatttatctacattaatttacctgtgtaaggatgaaaaactagaggtgaaattgacttatctccctctggcttccagcatgctcagagccaatttagaaattaatcagtgatctccacattaccacatgtgttggctcatttttttccctgaaccattttatccacttttaccttgagtactttgagcatgcatttcttaagaacaaagacattttcccataaccaaattacatttatcaagttcaggaaattgaacattgatacaatattattatctaatctacagtgggtgttcagacttcaattgtcacaataatgtatttttttaattgtggttttaaaaaagcacataaaatttaccattttaactatttattcttatttatttgaggacaagttctcactatgttgcccaggcctagaactcatagacgcaagggatcctcctacttcagcctatcagatagctgggactacaggaaagagcaaccatcttaactatttctaagtgcagagttcagtagtgttaagtacatttattttgtgccaatgtcttttatagcaattgtttacctccatccagaattacacattgcattgttatcttgtcttttttatttattttaatctagagcaattctccagccttcctttgtcaatgactttcatgacatagatgtcaggaatctaggtcaactgtatttttacatttttgttacgtgctttttttttttcttttttttttgagacagaatttcgctcttgttgtccaggctggagtgcaatggtgtgatctcggctcactgcaacctccacctcccgggtgcaagcgattctcctgcctcagcctccggagtaggtgggattacagacatgcgcccccacgactgggtaatttttgtacttttagtagagacggggtttcgccatgttggctaggctggtctcgaactcctgacctcaggtgatctgccggcctcggcctcccaaagtactgggattacaggcatgtgccactatgcccggcccagtttttttttttaacctgaaaatgttcatagtattttcttctagtttttgttagaggatctagcacttgtcccttctgttaaaatgccattgggcaacatgggagatcgttgctgccatggaaatgttctgcgtcttgactgtatcaatgtcaatatcctggtgatgacactgtgggatctgtgcatcgagggaaaccgggtaaaggccacaaggaatgtctctgtatcatttcttaaaactgtatgtgagtctacaatgatctcaaaattaaaagtttaattaaaaaaaaaatgccctttggcatttcagagtgtgaagggttagacctttctcctagggaaaacctggccccttggtgaaactcccagcaggaatcctccctgcctgagaaactacttcttaatgaactcctttcacttgcaggcgcgggggaggggagagggagtgaggactttcgttgccctccacagggacattttaaagtgaatgaagggagtagggtccctcattaaggctgaaatgggggcaggaggttctctagaagagagtcctggctccggcctgcatttcctgctgcaaagttatcacattaacagtaatcactgctccttccttcctctaagagtggattgtgaaggagaaaattggaaagactttttttatctattgcctttgttagttacaaagttcttaatgagaaagaaaagtcagagagttctaaataggcaaccacaaggattagttatgagcatttaattcttgctccatagaatattatgcagcatttttggacgatgtttaggtagcattttatcattgaagccaaaaatgagatttgagatttggaggctaatttagaggacttggatgtctcctctttgggatgtaggggttgtgggttggaaggcgggcagggcctggacccggagcctcatcagggaactgcaccaggtgcctgttcaggcagaaatgctaatttctgggtgttttcagagagatggttcatgggtaatggtttagtttctgcttaccttgaaaattcatccgtccttgtgatattaaaaaaatatattgatacataatatttgtacatagttatggggtatatgtgatattttgttgctttcatagaatgtgtaataatcaagtcagggaatttagggtatccttcacctgaagtatttgtcatttcttttcttccttttttttttttaattgaaatggagtctcactctgtcacccaagctggagtgcagtggcgcaatctcagctcactgcaacctctgcctcccgggttcaagcaattctcctgcctcagcctcctgagtagctgggattacaggtgcctaccagcaagcctggctaatttttgtatttttagtaaggacagtgtttcaccatgttgatcaggctggtctccaactcctgaccttgtgatctgcctgcctcagcctcccaaagtgctgggattgcaggcatgagcctcctcggccggccttttttttttttttttttttttttttttttttttttgagatagagttttgctcttattgctcaggctggagtgcaatggcacaatcttggctcactgcaacctccttctcttgggttcaagctattctcttgcctcaacctcccaagtagctgggattacaggcacctgccaccatgcccagctaatttttgtatttttagtagagttggaggttcaccatgttggccaggctggtcttgaactcctgacctcaagtgatccacttgcctcggcctcccaaagtgctaggattacagatgtgagccaccgcccccggcccttgttcattcattctctctctctctctctgtttttttttttttttttttttttttgagatggagtttcgctcttgttgccaaggctggagtgcaatggcgtgatctcagctcaccacaacctccgcttcctgggttcaagcaactcttctgcctcagcctcctgagtaactgggattacaggcatgcaccaccaggcccggctaattttttgtatttttagtagagacggtgtttttccatattggtcaggctggtctagaactcctgacctcaggtgatctgcccgccttggcctcccaaagtgctgggattacaggtgtgagccaccgcgcccagcctattcattctttataactactttttgtggtatccattagacatcctcatctctaccccatccccatgacatttagagcccagaaggactgaacataatattccttgccttcctagaaatttttcctaaagaaataatcagatgtggaaaagaattgtgtacaggaatgtttattgccatattctttttataagattgaaaaattgaaatgataataataccaagcagttactgagctcttaccatagtccagttgctgtgctaaatgctttataagcattgtcttgtttcatctttccaagaaggttatattatcatttccattttataaataaaaacagaaatagaagcactgaaaggttagtaatttgcctgagacaaaataattagtaagtggaggagacagatgtataaacgacagcaataacacattgtggtaaacattaaaatagaaataatggttcattcctgggtttcagcacacacaaaaaagaaaaagtaatatgagcgacaatcagtagacaatgcaaagtattattatcattatacacggtgtgtattcaaatgcttaaaataaagtcctgcacaaagtgagcacttaaagtggttgttattatttgcacttcaaactttaatgtgcccacaaatcacttgggaatcttgttaaaattcagatcctgaatcagcaggtctagtagacctgagattcggtatttattttatttattcatttgtttttgagacaaagtctcactctgtcacccaagcttgtgtgcagtggagtgatctaagctcactgcaacctccacctcccaaattcaagcgattctcctgcctcagcctgcggaatagctgggattgcaggcatgtgccaccacacctggctaatttttgtatttttagtagagacaggatttctccacgttggccaggctggtctcgaactcccgacctcaggtgatctgcctgcttcggcctcccaaagggctggaatgagattcagcatttctttttctttctttctttcttttttttttttttttttgtgagatatagtctcactctgtcaccaggctagagtgtagtggcccgatctcggcccactgcaacttccgcctcccgggttcaagctattctcctacctcagcctccctagtagctgggactacaggcgcttgccatgacgcccggccaatttttgtatttctagtagagacggggtttcaccatgttggccaggatggtctcaatctcttgaccttgtgatccgcccgcctcgagcctcccaaagtgctgggattacaggcgagagccaccgcacccagcctgagattcagcatttctaacaagcttccaggtaacgcctgcactgctggtccaaggaaccacacgtggagtatgagggattattaaataacttggtgaaatgcgagagtcctgtgtatgtaaaacgaaaacaaatcacacaaccccagtgacctgcgatgtggaaaaagactggaaaaaggccgggcgcggtggctcacgcccgtaatcccagcactttgggaggccgaggcgggtgaatcacgaggtcaggagatggagaccatcctggctaacacggtgaaaccccgtctctactaaaaatacaaaaaattagccaagcgtgatagcgggcacctgtagtcccagctactcgggaggctgaggccggagaatggcgtgaacccgggaggcggagcttgcagtgagccgagatagcaccactgcactccagcctgggcgacagagagagactccgtctcaaaaaaaaaaaaaaagactggaaaagaagagtcaccatattcctatagtattgggtgtcagtttcaagtgaattcctttccttttctgtattttctgtcacatgagctaattccgttccacaaatacagtatttatcaagtgactcagcaccagtcactgtggaagcagaaatgaaaagaaatccagtggttttctccaggatgttaaaaacaaaacaaaacttaaaacaggttcattttattttttatacctaaacagttgatttaacacttaaagatatgaagaaatgtaatgccctgatggggatcttcttttttttttcccccaactatttatttatttatttttgaacagagtcttgctctgtcgctcaggctggagtgcagtggtgggatttcggctcactgcaatctctgcctactgggttcaagcgattttcctgcctcagcctctagagtagccgggattacaggcatgaaccaccatgcccggctaatttttgtatttttagtagaaccagggtttcactatgttggctaggctggtcttgaactccggacctcaggtgatccaccggcctcagcctcccagagtgctaggattacaggcatgcgtcactgcgcccagcccagatcttcttttttaacaaggttaaaaatatttaaaaataaaaattccgggccaggtgcagtggctcacgcctgtaatgccagcactttgggaggctgacgcaggtggatcacttgaggtcaggagtatgagaccagcctggccaatgcggtgaaaacccatctctagtaagaagacaaaagttgggccaggtgcggtggctcgcgcctgtaaacccagcactttgggaggccgaggcaggcggatcacctgaggtggggagttcaagaccagcctgaccaacatggagaaacccgtctctactaaaagtacaaaattagccggggtggtggcacatgcctgtaatcccagctacttgggaggctgagacaggagaatcacttgaacccgggaggcggaggttgcagtgagccgagatctcgccattgcactccagcctggacaaaaagagcaaaactccgtttccaaaaaaaaaaaaaaaagacaaaagttagctgggtttggtggtggccacctgcattcccagctattcgggaggctgaggctggagaatcactagaacccgggaagcagaaattgcagtgagccgagattgtgccactgcactccagcctgggtgacagagccagaatctgtctcaaaaaaaaaaaaaaaaaaaattcttgcacggtgagtagggcctctgagttcctgtctgtttgtcacccgaaggtttattctcttccaggtactccaaactcggactgtgtcctgtacacattctcaaagcacctcctactttttggcatcccttaatactttcacacacacttgcgtctgccccctgggtcaattctgacttctcagaggccaggcactgcatctggttcatctggttgtgtcactgtggaatccccaccccctatcatgtcatggtatctgcctcacagcagaccttcttttttttttatggagatgtggtcttgctctgtcgcccaggctggagtgcagtggcgccatctgggttcactgcagtcttgatctcaagatctcaagtgatcctcttgcctcagcctccgagtagctgggaccacaggcatgtgccactcaatatttgttgaatgaatgtatgaatgatataatgactgaaggggatgggcttggcctttgggtagaagacttttttgttttttctttgagacggagtttcgctcttgttgcccaggctggagtgcaatggcgcgatctcggcttaccgcaacctatgcctcccgggttcagggaattctcctgcctcagcctcccgagtagctgagattacagacatgcaccactacgcccggctaattttgtatttttagtagagacggagtttctccatgttgaggctggtctcaaactcctgacctcaagtgatccgcccgcctcagcctcccaaagtgctgggattacaggagtgagccaccgcgccgggccgggtagaagacattttgtttatacttttacagaagggattttcaggaaagggtagaggagaggaggagggctggtgaggaaggccagccaaaccccccacatttccctgctccaggtttctcggcattacctctttaccctcaaggctggacttaggggctaggtgaagcccttaggcttggcgttcagttcctagattctgggtagcatgtctctattttctcatgtttccagtggggattagggtaatattcacctgggaactgtgaggagcccctgggaagagagggcatgggggttagagtgtttgaggggctgcagtgatgatcacggtctcagtaacctcccctcacccacctcaccaccaccctccctgccccgcacagtcaaagccctcgcactattttgaggaaactttggtaagtcagtttcttccactccagaaggtctcaaagtgtagtccctgggtgcttattggaaatgcaaattctcaggctccaccctggcctttcgaatcagatcctctgggggcggggcccggcaataccaggtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcaggtgggcccggcggcggggcgtggggcgcggggcccaggtgattccaggatccgggcctggggtgggggggacgtccgggggtgcgcgggagttgggagagactagacagagcggcgtcttgtgggcgtttggggtgtgtgaggtgggttcggggcgaggctaaggtgagctggggtctgaggagagtgtggggagccaagggatctccggaggcctaagggccacctgaggggtccgaaaggctttgtggggtctcagagatgggactacgggacctctgcggggtcctggggccgaggagagcttttggggtcctagaagagggacggaggggagtctagatgaggctgaaggagtttggggaactgaaggaacagactaagggcgtggggagttttggggagcagtggggtccaaagggagatagatgtttggcagggaggccgaggaagcctgaggggagtgggagggcccgagaatctgagggggcccggggaagcttggcctgggctgccgtcttacatctcagtgtgacatgagtgtcagtaatagccaggccccactggggctctgtgggcctgaggggctcgatctgggacaaggctgatgacaccttccacctccacccagttaaggagagtcactgggattcacatggaaagaaaccttatacactgtgtacagtgggggtcttcatcctcgatggtaggggagctagcaaagcctttttctcccccttcaggctgcaggtgccaaccaaggcagtcttggaggcatcctgcttctgtgctggttgggatgccttttcataccaccaaggctgctgaaataggtgagaatgacacttctcacccccactgggaagatacatctatttcccccgctaggttgtcacttcccaggaggtagcgcccctcttctttcatctccataccccccacaacttcccacacagtagtgctgcttgcgagataaaaaccaaacttagaacttgtaacaacaggaaggttctaagcttgagctatgcaatagaaaaatttgcaagccacatttctaactttgcattttgtagtagccacatttaaaaattaaatagaaatggaaattaattttttttttttgagacgtagtctcattctgtcacccaggctggagtgcagtggcacgatctcgggtcactgcaacctccgcctcccaggttcaaccagttctctgtctcagtctcccgagtaactgggactacaggcacacgccaccatgcccagctaatttttgtatttttagtagagatggggtttgaccatgttggccaggctggtcttgaacacctgacctcaggtgatctgcccacctcagcctcccagagtgttgggattacaggcgtgagccactgtgcccagccctgagtttatcttatgcaagcatcctagagtttatttacacaaacctactgcaccctaggatatatggtatagcgcattgctcctaggctacaaacctatacagcatgtgactgtactgaataccataggcaactggactataatggtaaatatttgtgtgtttagacaaatctaaatagaaaaggtacagtacaaatacagtataaaagataaaaaataggccgggcacggtggctcacacctaccctaggactttgggaggccaaggtgggcggatcacaaggtcaggagatcgagaccatcctggccaacatgatgaaaccctgtctctactaaaaatacaaaaattagctgggtgtagtggcgggcacttgtagtcccggctactctggaggctaaggcaggagaatcgcctgaacctgagaggtggaggttgcagtaagctgcgattgcaccactgcattccagcctgggcaatagagtgagacttcatctcaaaaaaaaaaaaaacaactttctagttgggtacggtggcacagctaccacagtagtcccagctacttgggaggctgagacaggaggatcacttgagcccaggatttcaaggctgtagtgcatggtgattccacctgtgaatagccattgcactccagcctgggcagcatagtgagacccccatccctaaaaaaaaatttttttttttctgtttttgataagttgaccttagcctactgtcagttttttttgtttgtttgtttgttttagacggagtcttcctctgtcacccaggctggagtgcagtggcgtgatcttggctcactgcaaacttcacctcctgggctcaagtgattcttttgcctcaggctcccaagtagctgggactacaggcgtgcaccaccatgcctggctaatttttgtatttttagtagagacagcgtttcaccatgttggccaggctggtcacgaactcctgacctcaagtgatctgcctgcctcaacctcccaaagtgctgggattacaggcgtaagccatgcaccctgccaactgtaactttttacttcatgaatgcttacctttttttttttttttttgaggcagggtctcgctctgtcacccattgctcactgtagccttgatctcctgggttcaagcaatccttccacctcagcctcccaaatagctgggactataggcacgcgccaccatacctggctaatttttgtattttttgtaaagacagagttttgccatgttgcccaggctggttttgttaaactttttggctcttttgtagtaacacatagcttaaaacacaaacatggctgggcgcggatttctgtgacaatcactaggtaacagggatcttttacctccattataatgttatgggaccatcattttatatatggtccatcattgatcaaaatgccatgcatgcttaaatccacaatatcaaaatatttttcaatatcttacccatatacaaatatcaatgacattttactttttggtacaaagttttctaaatctggtgttttacacttacggcacatcttaaagtagtttagcccttttctttttttttttgagacagtgtctggccctgttgcccaggctggagtgcagtggcgtgatctcggctcactgcaagctccgcctcccgggttcacgccattttcctgcctcagcctcccaagtagctgggactacagctgcctgcgaccatgcccggctgattttttatatttttaatagagatggggtttcaccgtgttagccaggatggtctcgatctcctgacttcatgatctgcccacctcggcctcccaaagttttgggattacaggtgtgagccaccgcatccggccagcccttttctttttaaagacagtctcgctttgttgcccaggctagagtgcggggatgtgatctcggctcactgaaacctccgcctacagggttcaagtgagtctcatgctgcagccactcaagtagctgagattacaggtgttcaccaccatgcccatctaattttttcttgtatttttagtagagatgggctttcgccatgttggtcagggtagtctcgaactcctgacctcaagtgatccacccaccttggccccccaaagtgctgggattacaggagtgagccaccacccctggtcagattagcccttttcaagcgcttatgtggcaagtggccactggacaatagggatctaagtgcttttatgtattttttttttttttttttttgatacagagccttgctctgtcaccgaggctggagtacagtggtgcaatctcgactcactgcaagctccacctcccgggttcacgccattctcctgcctcagccttccgagtagctgggagtacaggcacccgccactactccctgctaattttttgtatttttagtagagatggggtttcaccgctttagtgaggatggtctttatctcctgacctcgtgatccgcccgcctcagcctcccaaagtgctgggattacaggcgtgagacaccgcgcccagcttatgtatgttaactaattgagtccttgcaatcacttttataggtagttgctgttattattttaaattgagacagggtctccctatgttgtctaggcttgtcttgaactcatggtctctggtgatccatcttggcctcccaaggtgatggaattacaggcatgagccactgcacccagccacttattattattcacattttacagacgaagaaactgaatcacagagcagtgaaatgaacatagctattatacgatattaatatattgagcatgcaccatgtggccaggcaccattttaaatgtatgcataacaactctaaaaggaaggcactattattattcccattttacagttaagaaagatggttcagagaaataaattgacctgtttaaagtcatgtagacaggagttcaagactagcctaagcaacgtagcaagactccatctctacaataagataaaaaattagccaggcatggtggcacacacctgtagtcccagctactccagaggcttaggtgggaggatcacttgagtcagaaattggaggctgcggttagctatgattatgccactgcactccagcccagagaacagaccagaccctgtttcaaataaataagtaaataaaatcatgcagaaagccaggcaaggtggctcatgcctgtaatcaagcactttgggaggtagaggtagggggatcacttgaggccaggagttcaagactagcctgagcaacatagcaagaccccatctctaggaaaacattttttttcctttgagatagtctcaatattgcccaggctgtagtgcaatggcatgatcttggcttactgcaacctccgcctcctaggttcaagtgattctcctgcctcagcctcccaagtagctgggactacaggcgtgcaccaccatgcccggctcatgtttgtattcttaatagagatgaggtttcaccatgttggctaagctggtctccaactcctgaccttgtaacctgcccacctcggcctcccaaagtgttgggattataggcgtgagccaccgtacctggccaaaagttttaaaaattagctgagagtggtggtatgtgcctgtagttctagctacttaagtggctgaggcaggagaatcccttaagcccagaagtttgaggctgcagtgagctatgaccatggcattgcactccagcctgggtcagaaaatgcgaccctgtctcaagaaaataaataaataatgtcaggcagccaggaagtgatggagccaggaatttaggatcacgtgtttggcttcaaagcctatggtggtagcttagcttttacttgttaatgtatcagtgttctctggaagatatccatttggagaataaaaaaagattctgctactaacaaagtttttttcttttttttttttttaagatactggattgtatgatctgtaaaattacctccagcttggtattcgtagaaaatacaaaccacttcctttgagatcagcacttgactcattttctttttttttttttaagacaggacctcactctgttgccaaggctggagagcagtgttacaataatggctcactgcagtcttgaactcctgggctcaaggagtcctcctgcctcagcctcttgagtagctggaaccacaggcatgtgccaccacaccaggctaattttttattttttaattttttttatagcaacacggtcactgtttgttgcctaggttggtctgggcctcctggccttaagggatcctcccacctcagcctcccaaagtgctgggattataggtgtgagccattacacccagagttgactcattttcttttctttctttcgtttttttaaatttgagacagggtctcattctatcacccaggctggagtgcagcctcgacctcccaggctcaagtgatcctcctacctcagcctttctagtagctgggactataggcatgtaccaccgtgcctggcttatcttttttttttgagacggagtcttgctctgttgcccaggctggagtgcaatggcacgatctcggctcactgcaacctctgtctcccaggttcaagcaattctcctgcctcagcctcccgagtagctgagattacaggtgccctccctcacacccagctaaactttatatatatgtatatgtatatatttctttttttttgagatggagtctcgctctgtcacccaggctggaatgcagtggcgcgatctcggctcactgcaagctctgcctcctgggttcacaccattctcctgcctcagcctccagagtggctgggactacaggtgcccgccactacgcctggctaattttttgtatttttagtagagacggggtttcaccatgttggtcaggctactctcgaactcctgaccttaggtgatccacctgcctcagcctcctaaagtgctgggattataggcatgagccatggtgcccagctctggctaatttttgtaatttttgaagaaatggggttgtgccatgttgcccaggctggtctagaacttcgggctcaagtgatatacccactgtggcttcccaaattgctgggattacaggtgtgagccatcacccccaggaactgactcattttctaaccttgaaacatactgtaaacctttacctttattggttttttttgttgttgttgtttgtttgtttgtttgtttgagtcagagtctcgctgtatcacccaggctgaagtgcagtggcatgatctcagctcactgcaacctctgcctcctgggttcaagcgattctcctgcctcaggctcctgagtagctgggattacaggcatgtgccaccatgcctggctaattttttgtatttttagtagagacggggtttcaccgtgttagccaggatggtctcaatcgcctgaccttgtgatccgccggcctcagcctcccaaagtgctgggattacaggtgtgagccaccaggcccagctacctttattgttaatacagaaaccttaaacctttctcctaataagcaacttacctgagtcgtttggcccatttctctgtcttttgttggataatcagacttctccaagtacccactctgttagctgaatttattttgaattctaaggtgtaggcctcaagtagtaaaacgaatcattgtgtgaaccttgtctttaacatttattgctcattcggtgggtgtttacctgaatgcctacataaaccaaatagccactaaacctggtaggacttaggaatatttgatggtcaaggccttttgtcctggggaagttgtgatcttctacagcaggtcataaaatgaagaagcagatagtaccaaattgcacatagatgtgccctttgatgcccgtggccagtcccaggcaatgtggagtctgagaataggcaggattttaagttaatcattttagaatgagagtaaactcagaaaaatataaaggataatacaagcaagtggcccacagtcctcttaccaagctggaaatgaaagtaatagacaggaaattcaaacagtatacaaagatatcaaagtgaaataagctaggtatggtacagcatgtctgtaatcccagagcaacccaggaggctgaggcaggagcctaggagttggaagctgcagtgagctatgatgatcacccactgtactccagcctgaaagagtgagacccccatctcttaaaaataaaatgtttatttttcttatctccagaaatcattttaatagtttcttatagctggtcacagtggctcacgcctgtaatccaaccactttgggaagccgaggcaggtggatcacttcaggccagcagtctaagaccagtctggccaacatggtgaaaccctgtctccactaaaaatacaaaaattagccgggcatggtagtgcacgcttataatcccagctactcaggaggctgaggaggataatcacttgtacccaggaggcggaggttgcagtgagccatgatcgcaccactgcactccagcctgggtgacacagagagactctgtctcaaaaaacaaacaaaaaatagtttcttagttatttttatagaaataaaagtcttaatttgccagcatatatatgagtatcctttaaaaaaaatttttttttttttgagtctcgcgctgttgcccaggctggagtgcaatggcgcaatcttggctcactgcaacctctgcctcccgggttcaagcagttctcctgcctcagcctcccaagtagctgggattacaggtgctcaccattatgcccagctaattttttatgtttttagtagaatggggtttcaccatgtttgccagtctggtcttgaactcctgaccaaaggtgatccaccttcctcagactcgcaaagtgctaggattacaggcatgagccaccgtgcctgggcatgttttcttatttttattttattttatttttgagatggagtctcactgtgttgcccaagctggactgcaatggtacaatcttggctcactgcaacctttgcctcctgggtttaagccatcctcctgcctcagcctcccgagtagctgggactacagctaccaccacacctggctaatttttgtatttttagtagacatggggtttcattatgttggccaggatggtcttgaactcctgaccttaggtgatctgccatcctcggcctcccgaagtgctgggattacaggcgtgagccgctgtgcctggccttatttttattttttagagatgaggtcttactatgctgcctatggtgatcttgaacatctaggctcaagtgatcctcccatttctggctttgaatttttatatatatatagaaaatggttcattctgtatatattttttcttcatcttgctggggtttttttttggttggttttgagacggagtcaagctctgtcacccaggctggagtgcagtggcatgatctgggctcactgcaacctccacctcccgggttcaagcaattctctgcctcagcctcccgagtagctgggattacaggcgcatgccaccatgcccggctaatttttgtatttttagtagagacggggtttcaccatcttggccaggctggtcttgaactcctgaccttgtgatccacccgccttggcctcccaaagtgctgggattacaagcgtgaggcacggcacttttttttttttttttttgtgacggagtctcgctctgatgcccaggctggagtgcagtggtgtgatctgggctcaccacaagctctgccttccaggttcacaccattctcctgcctcagcctcccctgtagctgggactataggcgccccctaccacgcttggctaatttttttattttttatttttagtagagatggggtttcaccgtagccaggatggtctctgtctcctgacctcatgatctgcgcgcctcggcctccctaagtattgggattacaggtgtgagccaccgcacccggccttcttttttttttttgagaaggagttccactccgcccaggctggagtgcaatcgtgcaatctcggctcactgcaacctctgcctcccaggttcaagcaattctcctgcctcagcctcctgagtagctgggattatagacgcacaccaccacgcctggctaattttttttttttttttttgagatagagtcttgccctgtcgcccaggttggagtgcaatggtgcaatctcggctcactgcaacctccacctcccaggttcaagcaattctgcctcagcctcccaagtagctgggattataggcacgtgccaccacactcggctaattttttgtttctttagtcgagatggggtttcaccatgttagctaggctggtctcaaactcctgacctcaggtgatctgcccgcctcggcctcccaaagtgctgggattacaggcgtgagccaccgctccaggccatttttgaatttttagtagagacggggtttgtttggctaagttggccaggctggtctcaaactcctaacctctggttatccccccgcctcaacctcccaaagtgctgggattacaggcgtgagccaccgcgcgtggcctgttttgttgttgttttttaaactgagcaatgtatcctattttctcccttcaatacaaatagatctactgcattctttttttttgagatggagtcttactctgttgcccaggctggagtgcagtggcacaatctcagcttgctgtagcctccgcctcctgggttgaagtaattctgctgggattacaggcgcccgccaccatgcccagctaatttttgtatttttagtagagacggggtttcgccatgttggccaggctgatctcaaactcctgacctcaggtgatccgcccgcctcagccaccaaagtgctgggattacagatgtgagccaccgcgtccgaccttcttttttctttttttttgagatggaatctcactctgtcgcccaggctggagtgcagtggcgcgatctcggctcactgcaagctccacctcccaggttcatgccattctcctgcctcagcctcccgagtagctgggactacaggcgcccacttccaagaccggctaatttttttgtatttttagtagagggtttagagacagggtttcaccgtgttagccaggatggtctagatctcatgacctcgtgatccacccacctccgcctcccaaagtgctgggattacaggcttgagccatggtgccaggcctctttttttctttttaaatttaaatgtattattatgatttgtagagatgggctctcactatgttgcctgaacataatgcttgtctcctgggatcaagcggtcctcctgcctcagcctcccaaagtgctggcattacaggcatgagccactgtgacttgccaaaacatttactttttggaacatacctaaaggatatacttcatggaatggaattactaggtcgaggggtataatcactttaaaaatttgatgccggttgggtgtggttggtcaaacctataatcccagttcttagggagggtgaggcaggaggattgcttgagcccaggagttccagatgagctggggcaacattgtgagaccctgtctctacaaaatataaaaaaattagcccaatgtggatgtggtggcatgtgcctgtaatctcagctactcagcagactgaggtgggaggattgctttgaacccaagaggttggaggctccagcgagccgtgattgcgccactgcactccagtctgggcgacagagccagactctgcctcaaaaaaatacaagttagatgcacattgtgaaattgcccctagaaaggtcaccccagtgtatcctattatcagtcatgcaggaacctgtctgcttccttgtactttcaccagcactggtgtcctagtcaaacttttgggtttgcagatctgataagtgaaaaatagtatattctggttttactgatttgcatttctctagtctggaatgaccttgtgcatctcttcctaagtttactggggagaatccttaagattttgagatgcatgcatagatagccatgggtgggtgagcattccagagggaggcacctatgcaattgcaaaggcaaagcattgcggggagtgtttaggaaagatttattcagcaaatactgtgcacttacagtatttaagttgctgtgaagctgcaatgccatataaggaaacttctcttctaagacatgtttgtgttccttatcagagttgaaaattgtaggtggccccagggagcctcagaagttgagaatctgggtaggtccctttcttgttgggagtgtcatggtttcttggcagggctttggaggataaggagggcttgggaagggagagatagggacgagggatcaataacacattcttgcactgtcgctcaggctggattgcagtggcgcaatcatagtttgctgcagcctcaagctcctgggctcaagcaatccttccacctcagcctccagagtagctagaactacaggtgcataccaccatgcttgactaatttatttttattttttatttttattttttgagctaggatcttgttctgtcactcaggctggagttcagtggtgtgatcatgactcactgcagcttggaatgcctgggctgaagcaatcctcctgcctcagcctcctgagtagctaggactacaggagcatgccaccttgcctggctaatttttaaatttttttatgcagattgcccaagctggtctcgaactcctggcctcaagcaatcctctcactttggcctcccagagtgctgggattacaggcatgagccaccacacccagtttcgttttcttttaaaatagaatacatttttgaataaaataatacagagtcctgacagatgtgtagagtttaatgtgtcatagcagaagggataggtgcatttaacatactacacatacagctttgggggttttaagctgaagtatctgcctataatctttttctttttttatatattgcttctagaaggtggatcaaatggtatagtgactctaattatgactctaactgtagctaccatttgtttagcgtccagcctggctctgtgctagaggctctgcatgtgttactgttagtattggaagctgtgtattcttacctttgttttcctcgtggggactgggacacagatgctaaacggcttgaccaaattcacaagagtagtcaacggagaacactgattgaactgggtcttttaaaccctggcatcctggttttccccactatgccatacacagtgggctttttgttgttgttgttgttgttgttgttgttttttgaaacggagtctcgctctgtcacccaggctggagtgcagtggcatgatctccactcactgcaacctccgcctcccaggttcaagcaattcttctgcctcagcctcctgagtagctaggattacaggcacgcaccaccacgcctggctaatttttgtattcttagtagagacggggtttcaccatgttggtcaggctggtcttgaactcccgacctcaaatgatccgccaacctcagcctctgaaagtgctgggattacatgcgtgagccaccgcgtccagcccatacacactgttcacagggagggacatgagaaagtaatgatctgtgtctcagtcagctcaggccagggagggacatgagaaagtaatgatctgtgtctcagtcagctcaggccagggagggacatgataaagtaatgatctgtgtctcagtcagctcaggctgccataacaaaatacctgggcagctggtattttgttaaggcaaaatatcatagactggttggctccaacagcagacatttctttctttcttttttttgagacagagtctcaatctgtcgtccaggctggtgtacagtggcatgatcacagctcactgcaacccctgcctcctggattcaagtgagtctcctgccacagcctcccaagtagctgggattacaagtacacgccaccacgcctggctaatttttttttgttttttgttttagtagagacggggtttcactatgctggccaggctggtctcaaactcctgacctcgtgatccactcacttcagcctcccaaagtgctgggattacaggtgtgagccactatgcccagcccagacatttatttctaacagttctgcttgctcggaagtacaagatcaagtgccagccagtgtgattcctggcttgtagatgactccctccttccttttttttttttttaagaggtggggtcttgctgtgttgcccaggcagatctcaaactcacagcctcaagcaatcctcccatcttggtctcccaaaatgctgggattacaggcgtgagccactgcacctggcctcttcctcttcttataagggccccagccctaggctaggcacggtgggtcatacctataatcccagcactttgggaggctgaggcaggtggatcacttgaggtgaggagttcgagaccagcctggccaatatggtgaaacccgtctctactaaaaatacaaaaattatccaggtgtggtggcaggcacctgtaatcccagctgctcgggaggctgaggcaggagaattgcttgaactcagaaggtggaggttgcagtgagccaacatcacaccactgcactccagcctgggcaacagagtgagactccatctaaaaaaaaaaaaaaaaaaaatcaaaataagcgcccccagccctatggggctagcatctcactcttatgacctcatttaacctttatcatctaacaggccctgtcttcaaatattgtcacaatggaagttagggcttcaatatatgaattttggggagacacaaacattcagttcctaacaacacattaccagtaaagagaaaagattaagacacacaaaactgtaagagtctgttctaggtgtataataaagtgttacagtttattgttgtcttacacaagtaacgagatgtttatgggtggggggaacccaagaaaatatgaggccaggtgcatggcttatgcctataattccagcactttgggaggctgacgtgggtagatcacttgagcccaggagtttgagaccatcctgggcaacaaagtgagaccctgtctctacattaaaaaaaaaattagtcgggtatggtggcatgtgcctgtagtcccagctactctggaggctgaggtgggaggattgcttgagcccaggaggcagaggttgcagtgagccgagattgcatcactgcattccagcctgggtgacagagagaccctgtctcagggaaagaaaaaaaaagaaaagaaagaaaatatggataggtaaaacagaagaaaataaaaatcatccaaagtggtaaccgcttttaattttctgatgatttcccccttgtgcgtgcgtgtgtgtgtgtgtgtgtgtgtatgtctgtctgtgtgtgtctgtgtcctagagatatatgtgtgcatctgagtgcatatgcttacagtctctcaatacatgtctgctaagtatcccaataaacgtgtttttcagatgatgtagcgacacaggtatattgacactggtggtgggtattgtgaacatttgtaactataggatgatcagaacaggcataacacctggctgttactgttcttccctctcaaggctatgcagttgcctggggtggggcatgctgacccagtagtagaaattgtactgatgttctgtgttgttttcttcacagcagttctcagccctgacagaggtgcttttccacttcctaactgagccaaaagaggtaaataaaacattctgtgttagggagtgggtccgtgctccctgagatgcttagaaagtgaaggcccgggttttcactgttctctctctgcaggtggaaagatttctggctcagctctctgaatttgccaccaccaatcagatcagtcttggctccctcagaagcatcgtgaaaagcctccttctggttccaaatggtgagtaacctctcttagcagctgtggccagagacattaacttgaacattcctttagtccatggagtcattgaagcatgctccgtgggccaagccagagcgtttggtaatgagccagacgtgggtgggactctgtctctggagggagcccacgtaacaggtgaacatagtatagttgaatagtagtgtgctgtgctggaaagttcagtgtgcatcttgggttatgtcctcagaatgtcctcttgtcctctctataataaggacagaaattgagaataagcatttggaaccttttatagcaatttgacaatgtcccttgaatctaatactttttttttttttttttttgagacagaatctttctctgtcgccaggctgaagtgcagtggtgcaatcttagctcactgtaacctctgccatccgagttcaagtgattctcctactcagcttcccgagtagctgggattacaggcacgcaccaccacgcccagctaatttttttatttttagtagagaccatgttggccaagatggtcatgatcccttgacctcatgatctgtctgcctcagcctcccatagtgctgggattacaggcgtgagccaccgtacccggcctgaatctaataatttttttaaatggagcatttttttttttttgacagggtcttgctctgttgcccaagctggaatacagtggtgcaatcatagcacacttcagcctcaaactcctaggctcaagtgatcctcccgcctcaacccccaagtagctgggaccacaggtgtgcaccaccctgcctggctaatgttttttgtgtgtagagatagagtctctctatgttacccaggctagtctcaaactcctagctcaagctgtcctcctgccttggcctcccaaagtgctaggattacaggtataagccaccatgcccaggttcagttcaagtgtattagaagttgggggtttaatttgtttgcttctgttcagcactttcctatatcttagtgaaggttctttcctttgccctgtattgtgctcctgaggttctgggggcttgaaccagaatattccagagattttcaactgaaattttctgagcctcgtgtttttgtgattcttgccttctttgctgtcatgacttgataagaatttgagggtttttttgttttgttttgcttttgagacagagtttcaatctttttgcccaggctggagtgcaatggcgtggtcttggctcaccgcaacctccacttcctgggttcaagtgattctcctgcctcagcctcccaagtaactgggattacaagtgcccgccaccacacccagctaattttttgtatttttagtagagacagggtttcaccatgttggacaggctggtctcaaactcctgaccttaggtgatccacccacctcaccctcccaaagtgttaggattacaggagtgagtccctgtgcctgggcttgaagtcttttgtttgtttttttgagacggagtctcgctctgtcacctaggctggagtgcagtgcagaatcttggctcactgcaacctctgcctcccaggttcaagtgattctcctgcctcagcctcccgagtagctgggattacaggcacaggcaagcgccaccatgcccagctaatttttgaatttttagtagagatggggtttcactgttttggccaggctggtggtcttgaactcctgacctcgtgatccacccgccttggctccccaaagtgctggattacagacatgagccactgtactcagccaaagtctttttatataggaatactttttttttttttttttttttttgagacaggcttttgctctgttgcccacactggagtgcagtggcatgatctcagcttactgcaacctccgcctcccgggcttaagtgatcctcccgtatcagcctccggagtagctgggactacagacatgcaccaccatgcctggctattttttgtattattattattattatttgtagagatggggttttgccatgctggccaggctggtttcaaattcccgagctcaagcgatctgcccgcctcagcctcccagagtgttaggattacaggtgtgagccatttcaccagcaggaataaattttcattttaaactttcaaaaacagtacagagcggccaggtgtggtggctcacgcctgtaatcccagcactttgggaggccaagatgggcggatcacgaggtcaggagatcgagaccatcctggctaacacggtgaaaccctgtctctactaaaaatacaaaaaattagccgggtgtggtggctggcacctgtagtctcagctactcaggaggctgaggcaggagaatggcgtgatcccgggaggcggagtttgcagtgagctgagaccgtgccactgcactccagcctgggcgacggagcaacactccgtctcaaaaaaaaaaaaaaacaaaacacagtatagagctatagagagtcaaaagtaaaaatcctcttttactctcctcctacttttgtccctagagataatcacaatataattttggactatggccttttatatttttatgtacactaatgaacatattcatgtagctttgtttttcataaatggtagcaaaccataaaaagtgtcctggaactcacattttttcatcatacctggtatatcatggagctctttccacatcaccttcattctttagatggatataatatcccatagactgaatatatctccttttagttaatctatatcctgttgttggatatttctgttgttcccatatctcacccttacaaacaatgccacagtgaacatccttacaacctcttcttactcacaaatgtgagtattttgagaccagcctgaccaacatggtgcctaaagtgcagaaccacaagtctttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacagggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggtggggcagaggcgctccccacatctcagacgatgggcggccaggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaaccagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagagggagacggagacggagacggagacggagagggagggagagggagagggagagggagacggagagggagagggagagggagaggatcacaagtctttattattattattattattatttatttatttatttatttatttatttttgagatggagtcttgctctgtcacccaggctggagtgcagtggcgtgatctcagctcactgcaagctctgcctaccaggttcacgccattctgcctcagcctcccgagtagctgggactacaggtgcccaccaccacgcccggctaattttttgtattttttagtagagatggggtttcaccgtgttagccaggatggtctcgatctcttgacctcgtgatccacccgcctcagcctcccaaagtgctgggattacaggtgtgagccactgggctcggccaagtcttttttttttttttcctgagtctcactctgtcacccaggctggagtgcagtggcacgatctcggctcactgcaacctccacctcccgggttcaagtgattcttctgactcagccttctgggtagctgggattgcaggcgcccaccaccatgcctggctaatttttgtatttttagtagagaccaagtttcaccatgttggccaggctggtcttgaactcctgacctcaggtgatctgccggccacgcctcccacagcgctgggattacaggcatgagccatcacacccggccagaacgataaatcattattctcattctctggccttcatctttggaaatgggtttgtctgagggctgagacctgtctaccaaacacctgttatgggcactaattttcaggagacctctgtctagtgtccctgtccccagtcttccctgtcttcctcaccccaccacactgtatcctttttttttttttttttttttttcgagacagagttttgctcttgtcacccaggctggagtacaggggcaagatctcggctcactgcaaattccgtcgacaaggttcaagcaattctccttcctcagcctcccgagtagctggaactacaggcatgcaccaccacacctggctaattttttgtagttgtatttttatttttattatttatgagatggattctcactctgttgcccaggctggagtgcagtgacgtgatctcggctcactgcaacctccacctcccgggttcaagcgattctcctgcctcagcctcccaaatagctgggactacagatgcatgccaccacactcggctaatttttttttttttttgagacaacgtcttgctctgtcgcccaggctggagcgcagtagcatgatttcagctcactgcaaacctccatctcccggattcaagcaattctcctgccttagcctcccgagtagctggcattacaggcacccaccaccacgcccgcctaattttttgtttgtttgttttttgtatttttagtagagatgatgtttctccatgttggtcaggctggtctcgaactcctgacctcaggttatctgcctgccttggcctcccaaagtgctgggattacaggcatgagccactgtgctcagctgatttttttatttttagtagagatggagttttgccatgttggccaggctggtcttgaacttttgaccccaagtgatccgcccacctcagcctcccaaagtgctgggattacaggcgtaagccgtcctgcccagcaattttttgtacttttagtagagatggggtttcaccatgctggcctggctggtcttgaactcctgacctcaggtgatccgcctgccttggcctcccaaagtcctgagattatagatgtgagccactgtgcccggcctattatttaaaaaataaatagagtcaggatcttcctatgttgcccaggctggtctccagcgatcctgggcccaagcggtcctcctgccttggagtttgaaagtgctgggattacaggcatgagccaccgcacttggccccccactgtatcctgttagattgccttcagccttgagctgcaaccctgtgctgcctcagaaagccttcccaaatcgcttgagttcacagtaacctccccttccagcatctgagatatgttttttatctgtaactatcattttggtcagtactaatttacaggtttctattgttcctgctgatttgtttgtatctgatgtatctgtctcatggctctaatagatagttcctcaaactcaggggcgagtcttgttctttcctaagccatagttagaagcaaggtaatggcataaagcaggtgctcagtacatgcagagcgaattgaatagaatttaggagatgctgtgaccctcccaggggatgttgagtctgtattttccttctttttatgtatttatttattttgggacaaggtcccacccagactgattctcatagctcactgcaacctccaactccagggcttaagtgattcttctgcttcagcctcctgagtagctgggactacggtgcaccaacacacctggctaatttttgtattttttgtagagacgaggttttaccatgttgccctggctggtcttgattcttgggctcaagcgatctgtctgccttggcctcccaaaatgctgggattacaggcatgaaccaccatgcccggcctagtctatatttttctttctttttctttttctgagacggagtttcactcttgtctcccaggctggagtgcaatggctcgatctcggctcactgcaatctctgcttcccgggttcaagcgattctcctgcctcagcctcccgagtagctgggattacaggcatgtgccaccatgcccggctaatttttgtatttttagtacagacggggtttcaccatgttggccaggctggtctcgaactcctgatctcaattgatctgcccacctcagcctcccaaagtgatgggattacaggcgtgagccactgtgcccggcgtatagcagatcattttctatagatacagagaaaattgaggaactcagcataccagtgaagagatgggcttttcaggctcactctgatttgagttttggtcccatcactgaatgtagccatttggttctggacaaatcagccttgtagaacctcagtttcttttctgaaaagtagaataataatagcagcttattgcggtgttaggaatgaagagatgaatgcctgtaaagtacttaacacagtgcttgctcaactgtaacctttgttttgttgaggcttttgttgagccagggtcttgctatgttgcccaggctggtctggaagtccttggctgaaatgattctcctgtcttaacctcccaagtagctgggattataggcatgttactgtgccaggctgttatggcctttatttattgatagagctgctagtgttcagtcctattcctttatgtcaaattatgggataaaacttttacctaataatgagtatgtgaatgtatgtctgggctagttaatgtcccaaagcctcctaagttttattattttattatatttttttttagatggagttttgctcttgttgcccagtctggagtgcaaaggtgccatcttggctcactgccagctccgcctcccaggttcaagcaattctcctgcctcagcctcctgagtagctgggattacaggcacccgccaccatgcctggctaattttttgtatttttattagagacggggtttcaccttgttggccaggctggtctcgaactcctgacctcaggtgatccaccccaccttggcctcccaaagtgctgggattacaggtgtgagccactgctcccggccttcctgtccccttcttatcctttgtccttgtgcatcccttctttctagtcccaaaggctgccatcccagaacagtttcttagccctacatgcctagttatggcagttacatctccacctccattctcccatccagactccagtttgccctggagcacacttaactacagcacaacttggatcatcctgcttctctcaactgtttaccttgcgtaatgaagtctgtaggcctcagtttggcattcaaggcctttcctaatctaatctgcaacgtaagagcctccaggccctcatcagtgtcctcttcctttgacctggtcctgcctgtgcaagaagctcttattgtagaagtacagtttgttagagctgaagtggccttaagaaaccaccagatcagtcttcctcaaattggtgtgtccagagtcagaaatactctccccccaaccccagccttggaaccctggagattcaagcacacattgacacatctcaggttctgaaaagtcctacagtaaagaaacttgcttaaccagtatctgtgaagcacagttaatgatggaactttttggtttctttttttttttttggcagggggagagtcaagtaaaagctttgtaaagtactgatcttttttggcattttattttattttattaatgtatttatttgagacagagtctcgctctgtcacccaggctggagtgcaatggcacagtctctgctcactgcaacctccgcctcctgagttcaagcgattctcctgtctcagcctcccaagtagctgggattacaggcccatgccgtcacgcccagctgattttttgtattttagtagaaacggggtttcactgtgttgcccaggctggtctcgaactcctgagctcaggcagtccacccgccttggcctctcaaagtgctgtgattacaggcgtgagccactgcgtccggccccctttttttttttagatggagtttcgctctgtagcccaggctggagtgcagtggcgcaaactcggttcactgcaagctctgcctcccgggttcacgccattctcctggctcaacctcccgagtagctgggaccacaggcgcccgccaccacgcccggccaattttttgtatttttagtagagacggggtttcaccgtgttagccaggatggtctcgatctcctgaccttgtgatctgcccgcctcagcctcccaaagtgctgggattacaggcgtgagccaccgcacccggctcccctttttattttattgatttttttttttttttgagaggcagtctcgctctgtcgccgaggctcgagtgcagtggcacgatctcggctcgctgcaacctccacctcctgggttcaaatgattctcctgcctcagcttcctgagtagctgggattacaggcacacactaccacgccaggctctttttttttttcttttttggtcaagagggggttttaccatgtcagccagggtggtctcaaactcctgacaaagtgctgagattacaagcatgagccactgtacctggccttttttgccttttttaaaaaatgtttttcttgtactatttagtatgtaattctttgaaacacctgacttcagccaggcacaatgactcatgcctgtaatctcagcactttgggaagtcaaagggggagaatctcttgaggccaggagttgaagaacagcctgggcaacataatgagacactacctctacaaaaaataaaaaaaattggccaggtatggtggctcacgcctgtaatcccagcactttgggaggctgaggtgggcggatcgcttgaggtcaagagtttgagaccagcctggccaacatggcaaaaccctgtctctactaaaaatacaaaaatgaactgggcgtggtggcacatgcctgtaatcccagctacttgggaggatgaggcatgaaaatcacttgaacctgggaggcagatgttgcagtgagctgggattacaccactgcactccagcctgggtgacagagtgagactctgtcttaaaaaaaaaaaaaaaaaaaaaattaactgggcatggtggtgcacacctgtagtctcaactacttcagaggctgagacaggaagataccttgagcccaggagtccaggctgcagtgagccatgattacaccactgccctccagtttgcacaacggaggaagaccctgtctctaaaaaacaaaccaaagaaaatccttcaaaagttattaacccgggctgggcacggtggctcacacctgtaatcccagcactttgggaggccgaggcatgtggatcacgaggtcaggagatcaagaccattctggctgatacggtgaaaccacatctctactacaaatacaaaaaattagtcgagcatgttggtgggcacctgtagtcccagctacattggaggctgaacccgggaggcggggagcagagttcctgacactgcgctctggcctggacgacagagctagagtccatattatgaaaaaaaaaaaaaagttactaacccatggccagattgattcatgtggaccccacccatggctccttactgctctctgaactggattactttagtttagtttagttttagagatgtgggggtcttgctttgttgcttgggctagtctcaaactcctggcctcaagcagtcctcccacctcagtctgctgagtagctgggattacaggtgtgggcaacatgcccagtgcaaactggattatgttttgttttttttgtttttgagacggagtctcactctgtcacccaggctggagtgcagtggcacgatcttggctcactgcaagctccgcctcccgggttcacgccattctcctgcctcagcctcccaagtagctgggactacaggcgcctgccaccacgcctggctaattttttgtatttttagtagagacagggtttcaccgtgttagccaggatggtctagatctcctgacctcgtgatccgcccgcctcggcctcccaaagtgctgggattacaggtgtgagccactgcgcccggcccaaactggattatgttaaaggcaatatcagacatactttattcctgaatacctagttgtctatctctaaaagaaaaaaaggaatttcccccttatcaaactacaatgccattatcatatctaaaaggaaaatacaaggtcagtattaatttccccattgtctcctgtattttgtttgtttggaatgggttcccatcaggatctagataggactccagtccagcacgtggctgctgggtggcccttctgtgcttgcttactcaccagggatttaacagctctgagacccaatggtacctgagaactaatagtagactcatacttttattataaggataaagataataaatgtaataaggtgctcacttcactaagtggtagcacactgctgctaatattatgattgtcattattattatgtgttatctcctagctgagattacagataacttggcagtagggccactatttaagcctgtttttaattaatttattaatttatttatttttgattaatttattttttttgagacagaatctcgctctgtcacccaggttggagttcagtggcatgatcacagttcactgcagccttgtctacctgagctccagtaagcctccgacctcagcctcccgagtagctgggaccacaggtggatgccaccactcctggctgatttttgtatttttggtagagacagggtttcgccatgtttcctaggctggtcttgaactcctgagttcaggcagtccacctgcctcagcctcccaaagtgctgagatataggcatgagccatcacgcctggccgcctgtttttttattttattttattctttttgtttgtttgtttttttgagactgggtccggctgtgttgcccaggctggagtgcagtggcacagtctctgctcactgtatccttgacttcctgagcttcagtgagcctcccacctcagcctcccgagtagctgggaccacaagtgcatgccaccactcccggctaatttttgtatttttggtagagacagggttttgccatgtttcctaggctggtcttgaactcctgagttcaagcagtccacctgcctcagcctcccagagtgctgggatataggcatgagccacctagcctggctgcctgtttttttattattattattattattttttgagactaggtctggctgtgttgcccaggctggagtgcagtggcacaatctctgcttactgcagcctcgatctccccaggctcagccaccctgcttggtcacctatttttatttcatttatttatttatttatttatttatttttatttttatttttttgagacagagtcccactccgttgcccaggctggagtgcagtggtgcagtctcggctcactgcaaccactgcctcctgggttcaagcgattctcctgcctctcaacctcctgagtagctgggattacaggcatgcgcactacacctggctaatttttgttgttgttgttgttgttgttgttgttgttgtttgagatggagtctcactctgttgcccaggctggagtgcaatggcgtgatctcggctcactgcatcctccgcctcccaggttcaagcaattctcctgcctcagcctcccgagtagctgggattacaggcatgtgtcaccatgcccagctaattttgtatttttagtagagacggggtttcactgtgttgcccaggctgatctcgaactcctgacctcaggtgatctgcccgccccggcctcccaaagtgctgggattacaggcgtgagccaccgcacccggcaagacctttttttttttttcctgcatcagtttcctgatgataaaatgcaggaatcgttttcctttgtttgtttttttcttttgagactgcatctcattttcttgcccaggctggagtgcagtggtacgatctcggctcgttgcaacctccacttcctgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtggcgcgatcttggctcacttcaacctctgcctcctgggttcaagcaattctcctgcctcagcctcctaagtagctgggactacagatgcatgccaccatgcccagctaatttttatactttttagtagatacggagtttcactacattgtccaggatggtctcgatctctctctttttttttttttttttttttttttgagacggagtcttgctctgtggcccaggctggagtgcaatggcacgatctcggctcactgcaacctctgcctcccgggtgcaagcaattctcctgtctcagcctcctgagtagctgggattacaggcgcctgccaccacgcccggctaatttttgtatttttagtagagatggggtttcatcatgttggtcaggctggtctcgaactcctgacctcatgatctgcccacctcggactcccaaagtgctggggattacaggcatgagccatcgtgcccagccctcagtctcgatctcttgaccttgtgaaccacccgcctcagcctccgaaagtgctgggattacaggcatgagccaccacgcccagcccatcacctaagtattaagcccagcatggaataactatttttcctaatgctatccctccccccaccccaccctccaagaggccccacacaattttcattctgtctgacgtaaggtcaaatgttgcaggtctgtcttgtggctggcatttgcttaggacaaaggaatcaccacaggaaaaagctgaaaaagaagttaagagcttgaggcctagcatgatgccaatccatgtttcaagtctggcctctgccctccagaggtaacttcaggatggagagcttgctcttccatccctgcagctttgttgacttcattgtcagcaactgtcaaggcattgcctgataccgcagcaccaagatagcgtctgagaatgacctggtgtagaaagaacttggtgtggggaccctctggcctataagccacttggctctgtcagttgctgactgttgtggccttgttcctttaactgtttccttttttttttttttttaagtaacaattttttttttttagacagagtctcactccgtcgtccaggctggagtgcagtggtgtgatctcggctcactgcaacctctgcctcccaggtttaagcgattctcctacctcagcctcccaagtagctgggactacaggcgtgtgccaccacgcccagctaatttttgtatttttagtggagacggggtttcaccacgttgaccaggctggtctcaaactcctgacctcaagtgatccacccgcctcagcctcccaaagtgctgggattacgggcgtgagccaccacccccggccaaagtaacacttatttttatttatttatttttagagatagagtcttgctctgtcacccaggctggagtgaagtggtgccatcatggctcactgcagcctcaaacttctgggctcaagcgatcctcctattttagcctcctgagcagctggattacaggtgtgcacctccacacccaagtaattttttatttttatttttgtagaggcagggttttgctatgatgcccaggctagtctcaaattcctagcctcaagcaatcctctcacctcagcttcccaaagtgctgggattataggtgcctttcctttttttcttgacattatattatgcagattggtccatcaacagctactgagctacatctattttttttttttttttttttgagatgaggtctcaccctgttacataggctggagtgcagtgatgcaattatggttcactgtagcctcaacctcctgggctcaagccatcctcccacatcagcctcctgagtagctgggaccacaggcctgtgccactataccttgctaatttttttattttgtagagatggggtctccctgtattgcccagactggtcttgaacccctgggctcaggtatcctcccacctcagcctcccaaagtgctgggatgacagcacttggccttacataattttttttaagcctggatagcaatccattgtaaggattcttgcattcaacgtgcttttattgagtgccaaccaataaactttgccaggcatttctctcagagcttgggacacagcagtaggcaaaatgagcctagtctttgttcttatcaagctggtgttctagtggaaaaattgataataaatatataacataaagttgggtagttataaatgcaatgcagaatatcccacagcattatacgagtatgagtaaagggcagtgctatttaaattagaatgaggctgggattggcagctcatgcctgtaatcccagcattttgagaggccaaggtgggagtattgcttgagtgcgggagtttgagctggcaagatagtgagactctatctctagaaaaaaaaattaaaaattagtcaagcattgtggagcatgcctgtagtcccagctacttaggagcctgaggtgggaggatccattaagcccaggaggtcaaggctgtaatgagccgtgattacaccaccgcactccagcctgggtgacagaatgagattaaaaaaaaaaaaaagtaaaaaaagaaaaaatgtgaaatagaatggtcggggatcctttctgaggaggtaagagtcaggcagaaccctgaatgaagcgaagggatgagctatgtgcagagaactgcaagggcaaatggccaggggtagaaagctgtctggcatattctaaaaatagcacagtaagcaagggagagagcctaggggttctaagaggaggccagagcatgcagggtgttgtacaacctttggattttactgtgagtgaaataggagatagtagagggttttgagcagaaaaaatagcatggtctgacctgaggtttttgtttgttgtttttgtcatcgtttgtttttgagacggagtctcgctctgtcgcccaggcttgagtgcagtggcagatctcggctcacggcaacctccacctgccaggctcagatgattctcctgcctcaccctcctggctaattttgtaacaggcgcccagcctgtttttttttttttttgagacagagttgctctgttgccaggctgtaatgcagtggtgccgtctctgctcactgcaccctcagcctcccaagtagctgggactacaggcgcatgccaccacacccggctaatttttgtacttttagtagagacggggttttgccacgttggccaggctggtctcgaactactgacctcaagtgatccaccccctcagcctcccaaagtgctggcattacaggcatgagccaccgtgcctggtctctccatgacctttcatccctactatccacattgctaaagagcttcccctgtatatctcagcgtgcttttgggtgcagcttggttgggtgaattcttggcagtgcaattcttgactatctgcatttgccaaattttctcccaaaaatgcttaatgtttcctggtaaactaagttaaaataatagctgggcatggtggctcatgtctgtaatcccagcactttgggaggccaaggtgggtggattgcttgaggtcaggagtttgagaccagcctgggcaacatggcaagaccctgtccctacaaaaattcaaaaaattagctgggcatcatggcacacgcctgtagtcccagctatgtgggaggctgaggtgggaggattgcttgagccccacccacccaccccggtgtggtaggaggtgagctgagattgcccaactgcactccagcctgggcgatagagtgaaaccgtgtctcactgtctcaaaaaaaaaaaaaaaaaagttacaataataaagcccagtgtttggggattgtcaaataaagcattgggtttgaattggatataaactaagacactgtattcatggtagttaggagttatttggattggctgggaagtagccaccttctcagagggcctttatggctaaggtttcccggggtcttgccttttttattccgtgtggcttccttgctcagtctgattttggagataaaagatttcctccctttgtttatatggttgattttaccggtacaacagcctttaggattgtttttctggagtgagttgggggtggggacttgggtttagggtataggttcagggccttcccttgatggtggttggcatcttcctattctttaattagtcattttctggtgaactaaaaagtggaaaatttgagagtggttgccaaattgtgactggggatgtagcctgcaggttaaacattgagaagcccagattgctggctttgttttcaggaattggagcctagcaaaacaaggtgaccaccacagggaagtgttcctagggcttctgagaagttttgacagcccctctggaagtgacttgtgaattgtagaggttagtctgtttagtccatcttggtgtactgtgtgaaagctaacttcttaggacaatgccatccaatagaactttctttgcagatgtaaatggtctgtaatcttcagtgttcagtataatggtcactggccttgtgtgactgtttgacacaggaaatagctagtgagactgaggaatggaattttaaattttatttaattaaaatttgcataaccacatgcaatagtggctacataatgcattgtggagctctaggtggttgccccctgtgcccaacctgacattacactcccctgcctcttgctccaggaattcgtatccttactcattcctcagaccagttgctccatccccaagtccgtgaagtcttttctgttgtctctgacttctctcacactggttggagggataaataattgtgttgtacaattaaaaaaaaaatatgtgccaggcatggtggctctcacccctttaatcctagcactttgggaggccaaggtgagcagatcacttgaggtcaatagttcaagaccagcctggtcaacatggtaaaacccagtctctactaaaaatacaaaaattggtttggtgtggtggcgcacgcctgtagtcccagctgttcaggaggctgaggcatgaaaatcacttgaacccaggaggtgtaggttgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttttttttttttttgtatttttaatagcagcacagggtttcaccatgttagccaggcatggtctcgatctcctgatgtcgtgatccacctgcctcggcctcccaaagtgctgggattacaggcttgagctaccgtgcccggcaaaaataaatatattttttaaataaaataaataaattgtaaaatgtactgtctttcttgttttctggtcatttcggatgctatttccccatggctggattgagatcttggagctggccagtctttgggtgttccttttgtcctttaggtcacataggttgtgcccattaaatacttattgccgactaattcactggtctgcctttctaactgatttctcccctgcctcccaggtgctttgaagaagagtctcacagccaagcaggtccaggcggatttcataactctgggtaggtcattggccagggttgctcagggtgactggcttctgaggctttttattatgttaatatctccttctgttctcttataggtcttagtgaggagaaagccacttacttttctgaaaaggtataattcctcttaatcaaggttaatggctgattaagatcccttgcttttctttcttttttttttttttgagatggagtcgcattctgtccaggctggagtgcagtggcagtgtgatctcggctcaccacaacctctgcctctcgggttcaaggtgattcttctgcctcagcctccccagtagctgggactacaggcacatgccaccatgcccagctaattttttgtatttttagtagagacggggtttcgctgtgttagccaggctggtctcgaactcctgacattgtgatccacccaccttggcctcccaaagtgctgggattacaggcatgagctactgtgctcgacctctttctttctttctttctttttttttttttttgagacagagtttcgctctcgttgcccaggctagagtgcaatggcacaatctcggctcactgcaacctccacctccttggttcaagcaattctcctgccccagccttccaagtagctgggattacaggcatgtgccaccatgcctggctaattttgcatttttagtagagacggggtttcaccatgttggtcaggctggtcttgaactcccgacctcaggtgatccacctgcctcagcctctgaaagtgctgggattacagtcgtgaaccaccaccgccagccccttgcttttatatcatgaagagagaaaacaatgggaaatgccaagtaaggccaaaccacctatcagtatcatcatttccccagcctaaggttttcatctggcttcaagcgcatgtcatacacacagctttaaccagcactattcagtgtatctctaatcatttctcctgatttgacccagtcaaaaatctgcccattttcatggatcaggagaggacttacttgtaaaaatatacctcctactggccaggcccggtggctcacgcctgtaatcccaacactttgggaggccaaggcgggcggatcacgaggtcaggagatcgagatcatcctgcctaacatggtgaaaccccatctctactaaaaatataaaaaattagctgggcatggtggtgggcgcctgtggtcccagctacttgggaggctgaggcaggagagtggcgtgaacccaggaggtggagcttgcagcgagccaagatcatgccactgcactctagcctgggcaacagagcgagactccatctcaaagaaaaaaaaaaatatatatatatatatatacacacacacatatatatatacatatatatgtatgtatatatatacacatatatatgcctcctttctccaattcactgctctcagatgtcactgtgacaaaaatagagaaaaataacaagtgactgattgagaacttaccctgaagaccccatcttgcaattgtctagtagaagccatgtgggggccagtatgatggcagcactgttttttttccaagatggattaaatcttggaatgaaaaatacaacattaatgttgtggtctgccactctgtgccctcctccatccctaggtatgtgcatatagactgagcccttcgttctgcaccctccccactatcttctgcaccctccccactatctgtgtcaatgctaaatattgcaatgtttagggcaggatggagagggggagattttcctattgtaattgactttgtcttttgcttttgttccagtggaagcagaatgctcccacccttgctcgatgggccataggtcagactctgatgattaaccagctcatagatatggagtggaaatttggaggtaactagttacaaccagtcctgggttatttgggtggtacagggttggggtgcagaggctgtgacacagccactatggggaaggcatgacctagtccctagcactgttggggcagcagctgctgttttgtattctgtccacattcagtagctgtttcatggctctggataagttgactttccaaaagcacaccttgctgccctcatacttgcccccacatggcttctgctggacagctgcaaaactggggtcttcagggtcagtcctcaatcagtcacttgttatttctctctctctctctcttttttttttttttgtcacagtgacatctgggagcagcgaattggagaaagtgggaagtatatttttacaagtaagtcttctcctgatccttgaaaatgggtagatttttgacttggttaaaaattatatctacattgggttaaatggatatttaaatggatgttttactgaagtaccttatatatctcagagcagtgtggccagctaaagatgtagtcactaacatgcctacttttagatgaatagatcctagtgttattcattgatgcgtgattgttcctgtaatcatgggaattgttagaattttcggtggtggatgatccagactgctcctgtatgactctcaggttggaagcttaattaagtcaaagggttttaagaatttctttgcccagttgtcatcattttaatttaaattatttctttttctttcatcagctaaagttggtggttaagaaaggaaatcaaaccgaaaatgtgtatataggtgagtctgaattcccacttgagcctcttcaccttttttgtgttctctgcaatcaggggctggtgacgctcaccacaaatcatgtcttctataaaaacagtcattgccagctgtggagtagctgttccactgcctttcctctcctgaaagatggcacaaggagtgttagaaagccactggcaggttggagcccccacagctgaagagccgttttgaaaaagggaaagggtgggaacggaatggctgggattgaagaagaaggttgacgagcaagaagctcttgccatagaagtcacattgaacatcccgaatgataccctttcatctctttgtgccatggatctgtgccatttgaacactcactccccttttttttcctttggagcagagaaccttctgcattcaagtctctcagttctttattatgatcagttacccatcaagagctgcttagatgtattaagccaaaaaagaaaaaaaaaatcctccgggtggaaattaattttcttggatgattctgtggagttggaaacatttatctgaagctgaattttctctccccagaattaaccttgcctcagttctacagcttcctgcacgagatggagcgagtcagaaccagcatggagtgtttctgctgatttctgtccctgcatctcccctagccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaggtctggatccagttgtctttctgcatggattaaagagtcgtgtaccttgcagagagctagtgcttgctcttgtctttaaaaattatcttcctggttttgtgacgatcctgggtctccagtgaaattgggtctgttccaaagttggaatttgtaagagcaattccggggaaactcaggttaaaagccacaggaaaaagcataacatgtgaaatgctttgtgtacagatgacttttcctgctcctcctcctccactaccctcctcctcagaattttttttttttttttttgagacggagtctcactctgtcacccaggctggagtgcaatggcggcatctcggctccctgcaggctccgcctcccgggttcacgccattctcctgcctcagcctcctgagtagttgggactacaggcacccgccaccacgcccagctaattttttgtatttttagtagaaagggggtttcaccatgttagccaggatgatctcgatttcttgacctcgtgatctgcccgccttggcctcccaaagtgctgggatcacaggcgtgagccaccgcgcctggcaaatacctcctcagaaattttataaagttttgaatagctaaaagatgcccatgattaaaaggtacagtgtaaggtaataacccctccccaccaccgtttcccagttacccagttctcttccccagaggtagccactgttattagtttattctgtgttctgaagacattaactgcatttgcaaacggatatgcatatagtttcacttttcttcccacacaaatggtagcattatgtacccaccgtcctgcacctttcttttttccattcaacttggaaatcgttccatatcagaacacagagaactgcgtcattcttggtaacaaatgcaccgttttacttcaaatggatgatttatttaatcagtttcttgctgatgggtgtctaggttgttcccattctttttctcttacaaataatgccacaacagaatatccttgtatatatgtcgttttgcacatatggaagtatgtttataaggtaattacatgggtatggaactgctgggtgatagaatatgtacatttatcaaagagtataaaaaagagtaaaacaaaaggtttcttctcccttgtctcccatttacttaattctcccactggcctgttccaatagataacctctgttgttagtttcttaggtacccttccacaggtttttatttttccccacatagaaacaatagggtcagtcatggtggctcacacctgtaatcccagcatttttggaggccgaggcaggaggattgcttgaggccaggagtttgaaaccagcctgggcaacatggggagaccctgtctctacaaaaaatttaaaagtttgctgaacgtggctgggcacagtggctcacacctgtaatcccagcactttggcaggctgaggcaggcggatcacgaggtcaggagttcaagaccagtctggccaacatggcgaaactgcatctctactaaaaatacaaaaattagccagttgtggtggcaggcacctgtaatcccacctactcaggagtctgaggtaggagaattgcttgaacctgggaggcagaagttgcagtgagccgatatcgtaccactgcactccagcctgggcaacaggcaaaactccatatcgggaaaaaaaaaaataattgctgaacttgatggtgtatgtctgttgtcccagccacttgagaggctggggcagaaggattagttgatcctaggagttagaggctgcagtgagctgtgatcagtcataccactgcactgcagcctgggcgacagagtgagaccctgtctcaaaaaatgaaaaaataaacaacgtgaatttttatttttacacccttttttgtttacacagataattgcacactctacatacttttgttaatacatctaggagatctttccatatcattttataaagagtctgcatcccctccctgtggctgtagcatattcagttttgtggatggattgtaaccagcacgagcagtgtttttttgttgttgttgtggtttttgttgtttttttagatggagtctcactctgtcacccaggctggagtgaagcggcgcaatcttggctcactgcagcctctgcctcttgggttcaggcgattctcctgcttcagtcttctgagtagctgggattacgggtgcatgccaacacacctggctaatttttttgtatttttagtagagacggggttttgccatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagttccaaagaggaacagatgagtgcctttgaacagtgtccagatatattcatgagttttcagagagcctcatgtagcttgagaccatgagaatctaatgtattaataaaaagaattcacaaaaaaggaagtaaaaataaaaaattagaaaaaaaagttcacagaaagtcagaacgggaaggtacctaaaatactatcaatttatttattattattattttttgagatggggtcttgctctgttgcccaggctagagtgcagtggtgtgatcttcgctcactgcaacctctgcttcctgggtttaagtgattctcctgcctcagcctcccgagtagctgggactacaggcgcattccaccatgcccggctagatttgtatttttagtagagacagggtttcgctatattggccaggctggtcttgaactcctgaccttaggtgatctgcctgcctcggcctcccaaagtgctgggattacaggtgtgaaccactatgcccggccaatacaatctgtttaaaactcactcatattacagatggggaaactgaggcctggagactgaaactgtggtcactggccaggggtcagacagtgctgtcctgtgatccatggggtcctgcttgattcagaaatgggctcctgacactagaagggcttccagcacgccaagccatctggtgcaggtccaagtccgggtgctgtgtaagagttgcacccagctggccaccggacagattctgaccagggagctccttgccctgcccaattcagccgctgctgccccacctggatcacaacattggctttctgatggcccccctggagtcttcagcctcacagcttccacagtccagcccatttcctgtgtgaccattcttatgcacaagtctcatgtcacccaacagatccactgctcagggttctgccaggtgtccagaggaaagtcagaactcctaacttagaacactcagccctgacaacctggccctgctgacctcctccagtgctccatctccactgcctcctggcaggcatcctactggagcatctagactaccaggctgcttacagccaccaagccatggtgccatctgcctcttctccccttgggctcacagtgctgccccacatttctaaaggcctctcctgatagttcttggccataataaacacaccttgggccctcattcctctgcttcaggggttaggagtgcaagctctgaagtcagactgcctggggtttcttttttcgctttgtagagagcggggtggggggagggggggctgtctcactgtattgcccaggctggtctcaaactctttgactcaagtgattctcccgcctcgggcctcccaaagcatcaagattacaggtgtgagccaccacacccagccctgcttgggtttcaatactggcctttctgcttattaactgtgtgaccttgggcaaactccttaacatctgagaaccttagtttccccgtttgtaacagggttataattctcagctcacaaggttattggggtagatcacttcacacagagcatgcttaactaaccagtgagctacttattatcaaatcgtaattatttgttcccaggattctctttcccactagcccctgagtttctttctttcttttgtgcgtgtgtgtgtgtgtgtgtgtgtgtgtgtgttttgttttgtcttgtttttgagacagagtcttgctctcttgcccagactggagtccagtggcaccatcttggctcactgcaacccccacctccggggttcaagcgattcctgtgcctcagccacctaagtagctgggattacaggcacctgccaccacacccaactaattttcatatttttagtagagaagggttttgccatgttggccaggctgttctcaaactcctgtgctcaagcgatctgcctgactcggcctcccaaagtgctagaattacaggcgtgagccaccatgcccagcccatgagcttcgtgataggagacttgcttttcagctcaatcacccctacaatcagcatcattcagccccgctcctcctccccaagccagccttggaacaggtcctgccctttgttgaaatgaaatgaggctgagtgtagagcctccatggaagcaatgttaacaaacctccctgactttagaagaagaaatccaggccaggtgtggtggctcacacccgtaatgccctgcactttgggaggccgaggcaggcggatcacctgaggtcaggagttcgagaccagcctggccaacatggtgaaaccccatctctactaaaaatacaaaaacttagccaggtatggtggctcgtgcctgtagtcccagctactccagaggctgagacacaagaattgcttgaacccgggaggtgaaggttgcagtgaattgagatcccgccactgcactccagcctgggcgacagagtgaggctctgtctgaaaaaaaaaaaaaaaaaaaaaaaaaaaaaggccagggaagttgttttcattgtgggtcagttttaacatagatcacagatagctccacagtgtaagggggccctcttcccagagcagttgactatcctgctccatgactccaccaacattcttggagcgcctcatatgggcaaaggctttgctaggccctgggggagggagtgataagccctgaacacagataactgacaagttgttttttctttttttctttctttctttctttcttttttttttttgagacggagtcttgctctgtcaccaggctgatgtggcgcgatctcggctcactgcaacctctgactccctgattcaagcgattctcctgcctcagcctccccagtagctgggattacaggcatgcgtcacaccacacccagctaatttttgtatttttagtagaggtggagtttcaccgtgttcgccaggatggtctcaatctcctgacctcgtggtccacctgcctgggcctcccaaagtactgggattacaggcgtgagccaccgcacctggccaggttgttttttctatgtaagagtagattatatcctcactcccatttacaatagttcagagcccattatgaactccagaactactacagttcctttgctggattggaattttgtcacgaatatactctgttgaataaggggcattgatcaggctctgcagactgtcaagggggattttgctgcaatgctgggggatttgggcaggatttttcttactgttagcactgcacctttgcattgattcactgttcttccaattctgtttagaaatctgctgtctggtaatctcacttttgattgcagtttatttgcttttggagtatagtgttcattaggatggtaatagtctggcccaagaggagatgagccagaaatacctgtattctttccctggagggaagaggactggcttggctgggatgggaagatcaagtggggggagggggtgttgattgttcagttctttttttttttctttcattttttcactttttggcctatcattcttgtttcctataactgttcagttctgacactattgtttatttttactatagtggcattaaaaaaagaacctgggggccgggcacggtggcttacgcttgtaatcccagcactttgggaggccgaggcaggtggatcacaaggtcaggagatcgagagcatcctggctaacacaggtgaaaccccgtctctactaaaaatataaaaaattagccgggcgtggtggcaggtgcctgtagtcccagttacttgggaggctgaggcaggagaatggcgtgaacccaggaggcggagcttgcagtgagcagagatcacaccactgtgctgcagcctgggcgacagagctagacttcgtctccaaaaaaaaaaaaaaaaaaaaaaagaagctgggcctggcacagtggctcacatctgtaatctcagccctttaggaggccaaggcaggaggatcatgtgaggccaggagttccagaccagcctggtcaacatagcaaaaccctgtctctacaaaaaacttaaaaattagccaggtgtggtggcatgtgactgtagtcccagttgctctggaggctgaagtgggaggattgcttgagccggagttagaggctgcagtaagccatgatctgtgccactacactccagcctcatattttaaaaataaaaaagctgatgatgttgtggaaagtcctcaaatagcccaagtggtcaactgctctcttgtgggaccagcaacctgacacatgagcatttgccagagtggaaaatggcctttctgaaagacagaacactcaacaacaaatatttttctaaaggatacttgatcttttccaagttgctttattttttttttttgagacagagtctcattctattgcccgggctggagtgcagtggtgtgaccacgacccaccgcagcctcgacctcctgggctcaggtaattctccctggtagctgggattacaggcatgcaccactatgcccagctaattttttttttttttttttgtattttttgtagagacaggttctcactctgttgccagggttggtctcaaactcctgggctcaagggatcctcctgccttggtctcccaaaatgttgagattataggcatgagccaccacgcctggctggggttttgtttttgtttttttaacatttgtcacatttcacaaaggtatttcagaatctctgagaaaagtgctataatgtctaatgatactttatatttggacagcactttcgtttgttttttttggcggggggggtgggagaagtcaagtaacttacatatagtgaaatttacccttcttgagtatgcagttcagtgagttttgataaatgtgtaatggtagtgtaatcactaccacagtcaagacatggacaattttcattaccccacgaagtgccctcatgtgtggttagagtcagccctcccatcagcacagtcctggcagccactgacctggtttctgtccctactgttttgccttttccagaatgtcatttaagtgacatcattcattatggagacttgttttattttttattttttattttttgagaaggagtctcgctcttgttgcccaggctagagtgcaatgctgtgatttcggctcactgcaacctccgcctcccgggttcaagtgattctcctgcctcagcctcccgagtagttgggaccacaggcgtacaccaccatgcccagctaattttttttttttttgagatggagtctcgccctgtcacccaggctagagtgcagtggcatgatctcggctcactgcaagctccgcctcccgggttcacgccattcccctgcctcagcctcccgagtatgcccggctaatttttgtatttttagtagagacggggtttccccatgttggccaggctagtctcaaactcctgacctcaagtaatccgcctgccttggcctcccaaagtgctgggattacaggtgtgagccaccgcgcccagcccattatgtagctttttgtgccccacttctcccacttagcataatgtttttgagattcatctgtattactagtgcatctgtagttctttcctttttatggctgggttgttttttgtttttgtttttgttttgtttttgagatagggtctcactctgttgcccagggtggagtgcactatcgcagctctccgcaacctccacctcccaggctcaagatatcctcccacctcagcctcctgagtagctggaaatacaagtgtgtgtgccaccatgccggttaatttttttttctttttttttttttttttttcaatttttgttggaagcaccatggagccgcctgagcctggctgagcctaaaagccctgtggtgcatgcctggccaatttttgtattttttagtagagacgggattttgccatgtcgcccaggctggtctggaactcctggtctcaggtgattctcctgcttcggcctcccaagtagctggggttacaggcatgtgccaccatgctcagccctcccgtcagcacagtcctggcagccactggcctggtttctgtccctactgttttgccttttactggtctccatgctcacctaaatttttttgtattttttgtagagacagattctcgcaatgtt

SEQ ID NO: 59 - DNA, 1552 bp, Homo sapiens
aactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctagccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaagg

SEQ ID NO: 60 - protein, 286 aa, Homo sapiens
GSERPSAVPKGHSAGELAGNLASAGAGAAPAPPRSPAAARVRGPARAPRLRTAQGGRGRSALRRPWRKCGCGCAERPAAVAAAAEEEAEQGGGGGGTCGAGARAMGRLHCTEDPVPEAVGGDMQQLNQLGAQVERFLAQLSEFATTNQISLGSLRSIVKSLLLVPNGALKKSLTAKQVQADFITLGLSEEKATYFSEKWKQNAPTLARWAIGQTLMINQLIDMEWKFGVTSGSSELEKVGSIFLQLKLVVKKGNQTENVYIELTLPQFYSFLHEMERVRTSMECFC

SEQ ID NO: 61 - DNA, 31810 bp, Mus musculus
acacacacacacacacacacacacacacacacacttctatccagggaatgtggtaaacatttcttctctctctgtaaagactttagaaatccaggttaaaatggaagaaaaccttcttaaggcagagacagctcagaggacaaaggtggccattgcagaagaaatggaaaaaggttgtccttgtactacaactgtgctcgttggatacaggcacaaaggactaaggaacagacagacaccttcctagaaggtctatggcttcagagggcattggaattaggtgaagggtggacttgcaggcaaatcttctgggacaaaatgggatgctcagactatttgtaatggttccatggttttgggtgttctctgcaatcggaagcctggcttgcaggaccttggcacggggtgtgcagattatacctccttcagaagctcccccttgcaaatgccatcttgttctgtaatttgtctttctacaactaatcacttgtatattctatgcctttgtctcatttttcaaaagctacatatgagtacatattaaagatgagattttcattcgaagttgaaaaactacccaaagccttctgttttcctgatactgctttgcactgaagtgtctctcttcagcattcaagataacagtatttcctgttttctccggtgggtagagaatcttcagagacagccatgttttcagtggactgaaatctcaccaattaaaatgagcagtgtttgttttctgtgagcagcgtccacaggcaatgagatgcagaagcttcaggtacagaatttgctcactgatatcaagtgcctacgacacagtagatgctcgataaacgttcactgggtgaagtaaaccaacctaggagccttgctttgttctttgatgacgtagaaatgttcccagttagtcctgagcactattgtgggaagttttggacatgttccctcattcacagggcaaaccttccacgtcagcagattagaagtcgcatggaaagccatctcttgagcgatggtcaagtcaactggctgttattttactcattattgttcactgtagttaggtaaaaagtggctcgtagaatcggtactctccagtgcctgcgtggagcttccacgttgctactcagccaaccttattccttactcctgtgagcagccttctcccgactcttcctcctgaggatctagcagcagaaagcagctctatgtccctgcaaaggagctgggcaccatcgccatgaagtccatgctgaacttctatgtgctgggggtcatgttgaccctgctttccatctttgttagactgatagtgtcactgggaggcttattagagagcccattgcccaggagttcctggatcacagggggtcagctagccaacatacagcttctcaagggtcttccagaccatctatccagacctgaggagtgcagtaaacctccctccaggcatcagccatactttgacacactagcatggacaacatgttccatttcccaagaggcagcatcaagtgtctccaaaggactgttactaggcctagcaggacattttttttggggggagggggtcccttaccctgaaagagagcctatttactgtagagctgtgagtgggttttctgcggctctgggatggaggtgtaccagttccagctgttgggagaatggtttttggttgagcttgtttcagttctctgtcctaaaggattcctttggacctaagtatcttctgttggtttactattgagtctcttccacagagttgtatggacagcatctaaggggttgtgcattggctatgaagacagagggaggactatccagtgtccaggtcaagttgtacattaagttctttctccagtgtaatgcacatatgtttgcatataatgtctaaagggctatggtatgatcaggcctgctcagggtatgggtgttccagccactgtgtggcttatagacattttttcccttttagaaaaattattattattattataacttctatttttcttctcgctccagcctcaagatttatttattatatgtaagtacaccgtagctgtcttcagagactccagaagagggcatcagatctcattatggatggttgtgagccaccatgtggttgctgggacttgaactcaggaccttcagaagagcagtcagtgctcttacctgctgagccacctctccagccctctacataaatttttctaatacaataaatgtgaatacacacacacacacacacacacacacacacacacaccccacatacatatatgaatcactactcggacacactccttcgctgcctcaaagttttcatcctgctgtaccataagaggccaaatgactgatcttcatttggcttttcctttgattctaatacagttatatttttgtttcccagtgtatgtgtgtatgtgtgtttgggggcttccattatcatatatggtatatatgatatatatcatgagagagaaaagtgtttttttttttccttaaggaaatgtttaatgttgagcctgaaagacaagatatgatgaaatgcaaggtttgcactgaatatagactgaaatctcataaattaaaatgagtcatgtttgttttctataagcaatgtctacagaaaaggaaatctagaacgtcacacagtatcatgggacaggttctggggagctgtgtgctcttttaacccttgtcctcgggcaccggtcccatgagtacctgttccacgatcctgtgtgttactgtggattgaatcccaggcctgctgcatgctaggcaagtgctctaaccactgagatacacactcctagcccctcaaggaaccattagtgagaaagacatacgaagtcaaaaggattcacgtaagctgaatgtgtgtgtggtgtgtgtgtgtctccccttgtgtgcaccacacactatatatttaaaaagcaacatgtcatccctctcgatgtcacattcaataacacctccccaaatggtattctatctatagcatcctagaaacaagagcaaaaagagtctacacattgcattttaaagaactcattctccatcctcttagtctgttcttgccttggatgtttcagggaagaaccatttccaggactccgtttctaaggcaggggcaaattctatgatggtgaggtttgatctggatctacccagaccacaccttccattcctccgcagaagggtagcatcttggggttgccttcatagaagaggcacttttaagtgtggtagctcaataccctgttgacgtatattttccataacttactttaataagagttcaacctcccagcccggcagtggtggctcatgcctttaaccccagcacttgggaggcaaaggcaagtgaatttctgagttcaaggtcagcctggtttacatagtgagttccaggacagccagggctacacagagaaaccctatctcgaaaaagcaaaaaaaaaaaaaaaaaaaaaaaaaaaaaaaagagttcaaccttccctctagtgcaccacccaccagaggaggtggaaaagaaaggttattaggatgctgggacaatggacctgctagaactagttctttgggtcaattccaatcttctttgttctcagtccagtccactagcaaacaccaaacatgaatcagaagctttagtccagtcaactcggcagacaccacacacgaaccagcagcccctgcaatccagtccacttggcggacaccacacatgaatcagcaactgcagttcaatccagaagaaaccattaggctcccaaaatcggctggaatccttggaagtggcagaagctgcagggacctcaggagaagttctctggcgagtttctctctatgaagtcaccacaaccaaagctcagcaatgcaatctaaaatgaaccaatgcatgtgtgttatcagtgaaggctagcaaggcagagcaaagcaaaccaacgcttgagctcccactgtctgcggggtcatatttatattccttctaaacattatgcatcctttcacaacatagtttgctatagcaaaacctttcgctgtgtctgctctaagcaaagtgtcctttagcctacatgccccaacaaaacaatacttgccataattgatgaaaccaagttaatatttaaactgtataaagtttgcatctattttcaagaggacaagggaaagtgttggtcacatgcttcaaagttaccttctttaggcttggcatggctgtgtgtacttctattcctggctgagagcagagggtagcctgaactcaagagtgtgggaatggtacaggtagtggaatgaggtcgaccccattttacaaagagagaaggaaaaaaaaacacatagaagaagtccccactattatgtacaaagttaaaaatcaaaggttcaaattactattggtgagctcctaatttttttgagtacacatatacatggtgtatgtgtgtgcacatatgtgtacgggcacacctgcctacgtgggcatgtgtggaggccagaagctgacatcagaatgtcttcctctccatgagagagatggggtccctcatactgttcactggtttaggtttggcttccttgcacggttagcccctggtttctgcctccccggtgctgagattactgtgtggaatttcttgtgtgggtattagggatcccaattcaggtctttaggcttatatggcaagcactttacccaccgagctgtctccccatcctctgaacatccagtctttaaataaaataaaaattgcttaagtgtatccataatatttattcactctttaaaaatatacatttttcccaaaatgttataaaggcaaaaatattcacacgtttagtgtccatttcctgctaagaaaagaatcaatgacctgctttgtagtgccatatttagaattcaatgtgagcaaacctaagaaaaacctaagcttgtttcatattcaagacattgttcagtgctggtatgcagcagctctggtttctacataaacactgcagcaccccagaaccacagagaaaatgtcagcaggcagcaggcaggtggatggatggatggatggatgtgctctggccactgcttactgcaaacagccagatactactcttgctttaggaaggacttgacagcgccccctgtctctcctcacctttaaatatttctgtcacgcagcgggcttggctctgtagccgagccagtgtgagtggtctcttgggctgtgctctgagtgtctgtgcagggagctttgaggagagcaagcgtggacgagcttggaaagccacgacctgaggtggatggacagcagacacagaggtgcccctgtgataagtagagatgggagaggaagagaagggaacggtgtgtgtgctctgaagagaggtagaactggagacaagagagggtggtgacagcctgatgtgagtagcccgtgcggccacctgaggccatggttaggtcctggccaggtctggttaccaccgtggtagtaacaggggtctgtatcaatgttatcaccagaggctatgcagatgtccccggtcaggtcttcctcctggagccatctcgatgtccaagggctaagagttgtcttgaacctcaccagctttggtactcaggcgctccagagagcaggcccactccttatctgggcaacttgagagagctggccctcagggcatgagttagggagcagaccctgtccctcactggctgcaccacttgggagagctgaccctggtaatatgggagagctggccctcagccctgagggtgtgagagcagaagagctggccccacccctagctgggcagtgctggagatcaggctctggtagcatgggtgcaggcgagctaaccctgactgtataggagtgggagagccagcccttcctcttgccagctgccacaagcagaaatggccgtggttgttttcacaaagaagaactggcaagccgaacaactcagctaccacctaatctcagattattaagaatcataacacaggcgtggtggcgcacacctttaatcccagcactcgggaggcagaggtaggtggatttctgagttcgaggccagcctgttctacaaagtgagttcctggacagccagggctatacagagaaaccctgttctcgaccccaccccccacccccaccccccaaaaaaaatcataacacgtggacacacctgctattgccttggtgacagatgtctctaaggtagggcttagtactgggcatagaagttatccgctgacacaaatcctgtggctatagtgtaggtttctgcaggggcggggactaagctttccttgttcttcactcttgggtgtactgcaaagatcttctaacactgttttgttttcttattattcccactctcccacttatgatcccatagaaaggcactgcaccataggggatgactgtcacttacaacccagagccacaggaccaagggctgtctatatgcatcatttgttcaggtagatgtcacatggcagataggacaacagcagccatgtgtcatggtgaaattctggaagagccctctttctattaacttttgaggaggatattcactatctctctttaaaaaacaaagccaagaaaccttgcctatttattctttgccgggctgggatcaaacccaagctactgcacatgtgggccaagtgcacatagatcctggagatgttagttgtgaggactctggctgtcaggccctcaaaaagtattactttgcatcatctctgctgggaccagtgacggcacagagaggacttggaaaagggttggtctcacgagtccagtcatgctaggctcaaataaaaacttcctccagtgagactctccttggttgtgcagacaatagtatgttggcaaactattccagaacccaactgtaaatatgttttcagaacaaataaacccagagctaaaaataagctctttgtaaggttaaaggtccctaagaaggaagtgaacctgaagtgctgaacaatgctctcaaggaagctgagataaacaatagaaaccatgtgggagataaacaatagaaaccacgtgctagggtcatgccggccccaagacggtatataaaccccgccctcagcagaaggcatcagatcatcctctcctctctcaagttgctcttctgttcatttgatccgagtcctctctactgacaccatgggttgctgtggttgtggaggttgtggtggctgcggcggctgcggcggttgtggcagctgtggcggctgtggctgtggaggctgtggctgtggtggctgtggaggctgcggtggctgtggaggctgcggtggctgtggtggctgtggaggctgcggtggctgtggcggctgtggaggctgcaacagctgtaccacctacaggtgctaccgggttccctgctgtggctgctgtggtggctgctgcggttgctgtggctgctgcaagcctgtggtagtctgctgctgccgccgctcctgctgccgctcctgtggctgtggctcctgtggctgtggctgcggctgtggctgtgggaagggctgttgccagcagaagtgctgctgccagcagaagtgtggatgcaagaagtgctgttgctagcatggctgctggccccctggcctcggggccggtgatggttggacccaggctcatatacttagacttttagactgtatgccctataatccctcccagttcacctatcaagctgtaaggcttaataaacatagctgagtagaacgcggaagactaaaatacgtctgtgctgtgctgaagatgcctagccatggataaataagtcagcctccctgaatttgctcattcattgatgaaataatgaagctgaactcagaatctctaaggacctcttcttctttaatagcatatgcatcttcgagtccttaaaactgaactcagggcccttccacctttacccatggaagatttcgcttctatttctgatattcatagtgcatgtataatgtgaatacagggagcattataatgtgtttatattttagaatccaccctcagcccactatgaacggccagtgataatctgcagaagactcccattaaagacctcagctgagtgaaagcaatgtgaatatattctattattttgaagcacttgcctttcaagagatgcatgtattatatgtctgcttacattggctgtatacaccacgtgttttaactttaaagtgttccctccttccccaatgtaatttatgaataaaacaatggaaaatactgtgtttcactgtctttgaatttttttttcagactattggaactgatgttttggcaacacaggttgcgaactccaggaaagtttaaaaattgagttaaagtttgacactgaatataaggaaacgaaagctactgagattgagtcaatagactcctgggttgttttacgtgggctaagggctctctccatttagttattcaggagatgggctgaagaagctattgacatggtcaatgcatgacttcttagatagtttagttgtttccggtctatgtggaaaacaaggtagacatagcctagtgcttgcaaagcaatgtggcttgaaagtgacattgttttctttccctctctttctactggtttgaagtagtcacatggtcttacttagctgtaagtggataagtgtgaataagtatggagatgaattaatatgagagaaaattcatatatctttatatatgtataccaatatatcagtggctacctatgcactatgtgactcatgatttttcaagacagctaaggcagctttactacctatttatatgccttggattcttgctggggtagttcaaccagtcaggcagcagactgcatggttaagacctggcttgtcatcatgtgaaccctttgcatgggatggaactgcagtgacagagggttgagaagatagcaggagctggagagtcctgacttatcttacaaatattacctgtccttctagatacaaacatacacatggttcaaactgttttcaaacgatctaatgatggaacctagatactctaaagagttttctccaaacatttgaataagacagcaataactgttttgtttgttattcatttcagtgtcttttcagttgtcctctctgtaaacaaagtggtattttccccagagccgcctgcctttgaaatctggatatgcagtgacaggatggacctttatgagatacacaaagcagcacaaactaaaggcttgttcctctgtctgctatagttgaggaggaccatggcagacatggaaccttcgtctcccgtctagcctctctgccattgcttttatcatagtgtccatatttgatcactttccttctggtgccattagtcaaacctcccacaggttgtaggtgggatgtgtacaaaggatctactttacaagactgggaaaattaaggattaaaaatgctgcatgtgagacaatagcctgaaatgaaacactaatatttagagtaatcaggaatacttgcagagaagattgctttccctaatcttatacaatgttcatattcttactgaataactccaaaataaggatactttatatataatatccttgtatcgtccaataatataaaactatgaaaagtagtttattctaattggatatactttttgtcttcttagatttttacaaggcacatcagtagaggaatattttaggagttatgccacacaagcttttttttttttaaatcagtttttacttacctgtattcatgtgtaagttcatcacacagcaacattagatttttttttctatctgtttcccttcatcctatcataatatgattattggttcccgtcataatcctcacaataacatcctgccctactggactctgaactgctttccacaactcatttttcataagtgctaaactttaaccagaacgttgggataaaaggccaggcagagagctacacgagcccagccaccctgaggaggtttctaactgaaccaggaaaaccatgacgtgctgtgaagggtggacatcctgcaatggcttcagcctgctcattctgatcctgctaggagtggttatcaattgtatacccctgggaatcagcttagtggaggcagactcgacttctcaaaaccccatctcctgctatgagtggtggtttccaggaattataggagcaggtctgatggtgagtaatacctacatgaacagacttggagaagggtgtctgatgcctttaactatgactttcagccttgcacagttaggaatgtgattaccatcaatttataatgttacattgtgaagaatgataatttatgtacagaaagcgatggtccatcttagggaccttaaggcaaaaagcaggttaagtcgttacctatagcatttcttcacaggtgggatgatacctctgaactttattatttaacattaaggaacttcagtttttcttttttaaaacatggtgctggcgatggaactcggggccttaaccactctgtgggatattgtttaaatctattgcctctttttctctgccccatcctgatttctaggtatagggaacgtggcagcagtgggaacttgctctacgggaatgagaagcacccctgcgcatgggtagccttggagatggcatagtgaggcttagcctgcttctcaagggagctggcctaagacatagagttcgaaatcctgggtctcttttataagatgcttggccatggtcatggtgttttatcacagcaatagggaagcaactaagccagtttctgacctcaacaacttttggttttgagtattacatagatcccagaaagcttcagagttctatagtctgatgatggtgaatgggtgttccttgttgaaatctgatgcaaggtgggacaacacagatttcatgcgttcttaacagtgaactatcagagtcaggttctcattgtctcctagaaattgtgatgcagccagtctgggtagaacacatttgtagaatccaattttcagatctggaagatgcactcctagcagtgccccagctgagacaggccatttagaaaaactcagctatctctagatatgaatttgcattgctgaaaacacaggagagaatattttaaagctttgctacaagtagtaaagagcacgaggtagtgatggtacccatctacatctcttgggctttttttttttttttttttttttttttgagaaaccaaggagccagagactaaacagaccagaaaggacaggaggcatagaacattcatttgttgacatcttgctggaaagcctagtttagcgtacatcctgcctagtttccactctacaatcatctgggctgcaattatcacttgtactttatataccagaaaacagaaggctgagaatgttagccaggtcacacaatgggtgtgaaacccagtgctagatttatctaatgccaaagctagttaaaatactgtcgtcctcaatctctgcctcaggctcacagaggtcaaagataaaatccacaaagtaaaaggaccaggaagctgagtcacacaaaggcctacacacctgggaaacacttgagagaatctggactccttgtcttgcctatcttgcttccctcaataaatattaaccaaaggtcattagagcatcaaactcatggagaagtctgatgctctccatacgcagaccctcaagctggaggttagcccgactagtaaacaggtgctaacagcagtgctcggaaggcaagcatactttcatgatccttggcttcacataaaaggatgaatcacattttttttccgaggggagttatgtcccttgtgacatctgtcaactcacttctgcagacactttgtaaagaagaattcactaagtgtgttgagcatttgtttagtccttaaaacttttggccagttgttacatttcaagttagcctcccttcagaaatgggaattttacaggaaactgcatataacacaacctcagggctcattactgattactttatgaagtcatttgttttatgattttatgaccaaccccaatcagaggtgaacctttttatcttttgaaactgtaaccaagtaaaacattatgtagttaatctttaagattatctactaaggggaaggggattgtcaatataaatgttacttgatcaagcattaaaagcattttaaaatgtttgttgtaaaatataatcagaaaggctcttttactttatataaagttaactataagcctggtcttactcattctttttattgatttttacccattacataagggtacttttccaaagccagttattaaaatcttagtggaaaacaaatggctgtaagtcaaactgattagaagactgcatgcaaaccctttacaaagcagagcttctgcactcatgctgagctatggctttaagtgttgttctcatgttcaagaggactccccagagttaggcttctatcacagtttttaactaaggttcttgtgtgcttcctttatgaaaatgtacactttctagaactggaggaaagcctgggttcctgccaggaaaacaaactgtaattatttataaaaagaagagaaggaagactgaatttcacaaaatcttatgcattcaaatatgtttaggaatactcaaccctaccattttagtgcaaaagtagccatagataatatgcaaatggattagggttccaataaaactttatttataaaaatgaggtgacagggtggggagtgcatccttaccagttcttgtcctacttcacttgttatataagatcagaaagcagtgtcttctgggaacaaccaaaaaagcttagtgtatacatgatgacaaagatttcttttccctttccttctggtctttcagctatgcacaggggtagctggacatccatacgtatgtgtggcttctgaattggaaagggatcagtgttcagtgtataaacaaagcttagcaacaacacgaagtgacatgaagtcagcatgcgattagatggggtgatgtgtgctgggaaagctgccttgtgagagacatgaatctcttctagaaaaaccaggcagatgtggctttggaagacaacgggggaaggaacaattagaggcaaattgacatgagcaagggtgctggggttccaggacccaagagtgagtggctttatgaactgtaggtcaatgtgacacagtggcttagagaccacatgtctagaatggctctgaactttcccttcttaggcaagttacaccacctgtggtttgacagtggcacaataggccatacaccaatgctccattcaaggattgttacaaggctggcacagaccaaatcatgtcacgttctaacacctggtatgtagttacagagcctgctcatgttagcagagcagaagagtgggagaaccattccagggtacctaggatgcactgccaagcacccatcacagctaaaaagtcgtaagtggaaggaagcaactgatattctatgttcaacgatacaaaactcttagttaagcgttctagtcatagctgatagatgtctttttaaaaatagaaaactaactcttaataatgtgataccatttacagccctcctcagcagtacagaatgcactatacaccaagcttttgcctgcctttaatcccagcactcaggaggcattaggcagacagatctctgtgagtttgaggccagcttggtctacacagtgagttctaggacagccaaggccttatcttgtttgtacaaacaaacaaacaaaccaaagactcctactaaacatcagagtaaagtatggtcagtacatattagggatccaggagcagagaagggcatgggggaccaatggtcattctcaaatgtaggcttgggaactctggcaagctgatggttgtctgggatgtcgaattaagagcaattaaccagcaggagtggtggtgaattggtccctgccaaaggcaggcaaacaaaaacacgaatttccttcttcccagattgacttgcttaatttacaggaaatagataaggctgaaggagagggaagggagagaacaggggagggaaaggtggagggagtgggagatagcattaaaggtaaatttgggtgatagaacaaattcttttaagattctttccaaaactcatgcactaataagccaccctactctaaaatccaggaggctgcagcccacagggtaaacaggaacgtggacagaaggcttcatagctgctatcgactcttgccctctcagtctttacgggtgaaactgatgttaaggttcacgatacagcgatgtcagattagatttcctctttcgttctcctgggctctgaattcccccaacgggcaataaatggaaggtggcgatgattgagtttttatctgatgagaagagataatactcatctttcctgaaacttccattccaggccatcccagcaacaacaatgtccttggcagcaagaaaaagagcgtgctgcaacaataagactggggtgagtaccgtgcagcgggcttggaagtggagggactgcctcagcagctcctgctgggcctcaggcttgggtgacactgtcggggttggttaaacagtcatgtaaagagtgacaagagagcttctcttctctctagaagtttagctttggagctagcctttgatcctttcctcaacctttggttcatctaaagtataggaagttttgtttttgttttgtttttgtttttggtttgttttttttgagacagggtttttctgtgtagccctggctgtgttggagctcactctgtagaccaggctggccttgatcttagagatctgctttcccctgcctcccaagtgatgggattaaaggcatatgccaccatgcctggcagatcttgttattgaccaaaacgctgatggtttaaaacaaaacaaaacaaaacaaaacaaaacaaaacaaatcactagagtaggatattgagtattttctaaacccagcagacgcctctgattttccagtccttacacaatgtaagtcaagaacttgacaccgagggtctaattctctaaggccgggatagaccactgacaagcacccaaccatcatcaatacatgggactgagttcagcataaaggttttaaatcaatggttcccaatcagatgggaacacacaggttatctcaggagatttcaaaaacacaagtgcctgcctgcatggttcccaagattctgcatgtacaatcttccaaagcaccgggtgattccaacgtggggtggggtaagacccactgtcctaaagggaataaggaggtaggttgtgggcttcctttttaaatcattactttatgtaatgggtgttttgcctgcatttgtgtccatgcctgtggaagtcagaagagggtgtcggattccactgagctggagttgtggagggttgtgagctgatgcgtgagtgctggggactgcatctgtgtcctctggaagaacagcaactactcttaactgttgagccatttctctagccccagaaaataagtttgttcttaacagagcctgcttctggcattctgtttatttaggattacaataatcactttagccacagtgtttgtagtctttgttcctagtactttggtttctactgtcagtcacttttgttcctaaactaccataccttggtgcagtttgacttgacctcacttctacgtgatactcacaggatctcaagacctcctggtttatttctgactctcttaactggaaaagtatctgaatacttaaacgtttctcaaatctactttctattaaaatgtttttgaatataccctttcaagaaaattggtcccttttgtctcccttgaggatacaagcaggtgggaagaagcaagctatttgttatttttgcaatgatgttgtctctctgtgcatatatgcatgtgagtgcagtgcccagggatgccagaagagggcactggaccccctggagctggagttacaggatgtggaactgtggatgctaggaactaaatttgggtcctctgaagagcagcatatacccttaaccactgagctgtctttccaatccttaacagaggaacttttcatgtagatcctggctttaaattaggttgttttgctcacaccagttttgaaaataatttgtgcatgcttcagcaaaatcatgggttgttcaaagctgagggtcttccagggctgctgtggagagggggtggggcacagaggcactctatattatctatgccgttagcaatagttctagtcatttaaatagtgactgcctgcctatatcaatgtcataaaacccccttacaatagcttttcatttgctggcaaccaggtgttcaggttacagttggtgccttctgggtcaagataaggccaaggtggcataaaattctcctcccttctcagcagggcaggaagggggcagcagggccttcccggtttcatcctttcttccttccccttttctttgtttcccaacatggtaagattttgctcaaccacttgaatgactggtcactcaggaagtaacaggtccggggtaacagcggctcttcttgatgagaaaattcggtaacttgtataaatcacagtagtgctggagaaccaggattgacagctgatcctagctcccatttctgtgtgcttccagctgaggacactaagtgacaagaatgggagcatgagtatttccgagatgagtttcccaacaagctgtcaaccttccttcccctttctctccgaaatgagaataccagtagatctcttttagggttgttcgaaggattacatgagatgccacacatgaggtcacaatcctctaaggagctaataagggaagaaaaatgctttcctattttcacttttgattttgaaataatcataatcactaacagctttgtaaaacacggaaattattcttgggggggggcacattcaacctttttgttttctatgccaaatttcacagagtttgtgtgactagggttcagacaaggcacaccctttccctccatcatggtcttctcaactctgggcatatttagaccctccacccgtattccaaatggactgtggcactgttgagatagcttttagttgtcattctggactgggagaatataaagtgatccttgcatctgatgggcagagaccaaggttgctgacacatcccactctgccttggaagggcccaatagcaacaagtccctccagtgggcccagctgagttaagctctcaactctgctgcttactgattacttcaggatgctggccactgtccgcatacaacatcagccaaaaatgcgaaagagttggaagccaagagcccagaaataaaaatttaggcagacaaggtctaatagaggttcaatgtaggtagaaccatataccataggaagagggaaccaggtttcagtggccaggaggaattcgtaaacccaggaatacacaagttgagaattttcagagacattaacaagtgtaattatcttttggcaactgtaattcaacagtgaactttgatctccgcctctttaaaaaaatccacacctaattaaactgcactttcatgtctcaggaccacacagggcaagggagatggctaagtcagtaaagtgtctgtcatacaagcattcggatctgagtttggatccctagggctcacataaaagctgggtcaggtggcacctgcctaaaaggctagtgttagaggtgcatcaaggtagatgccggagctcaggggccagccagcttagggaaatggttcactcagttccaggcccagtgacagacaatgtctcaaagataagttggagaatgaaaagcgctatggggagacactccacatcaacctctggtttacacccctcatacacacgaacacacatgcacatacagaatacactcacacacacatgtacaaataccatgcatgtatatacatcaacaaataagggggaaaaagatctaggagcacagactgactggagaactgcagtcagtaactaagactgctaagtgctacacactgctgctgctggaaaacttgaaacatacaatgacgcgtgcaaacgttgctgctttgttttccagatgtttctttcatcactcttcagtgtgatcacagttgttggtgctgtgtattgcatgttggtatcactccaggctctcttggaaggacctctaatttgtaatactcaggccaacagtactgtcacttgtgaattttcattgaaaaacttaaggtgagttgagttttgtcacacagtctcccatagctgtggctaactgtggtgtataatgctaagcttttctccgttctgactactgggacaaacattcgtagggacttggtgagctgataccaatatctaatgtctcaccaagaagtggtggggctgcttcaggtatggtctcatctaaatggtctagttgatctcaggtggcttatacatgcctggtaaacattcatggatatatgcctatgcctctttaaaagttctgggaatatatacttaatttaaacccttggggtacagtagtgggtgaggggaacatttactttctacaaatctgcattatttttgtttaaattttaagcaaaggagtgttttgcctgcatgcaagtgcaccactcatgtgcagtatccaaggaagccagaagagggcactgtacccatgggactagagttatgaatagtttatgagccaccatgtaaatgctgggatctggacccaggtcctctgcaagagcaataacagctcttttaactgctgagctacttctctaggcccttattttttatcatgtgtgtgtgtgtgtgtgtgtctcgagtgtgtttgtactgtgaatgtagagtccattgaggccacaggtgatggatccctgtacaactggggtcaaaggcagttgtgagctgctcctagtgggtgttaagaactgaacttgggtcctctggaataaaagtatgttctcgggacagatgaaccttctgatcatctgatatgaacctatcctatcagttataaaccatagatggcttacattttttgtgtatggtgttcctgtctttgtaatgtttgctggtgctgtgtggataggcatgcatgtgtgccaacatataaggaggtgtcctcctcaatttctctcctttatttactgaattaggagcctgacaattcagctaaccggctaggttcaggaatccccttgtttctgccccatctgatccccctgtcctgggcttccaggtggccaccctgtctccttcctgccctccccccccccccaagacagggtttttttttttctgtgtagccctgactgtccttaaactcagaaatctgcctgcctctgcctcccaagtgttgggcttaaaggcatgcgtcaccactgctggactgtctccttggtttttataagggtgctggggatctaaagtctggccctcccactttcatggcaagtgctttgttcatggaggcaccactccaccctttgtactttcgaaatatcaatcaatcaatcaatcaatcaatcaatcaatcaatcaatcaatcgaaagagcagctagtagattcatgtggtcatgctatatacttatagacagcgataaaaatatttaagccatgcattggaagttacatacaaatggtccattgagaaaattctatgcctgaatttaggcatacttttcaaaaacaggaagaccaatctaatttactagctatctttaattagccacttagtttcggaaagctaccagatttaacttttttattaaaaaaactgttttctcctccattacctacagtaaaaaaaaaggtctttcaaaatgtgcatggtagttattattgtggactaaacaaaacccaaagaaattcctttaatagtaaggaaaatttgaactcccagccacagttactgcacacatttcaccctcaaggaagcaccagagctcactgacgtagtgggcagcaggcgaagcttcgagggcagcagcactgacatcccctcctagtctagttggggaggccaaggcagcagggtcattaatcctgtggtctcaaggaaaccaataggctcataggccatgtgctgcaaatactgttattctctcaggtccaaagtcagttattgggatctagaaatgtgttcttcctaagagtattccattttattggtatccccccccccccaaatcatcttgagatagatgtgttaggactaaaagcttcttattttatgctacaggcatgcatcattttaatcatgtatttgaaatgttgtgagtaaaaactatccacctggccaaagagcagatctatgttagaaactgctcctcccccccatctctctctctctctctctctgtgtgtgtgtgtgtgaactcatctgctttcctacctttggcaagtagaaaggctacacaaacaggttcacacctctgaggcttttgatatttatttccatcctgacatgagagagcatcagtttatcttaagatcagctgtcctatggagaatgacacaatgtgttcaaatagggttttaagcattagtgctgtgcaaatgtgctcagcaaaccagatcttagctatggtttctgtgtacaatctttaagaatgtacattgggttttactatactggggctcttactgtcttagtaggcacatttaacccttttctttttccctccagtaaatttgatcctgaatccttcaatctgctgtggttcttcaatggcacttgtgtttctcctactgattttaaaaaccccaccatcaataacatggtcagtaactggaaaatacccaactccaactctgaagaagacagacacaggattttccacttctcagtatttatgagtctcctgcttgttggaatcctggagctcctgtttgggctcagtcagatactcattggtttccttggctgtctgtgtggcgtctctcagcgacggagtcaaattgtataaagggcaataaactagaatatcagtactttgaataatttgaaaattgcatttaaaatatatacttttgtaagttcaataatgaagcatcttctagaacacagagtcattttagtgcaaacagatgtttttagaatcatctctgaagcaactttcaaaaaaaaaattaacctatcaagctgggcagggctggtacaggccttcgatcccagcactcaggagcagaggctggaggattcagagtttgaggcctgcctagtttacaaatgccaagacagccaggactatacagagaagctaaagcagaggactggcatgaactcgcactagcgcgtcctgtatgtgcagtgcacctccactccggggggagaagttaccagtgggtgacacaggggagaagcataggaaagcttttaggtttcttttttcctatgtatgccaaaagaacaattgtccacctcatggttacagaagtatgtgtcttagttttaagaaatatatattatgtgttttgggaggaagaccatgttttaaaaatactttaccctcaaagccaaagtgatggaaaaatgctgtgtttaactgacaggcacatggcaattcatcatactctatttttttatgtttgtatctcttcatgatatctgctaagactttggggaaaaaaaatcagccttttagaagctggtttttatgtatgctgatctttaaaagataggtaacaaaatgtatttattgtattaaaatgttatgaaatagaaaaaactaaaaatctacaattttctgaatgttctctctcctacaattgatttcaatctccattttatggggtgtcttagtcagggtttctattcctgcacaaagcatcatgacgaagaagcaagttggggaggaaagggtttattcggcttacacttccatactgctgttcatcaccaaggaagtcaggactggaactcaagcaggtcaggaagcaggagctgatgcagagaccatggagggatgttacttactggcttgctttccctggcttgctcagcttgctttcttatagaacccaaggcggtataccagcccagggatggtcccacccacaaggggcctcctcacttgatcactaattgagaaaatgccttacagctggatctctggaggcatttcctcaaggcaggctctgtgtcaagttgacacacaaaaccagccagtacgtggggcttatgatttgaaagtgggctggagagatggctcactggttaagcacttgctgttcctgcagagaactggactttggttcccagcacccacactagcatctcacagcagcctgtaactccagcttccaggggagccagtcccttcttctagactgcagggcaactgtgcacacacaaatacgaaataaacaaatcttagaaagtgtgtttttttgtttttttctttaagtgaactggacagatggttcggcatttaagagcacttgctgttcttgcagagttcccggcatctacatggtggcttggtggcttgcaactgtaacctgaatcccaggggatccagaaccctattctggcctctttgagcactaggctcactcacatggcgggacaaacagacaaatacataacataaaaataaatcttaaaaacaaaacaaaacaacaacacagtcatgatggtaactacaccaccaattataactgaccaagtaaatgagtacattaagaacttgcaagtctctttctagcccaaactgcacgaagacattttccctaaaccacccctccccacacacccaccaacacttaaggcttatctttaggatctatttaatagtctacatacaagagcacaactcagagaacactcaccagaacaatacatttctcctcaaacatgaaggtccttctgtctgtccttctgcgtgtccatccgtccatccatccatcacagactgtaaagatcagggaccgtcccctcccactcatcagcctttctccacttctgctccttagtaagagctctcccccaccctcatcagatacgccaacctgccttacctctggctgagccgttttcgtccctaagtatgtcgtggctcttaaagaatttgacactgactttgtcaagccatctactgttgagtaggattccttttgcactcttgtctgagtttctctttctgttgctgtgaggaaagtatcttgacaaacgctcctttaagaagaaagggttactgtggcacacagtagcttccagctcaagagccagcccatcactgcggagatcaaggcagcaggagctggtgctggtgcagcagctgctcacactgcatccatctgcaagaagcaggtggatgaatgcccctgctcagccccttctcccactttatacaatccagggcaccatgctgaaggctgggggtggaggatggttcctgcccacaattaggaaaagttttcccacaatcacttaacacaaccaagataatcccccacaggcccatctcccaagtggttctagcttcagtcaagctgataattaacattaatcaccatgactctggtgttagtattccacaggcccatctctcaagtggttctggctttggtcaaggtcaagctcataaacactgtcatgactcttctctgtagaatgtagcaaaacactgttagcatttttccttctttttaatttagtatgtatgtgtgttttgcctgggtgtgcctgtgcactgtgtgcatgcactgccagagaaggccatcagcctcccaggactaagactacagatggttgtgagccatcatgtgggagctgggaaatgagcctgggtcttcaagcagagcggccatgctcttaactagtgagccatctctccattcctggtgctagcatttccttctgtgattcttacgctgctacatggcactgtcctacaccagagcagaagctccgtgggtgccaaggcacatgcattttactttctcctggtgtaaccagtgcatagcacagtacctcatgcaggaagggccaaggtattggtctgctgaataaatgctaccttcagcactcagacatgagtggcaacaatgcttactaaattaatatgaaactgctaaaagacatgaaatagaaacaagtttaaaaaaaaaaaagaatgccagctcactgtacttgactgaacaaataagagagctagctagctagggatatctgggatagatagaacttaagacttttctcatcgccctggaaagaggtgacattgtccaggtctctgctcagtcagaaaaaaggagacctaagtttcaaaaagaaacagcctttgacagtaccaccactggtgcaaacagacggcagattatttctatgctctttagtctttaggagactgcaggccacctgaagttatcctcttttgagggcatgcaacctttgatctggtatccaaagtagcaaatgctcgtctgtatacacgcaattgatgcaccaggtcccacctaacactaaaacactacaaggagtcatttgcaaaatccgatgtttctctcttcctccccaccccacccctttggcctttttttttttttttcaggacagggtttctctatgtagccttcgctgtcctagaactcactctgtagaccaggctaacctctcaaactcagaggatctgcttgcctctgcctcccaagtgctgggattaaaggtgtgcatcactccagcctgacttccaatgtttcttcactctcactcctatctccaagaccaatatcattttagcacgcatctggacagcttctgccgtctagaacgcatctctcacatgcatctgaagcttctttccctcagggaaacgtttcataatcctcagtctttaagagtttttacacttacacacttacttgtgtgtttatcatgtgtgtggttgtgcgtgtaccaccacagtgcttgtggaagtcagaagacaacttctgggagttagttctctccttcaaaccccagtcccagggcctgataatagcacctttacctggtaggtcatcttacaactcgcagtcctcattagtgtgcttcattctctcccacaccactgcccttaatctgtcaattccttaggaacagaaaatgcgtctaaaatatttccagaactagaaagacaaatgtcagaattctggaagtagtgtggtaaaatctgctgttcttagttctttgatgctcgttagccctaatgctatctttctgatcctccaggacccagatttgctgttgttgttgttctttgtttaatgaaaaatctgtgtctgttcaagtacctacaaaatatttcttgattatcctgattaggattgaatttgttaatactcattcccatgtccggcccccacacctgtgcctaatcaatataggacattctatctaagaatattcaagtctttgtataacactcattagggaaaataacagcttctgtactaacctcttaggagttccttttatttccaccctttttatgaaatcttttctatgcctgctcagcaaaagaagttatacatttaatttatcaaagtcacatactcaaagtacaagaaggaaccctccccctggattaatggagactcaagaacagtaatgtgaaatctactaagccttggaactttcctcaccctcttagtaaaaaggaaactgatgatgtgcaaagaatattgtagctgaagtctaactgttcttgaaaaaaatacacttttgaatactaaaggctcgatattagcaaggaagtattacaatagaaaaaaggtacataggcttataaaggttttgtttttgcttttttaaaaataaacctgaatcattctcatagatacaataaatgagcaaaccatttacagtgctagcaagccctgtgctggggtggagatctgagaaacccaggtggctcttgtgacccacaagtcactaattcactacttgcccctgggacaggagacttggataagatattcagtccacagccccataggatgaaataaatctttccatagacattgctttggttgacagtttattaaatacactacatttataccttattttttaggtttttaaatcattcacacatggacttggtaaaaacatacttgatagaaaactaagatgaaagtcaaaacagcattgcacacagacagactgctgaactgttaggagtttttagccccgcctgtgcaggtaggcgatgaagcagagtcaggtggtttgacttcagtcctgcacagcactgtgacttagaaagcattacagttgagatgtagatacaaaaagcatctatcaaagaaatcgcttcatcatctgaaaacaggacaaaacacttttctttcacagacagttttctaaactcactctttatgactgccatttctgtttagagaattagctgtacagactggtgaggccacaaaaattattttctttaaaaacaaaacaaacctagagcctatttacaagacatgcaaaaggagagtgtataggtgccactgcacaactggctgaacgcccatcagcagcaccacaggccttcactctacagatacagggccttccctgcactctggagaaatacattttcagggccgtcatacgatgatgcaaagacagaaacaatgaagtttgcaaatcctttatatttccaggtgttgagacaatatatgtgaatgctgaggttacctctagcgtcgaaaccagagccagctgttaagcagccagaacgctacagtgattgaatacatgaccatttctcttttagcacgctctttattctcctcttccagaagttggagacgtctatttaatttgattatctaagtgaaagacaaatacaaaatacaaaatggtactattgcatgcatacagcaatcagatttttaaaaaagtcgtatataaacttgtcaaagaaatcattacatataaagttccattctggatcaaaatgaacaaaattataaaagaaaacaaaatactacccacaatggcttaaactgatttaaatacacttcttcatttccactctgtaagtctgaattagggagtgtgtgtaaggacactgttgcactaggcttttctggtgggaaacaggacctgtgtctgatgggtctatcacagaagaaggagcacaggatgcctgctcctctttgggcctcctccatgagcctcagttgtgcatccttggacctgcacaacttgtgatctcagtccactctgatacccgagagccccatattacctacgatagtgggccctctgatatgccactcagacacattgctatatgtttggtacacataatcagaatactaagcatgccttctccacatggcaatacctctttgtaaagatagacaaaaagcatattaaaaataagcacaagaagtgttcagactgggtttacgggtagggtcatgcaatatactgcagaggtagggggaaaattcaaagcagtgttttccaaagtaaagaaattataaacagtaataaaggttcccaaagtaaccacatatcaaaaccaaaacacaaaatttggaactggattcatttgtaagtatatcaagattctttgatactgttgagattatatcaatcattttggtagcaatgttctatgctgatcaaaatcatttgaatggtagttcaaaaatctttaaatctgagaaaaatcaattagggtttattagataatctgaattcacggaatccacaggagaaaaaataatgcaaactattaatctgaactattttgtagaaatagctacaggttactttttttatttggggcagtaattacctgacgtcttaatgaagctgcatctaccacagtcatgtcatctgaagctccttcaatggctgcatctaggtttgaaatgccatacctagcagataagatattgaaacacaagttaaaactaagagtaactgtcgagtcatgtgttgtgttgtatactacttaaaagactcatacccaacaatataaattagcatttttccatttgaattcatacaaataaggaaaagcagcttaagatgactatctgcaatactgggaaagctgaggaaaaacctcttactatgtgctttttttcaagccagaaaatgcaacaatgataacgggccctgtctgaaagaggcagaactgctactatctgacatactgacacacagcaattatatatgaaccatgtccatatgtcgttctgtaggcagagactcaatggcaggaaatgcacagtaaactacaaacaaaaactgatcatttattactctttcacttctgcctttcttttactattttttttttactttacttctgatttctagttgtctctgctctcccacaaaagtgaatacatgatcttctaaatcttttgcaactacacttaactacagaactgtctcaataatataccaacaagaagctgcatataaaacagtactgctggaaaaccaccaagacaatgtagagaaagtacattcaatagtactttttgttaaaatgcactcactcttctaaaagggcacggactcaggaatatagtggcattttagagatgggagtcttacatgactggtctcaaacttgctatgtggcagtgcatggccatctactctcgatcctcctaccttagcaccccccacaccccgcacaagtgttgggattattagcatgtactaccaagcctgcatgcagacataaaaatttaaaaagaaaaacagagaaatgttctgtcttccatttgtctaggtttctacatttttaagaaaagaacctgaaacgttatgtgtctgtgagtgtgtatctcagtgtattctacacttgtcaacaggaagccaggaaagtgcactagattaagagctgctcacatggtgttgaacttgagaactgtggatgagccataagaagtcttaactgctaagccatctctccagcaccaggtttctacattttaaaattcattttaatgaagaacacttttacctagatatagtttatacataatacaatttatttacacgtatatctactttatgttttatatggttattttagtgaaatgacatggtaacctttctacatgagcagaatgtaaataaaattccttttatgtaagctacacagggttggtacatgaatcatcattctaatactcccagtaactccacattagaaaacctacataacctgacataaagggatatgaaggagaatatatactccctcacgcttgctaatatgctgattcacaaagttctactgtttcaaatgttaaaactacctcaaaacacttttaaaaagcatgtcaagtagactttaaatactagagggcatgtacccattgtagataatccacagcaatctctgacttgcagtttctattatggctaggtcagatggcttacactaaccatgccttcctcttaagaaacaatgtgtcttgaactactcaaaataaaatttataagttaggagaaataaactcagttcataagtaaatgctggaactgtgagtttgtaaaccgagcaaattactcttataaacactaaaatagaacgtttaggtctaagggtgtagctcagtggcagaacgcttgcttacctgtgcaagtccctgggtttgtcccctgaaccataataattcagcctgcactccaaattattaaatgtttagtgaggaaactatgggtcaatgcattttcttttctatgttttatcttcaaaataataaacaatttctactttcccaagattacacatgagatgaatagttggaggaaggggttatcaaagaataccagcaattgcctcaaaggtaaacggaaggctggtgtgatactcagccagaaaatgctttccgtccaaagctgagcacctaaatttaatccccagaatccatgttaaaaatagaaaagctgggcatgctggagcattcttgtaatcccagtactggggaggcagagacaggaggattcctgtggcttgctgacaagccgacttagtgcaaccagcaagttccaggcaaagtgagagatgtctcaaaaaccaaggtggctaacactggaggactatcaaggataactattgggttttcatgtatatgcacttgtacccacacaggcaaccccaccccatcccatcatatacaaaagtaaaggaacagggatgatcatacacaccaacacacaaacatgcacagagataactagctttaacaaagaaataaagcatacatgaaaaaaattaccatttaaatactgaatcaccctgtttcaaaaacctaaagataatcttcacttgtcatatacatatgacaagattttatcatcaatttaaaacaaaaaatatgaaattagtttaaaaaatttctatttctcagaactaaaaactcttacaaatgctatcatatcactacaaacacattcacagtaagttaagagataaaaaaaaaaaaactcaagggaaactagtgtggactaaatgaagatgcagaagaaacgagtaagcagtgttcagggccaccaatgcaacatggataagattaacaagaaatgggtggctcccttttctcttacttaagaatgtgtctgcctcttctgaagaagagaaacaaggctgccaatttaaatcctgctgggacagttagcacaattctctaagcatatctgatagtatgaaaagggcaaatacaagagcaaaggctcaaatcaacaggtgataaaaaaatagttaatggacataaacaagatttaagactctatactttgttttagcatgatcctctataaagctactaaaatactgctataaagtatactggatgctcttaccacaccacagcagttttgttttgttttttttttttttttttggggtggggtggggtggggtggggtgtattgagacggggtagctctggctagtctggaactcactatgtagatcaggctggcttcaaaaatcttagcgatccacctgtttctgtctcttcagtgctaggattaaagtcatgtgccacaatacccaagcataatttttattattatacaatgttctcatactttggtggatttatgtcaggactaattatcatccctgttcttagcaaagcacatcatttcttctaagggaaagctacagaggcctaagtcgtatacataaatataatcacggctatgacatgcatcatgatgtcctgcacaatacaagctccatcaagtctgcgtgttctttggtaatcaaagtctccaaagttacctgacgttgtcatgatgaggattagaagtggcggcagctgacccaccacgcaacacaggtctagggcaggtttttgcagaagacacaagacagaatcaggaaacagagaaatacgaaaataaagcaaaaacaagacaaataaatgtcagataggattatattgtatgctttagtacaatataatatccctcaaatgctttgaaaatccttattttcttatgtcttccccattttaaataattttaacacttcataattttaaaaagagagaaaaacatgacggaatagcaccaacatatctatatggtgctatttaaaaaatgtaattcctcttttccaattgaaaaataaaaccactagcaactttaacagcatatccagacctgttagtagcacctgcatgatcatggttgctcataaatataaactaggcatttaaaggaatacccactgcccacaatcccttccctctagcttcattaatctgattagt

SEQ ID NO: 62 - DNA, 1504 bp, Mus musculus
cagccaccctgaggaggtttctaactgaaccaggaaaaccatgacgtgctgtgaagggtggacatcctgcaatggcttcagcctgctcattctgatcctgctaggagtggttatcaattgtatacccctgggaatcagcttagtggaggcagactcgacttctcaaaaccccatctcctgctatgagtggtggtttccaggaattataggagcaggtctgatggccatcccagcaacaacaatgtccttggcagcaagaaaaagagcgtgctgcaacaataagactgggatgtttctttcatcactcttcagtgtgatcacagttgttggtgctgtgtattgcatgttggtatcactccaggctctcttggaaggacctctaatttgtaatactcaggccaacagtactgtcacttgtgaattttcattgaaaaacttaagtaaatttgatcctgaatccttcaatctgctgtggttcttcaatggcacttgtgtttctcctactgattttaaaaaccccaccatcaataacatggtcagtaactggaaaatacccaactccaactctgaagaagacagacacaggattttccacttctcagtatttatgagtctcctgcttgttggaatcctggagctcctgtttgggctcagtcagatactcattggtttccttggctgtctgtgtggcgtctctcagcgacggagtcaaattgtataaagggcaataaactagaatatcagtactttgaataatttgaaaattgcatttaaaatatatacttttgtaagttcaataatgaagcatcttctagaacacagagtcattttagtgcaaacagatgtttttagaatcatctctgaagcaactttcaaaaaaaaaattaacctatcaagctgggcagggctggtacaggccttcgatcccagcactcaggagcagaggctggaggattcagagtttgaggcctgcctagtttacaaatgccaagacagccaggactatacagagaagctaaagcagaggactggcatgaactcgcactagcgcgtcctgtatgtgcagtgcacctccactccggggggagaagttaccagtgggtgacacaggggagaagcataggaaagcttttaggtttcttttttcctatgtatgccaaaagaacaattgtccacctcatggttacagaagtatgtgtcttagttttaagaaatatatattatgtgttttgggaggaagaccatgttttaaaaatactttaccctcaaagccaaagtgatggaaaaatgctgtgtttaactgacaggcacatggcaattcatcatactctatttttttatgtttgtatctcttcatgatatctgctaagactttggggaaaaaaaatcagccttttagaagctggtttttatgtatgctgatctttaaaagataggtaacaaaatgtatttattgtattaaaatgttatgaaatagaaaaaactaaaaatctacaattttctg

SEQ ID NO: 63 - protein, 230 aa, Mus musculus
TRKTMTCCEGWTSCNGFSLLILILLGVVINCIPLGISLVEADSTSQNPISCYEWWFPGIIGAGLMAIPATTMSLAARKRACCNNKTGMFLSSLFSVITVVGAVYCMLVSLQALLEGPLICNTQANSTVTCEFSLKNLSKFDPESFNLLWFFNGTCVSPTDFKNPTINNMVSNWKIPNSNSEEDRHRIFHFSVFMSLLLVGILELLFGLSQILIGFLGCLCGVSQRRSQIV

SEQ ID NO: 64 - DNA, 37262 bp, Homo sapiens
  misc_feature (1)...(37262): n = A,T,C or G
aagtaacaaaattaaaagtatttttcacatccttaagagttaactttctttaaaaaaagtcttcaaaattttttaaaattcttgaaatttaaagacataattaaaaggcaaaattcaaattataaaaaatgaacatccaagttttaaataaaattatttaaagggaactgcaatatttattgacctttaaacatgtaagtgtatttaagaaagtatattatgaaagtaaaattattaacaagtctagtgtttcatgtccatttattgccaacataaagaatcagcctatttcatgcatgctatatcgagacctacatgtaaacaaacctaagaaaaatatgaattgtttcatggtgcaaacattgctcagtgacggcatgcaatttttgtaaataccacacgagcacgtcagtacctccaacaatggggcagaatgcaatgagcaagaaactggattcttgccactacttactggaaatattttattacacaagaatattgtttagtcatgctgagaagaaggatttgacaagttaacccatcttttctcttacttaggtattttccaacaaattcttgtcacactttgaaggaatcaatccacaaacctctatggcatggagaagctggcagcccttgttttgaggtcgtggggcaagagacacgaagaagcaggtccctgagcagtaccagtcccagctgcacatatttaggcttctgggctaagctctgggtcctgagtggtgggggtggattagggcttgcgttttttacatagatttttttttttgtacgcttgtgatatgtgggatactaaagtgcacgtcccagggctgggcctagatcttgcctagatctgaggttggtactgggtgcatgaaaaactcctgtgattattattattattattatcattattatatttgagacagagtctcattctgtcacccaggctggagtgcagtggtgcgatctcggctcactgcagtctccgcctcctgggttcaagtgattctcctgcctcagcctcctgagtagctgggactacaagcgtgcgtcaccatgcccagctaaatttttgtatttttagtagagacggagtttcaccatgttagtcaggatggtctcgatctcctgactttgtgatccacccgccttggcctcccaaagtgctgggattacaggcgtgagccaccgcacctgttcactcctgtgattattgaagaatcaccaacggtggagacctccctctgtgaaggagggcccgtggcacctcggccacagctctaaaatagggctcaaggcatgacattgaaactacttgttgctcctacttgattttacttgattttacttgatgagtcctctctactgacaccatgggttgctgtggttgtggaggttgtggtggttgtggtggctgcggtggtggctgtggtggtggctgtggcagatgcaccacctgcaggtgctaccgggtgggctgctgctccagctgctgcccctgctgccgtggctgctgtggaggctgctgcagcactcccgtgatctgctgctgccgccgcacctgcagctcgtgtggctacagctgtgggaagggctgttgccagcagaagtgctgctgccagaagcaatgctgttgctaggagggaccccagcctctgggcaggtgccctttcttgggcttggatttgtagactttgtatactttcatcacctctggttcacctaaatattgagtagtggtggccaggcgccgtggctcacgcctgtaattccagcgttctaggaggccgaggcaggtggatcatttgagatcaggagttcgagaccagcctggacaacatgatgaaaccctgtctctactaaaaatactaaaattggccaggcctggtggtgaatgcctgtagtcccagctactctggaggctgaggcaggagaatcacttgaacccaggaagcggaggttgcaatgagctgagatctcaccattgcactccagcctgggcaacaagagtgaaactccatctcaaagaaaaaaatacatatatataataaatatatattttatatatatatatatatagagagagagagagagagagagagagcaagagagagcagcatgtgatttcatataaatacacctgatttagaagtcacaagcccaaattcaagtccatgctctgccacagcagtcagccacaaacaagtcagtcagcctcccagagtcttgcttattcacctataaactaataagtttgaactaagaattagtaaggagcttttcagttttaacaacatgtaaatctattgagatctattgagttcgcagaactaaactcacaggctctccagcctcacgctctgaagatttctcttatgtatcttatgcttttacatatatatacctttgctatagtgggcattaaaatttgttaacacgaaaaatcacctttaatctcatatgattcatcagttataatctgcactgcaacaaaaacaggccgtagcttacctgatgaaagttcaaaagtttacattcatgagctcagtggaatgaaataacgattactaatatattccattctttcaaaacatttactaaatgtggaaattctgtgcttatttacctgcttatattcgttgtatactatatattggctacagcttctagtgttcccttatcttcctaaatataatttaataaaacactagaaaaatattgtatttcactgtgtttgttttgatttgtttttgtcttttttgagggaggggtgagagtgatgaagctgatgtttggcaacacatattgcaaactttaggaaggttgtaagatgaaagacaagggatattcggaatttattagggtaatattagctacaacgaagcttttcttgttgctgtcaactatcctgggcagttttaggtgggcaggaggggatgaggattcgggcagctattcttcactcagttatttagggatctaggctgaagacagcactggcattttcaagatatggcttctaagatggcttagtgcgtccccagtctataggtagaaaagaaaagaacagatagcccaacacttcttaagcgctgtggcttgacagtgacacagcttgtcattggttagaagtaaccacatggtcctggccagggttggtggctcatgcctgtaatcccagcactttgggaggcggaggtgggtggatcacctgaggtcaggagttcgagcccagcttggccaacctggagaacccccatctctactaaaaaataaaaaggaattagctgggcatggtggcacgtgcctgcaaccccagctactcaggaggctgaggcaggagaattgcttgaacccgggaggcagaggttgcagtgagtcaagattgtgccactgcactccagcctgggtgacagagtgagactctgtctcaaaaaaaaaaaaaaaaaaaaaaggaagtaatcacagtaatcacatggtcttgtccagtccatagctagactgacacttccccagcaacaaccttgtcatatgaaaaggaaaagcatacatttctcatggacagttagctgtgtctaccatataaagctcacgttctagtaaaactcctagctgatttgactgcagtgtgtttagaaggggataccctgaggtaactctggtgggtgtttaattcccatttgtatcacatgaatttcccctggaagtagtgaaactggtccctgcagtagatcattcttcaaagaaaagttttttttttttttttttctttttgagatagcatctcactctgtcacccaggttggagtgcagtagtgtgattacggctcactgcaacttccgcttcccaggctcaagcaatcctcccacctcagcctctcgagtagctgggaccacagatgtgtgctaccatgcttggcttattttttgtatttttttgtagaaacagggtctcaccacattgcccaggctggtctcaaactcctgggctcaagtgattcacctgtctgggcctcccaaagtgctgggtttacaggcgtgagccaccgtgccaaacacaagtttttctaataccattaacactgttctcatttgaattaactaggtagttttgatttgttgtttaaaatgttgcatgtcattctagagttacaagcacaaacatggttcagattcttataaaaggatctagatattctagagaaagtttcctccgtaccatttaaatgagatcatagtggtggctatggtgaactctcttgctcaatagccatttccatgtccctctagtatttgctttttttccatatagcagaggctgagatgattagaaattacatggcacagaattctctgcatctgggatctggatattgcaagaattagatcaacccctgaggggtataaaaggcagaaatgaggtgaaggtcattttcctccaccttttatctgttgttgctgataaggaagattagggtggaggagttgagttttctgcactgcagcaatgttcctgggtccagatagcgtcatgcaagttaataaccagttgcagaggcagctgtagtcagctgggcacccaccaccccacccaaccaatttttgtattagctgggcgtgttggcaggtgcctataatcccagctacttgagaggctgaggcaggagaatcacttcagcccaggaggcggaggtaaattcagtgttgtagcattcaatcactaacccggggtgtgcagagtggtgatgacaacagcggcaatggttcctggaccgcagccgtactggggtgtttgtgaacttaatcgttccagagtggcttcttgatgtccccgccttttttcttgacagagtctcgctctcgttgcccaggctggagtgcagtggcgtgatcttggctcactgcaacctccgcctcccaggttcaagtgattctcctgcctcagactcccaagcagctgggattacaggcgtctgcaatcacacccggccaatttttgtatttttaatagagacggggtttcaccatgttggccaggctggtctcaaactcctaacctcaggtgatccaccccaccttggcctcccaaagtgctgggattacaggcttgagccacagtgcccagccttccctgcctttttggctactgcagagacagcggcatctcccgggccagttcagcagtcgggacctgcgaagcatttctgcagataagtctagaggctgcttttctagcccttccagcaattttgtacacatgattctcccattacatctcttcccaattccatagctagaatttcagttttctgcaactaactgacactagtctatgaaacgcccttctatcttttataccaaattctagccacgctccaaagctgtgtggaatcctggctcccagcccttcttgatggaatcttcctttttctgaactccaaggcttttgctgttttggcacgccatgtgacaagttatttgcatacttttccatccttggttttagcaacttttagttttagctcttttggttgcagaaaaatagaaacccactaaaaacaatatgaaaggataataatatagaggcatctcatagaaaacaaagacagagtctgcagtcagttttcatagggtagaaattaagacgtaaaatgccattgagaaaccaagcagtcaccctttctctaccaccctctaaagctgtgtggtctcctacctcctcttcctgcatatttctcctctctgtctctcctcctccttctgtttgtatagattggtttctctgtttctcccagcagcgttcatgaattcattgtattgtattgtatttttattatttttatttatttttctttttctacagaagggtctcactctgtcgttcaggctggagtgcagtggcatgatcatagctcactacaacctccaacttctgggctcaagcaatccttccgcctcagcctcttgagtaggtggggatttaggtatgtgccaccatacctggctaaatatttttgtggacatggggtctccaggctggtctcaaactcctcacctcagatgattctctcacctcaacctcccaaatcactgccattacaggcataagccaccgtgcctggccgttatttttattttttgtagggatggggtcttgctatgttgccctagctggtcttgaattcctggccccaagcactcctcccacctcagcctcccaagtagctgggattataggtgtgagccaccaagcctggttaagctcatgaatttaaatatggtagagacttctagttgcctacccaatacccttggtctcgttctccccagttttaactgggcacagatcacttggaataaatactacctttcccatgctgctacatggctacattctaggcaatgagatggctctttgaaagaaagagggtgagcctttctcttctttgatccttcttgttttatttattttttcttcttctcttcctttatccttctgagtggggagcagatataattgttggagctatggttgccacattttgaatgtgagaatgaagagatcagatgaagagatgcactgaaaggatctctgaggaagtggagctcccactccaactcttgagtactgtactagtctgttctcatgctgctaataaagacatacctgagactgggtaatttataaaggaaagaggtttaattgactcacagttccacaaggctggggaggtctcaggaaactttcaatcatggtggaagaggaagcaaacacattcttcttcacatggcagcagcaaggagaagaatgagcaaaagggggaaagccccttataaaaccatcagatcttgtgagaactcactcactatcaggagaacagcagcataggggtaaccacccccaagattcaattacctcccaccaggtccctcccacgacacgtgaggatcatgggaactataattcaagatgaaatttgggtggggacatgtccaaaccacatcaagtacttatcatctgactttgtgaataactttctatcttaagccatttttattttaaatttctttttgtgtgcaactaagcttaatcttaacagatacacatgccctcccatttcatgcatactggggaataactaatttctcttggtttcaattccaagctcctagagagattggaagagcatagcttctgtatctaccagtattccgatcaacaatggccaggggagcaaagttccataacacaaatggaatacagaggatctatgcatgtaagttacggggggttgtttttacagaaacaggcatgtgtgttgggcagatactaaaaagtggtcatcattctcctcttcagttataagctaattctcttttcagctttatactgaaatatcttccccttcatcacatacagattaaatttctacatttttacagaattcttcagatacttccttttagccacaaatgtaaggagtaccaaacccgagtggaactatgttatgcccactagcaaaagcatgcagcttactcagttttggtcaaatggcaaagactctggaaatcagacacttgattctcacagtcaggtggagtccaaccgatccagttccctacatataaaatgattccctaaacagttcttcaattcaacatcttatgaagacagcaaaaagatttgaaatggcacaacccacattctaaggtaagtaactaccacctcccactcattcaagtcagtaataaatatataatttatgtattgtaatatatagttatagaatgagataatttatatgacttagtgggagggtaaattttagttattaatttttataaaataaaaaatatatttttttagaatattatataattatagtagaaatctcaaccatgcagaagtatataaaccatacaatggaagtgtctcctgtctctcaacccagttgtattctttcagttattctcggtgttttgtgtgttgtgttgataggtgggtgttttttgtttttgttttaagatggagtctcactctcttgcccaggctggagttcagtggtgtgatcttggctcactgcaactactgccttctgggttcaagtgattctcctgcctcagtctcctgagtagctgggattacaagcacctgccaccacacccagctaatttttttgtatttttagtagagacagggttttgccatattggccaggctggtctcgaactcctgggctcaagtgatcctcccacctcgccctcccaaagtgctgggattacaggggtgagccaccatgcccagccaataggtgggttatttttaatccttttatacaaatcctttcatacaaaggatttcacatttcactgaggtccagtaactggaccccctagtctggagctactgttttggtgtccattaccagggatgccccttgtaccaggctgtgtgcgccccccacactgctgcagggtggagcgctgctctctaagcctactacgcctgagcttttggcccacactgactgcaccgctgcatacattatttcaccattcccaacagcactcactgaatctatgctcctgggctgagcgggggattacacagaagcagaaggaaggcgctgtagagattagagctgcctaatgtcccaatcttttctcctagacatattggtttgtatttccacccacttgaactcatgcataactgagtgacttttttggccaatgaaatgtgaacagaagtgatgtgggtcgcttctgggcagaaacatatagatccagtatgtggctcaccacatttttgtaccctgcctctgtgactgtggaagcctggatcaagaagctgcctctgccagtctaggtctaggtctaagtctaggtctttcagtaactaccatgaccccatttagatcaggatggtcagtcagcataagcaagaacttttgtattgtttttgttttttgagatggagtctccctctgtcgcccaggctggggtgcagtggtgcaatctcagctcatggcaacctccaccccccaggttcaagtgattctctggcctcagcctcccaagtagctgggatcacaggtatgtgccaccacgcttggctactttttgtttttttagtacagatgagggttttgccatgttggccagactgatctcgaactcctgacctcaggtgatcctctcgctttggcctcccaaagcactgagattacaggcgtgagccaccgcagctggccagaacttttgtattttaaagcttatgccaactgatagtcttttctcaaggagctcaccagctagtggagaggcaatgtggaaccacagtctagagatgtaaagtactgcacatggccaagtaagtgttcaagggcttaaataaaatatgataatctcctcatccaatctctctcctattgctatctttcagtctggtagcattagccaaagctctcacatgtcttaggtgggctatctctaaatgggttagtctgcaacactggaataatatgacataaacattttcttttgtgtatgtgagcatacggcttgaaataaactctaatatttgcagcagaggaaatacctttctccacatctcatatgtgttcattttcttgttgaacaatttcaaaataagaaacttccatagctggtaataatatcgatagaacaggaaaatatagtttagctggatatttttgtttttactttttagaagccatactaataaaggagtatattaaaggagcttatcgtaagcctatcttcttacataaatttatctcatagatttttttttctgctttccttccttcacctcatcataatatggaattattttctcatttcccatcatagtcatcataataatgtcctaccctattggactctgaactattttccactattcattttttattagcgttaaattttaaccagaagattgggataaaaggcaacatagtaccatgcaagcatagccactttgacaacgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggtgagtgatatttatttgacttgatgtgaagaagggcctgcctatttcaccaaaatcctaaaagctgtcttccagtcttgcagttaactatgtcttggcttatgataaaatttggagcagtagtatggcattaatttatattggtcatcagtgaagaatggtaatttaaataaagtacactatgtggtataggatagagagctgggcaaaaaaataaattaattagtagaagttggctgggttattatctctcacatttctgtacaggtagggctgctctttcaagctttgtggttagagttagggaccttctgaattaattccttcaactttccattgctccataccagtctctaagtatttacagaaaatgcaataggagtgacaggttgcttaatagggatgagtagaaacattcccatgtatgatgactagcctgggtgatggtaattacgaggcatgaatgctgcattgcctgtacctgaagggagttgggctaagagacatggacttaaaatcctgggtctctggcctcaaggaatttttgactcagctattatatagatcctaggacatcgagcttgttgaatagtttggtgattgttactaggtctacctctgttgaaatctgcagcagagcagtgcaggatggaactcctaaatataactgacatgaatcacccgaggcacttgcaatagttagatttacggattttctcctgagaattctgggtgcagtaggcctgggtaggacgcatttgtatagggaaaacggctttcaaatatggcagaatacctcagctatggttctgcctcccatataccactgcaagcaaatcatttatcctatggttttgtttccatatgtgtaaaatggggatgtggatgttgaagttgataattcagcatccaagaggcttgtttttgtttgttatgccactagggggtttagttagtgccaaataaatgaatgtgtgtgtgtgcctgtgtgtgtgtgtgtgtaagacagagagagagagagagagtaagctgtaaggactgatattatcagtgttttagagataataaaacacggaggtgacttttttttaacttttttttttaagttttcagttcagaggtacatgtgcaggtttgttacataggtaaacgtgtatcttgggggctggttgtacagattatttcgtcatccagatattaagcctactacccattatttattttgcctgatcctctccctcctcccaccctccactctccaccctccaacaggcaccagtgtgtgttgttcccttttatgtgctcatgtgttctcatcatttacctcccgcttacaagtgagaacatgcggtttttggttttctgttcatgcgttagtttaaggataatggcctccagctccatccatgtccctgcaaaggtcatgatctcattccttttttatggctgtggaggtgatttttaaagaaattcaggacatagttttctacttgaatcactgattctgaattatgatcagttactgctgctggtattatccccagatttacaaaaacactcttcctttaccatcacaaagaatctgttcctctgctttaggtagaaagatctaattaaagaaaaagcttttggaaagttttgggctatttcttcacactgccatgaatgctctcttccaggctgagagacagaaaacacattgcaactcaacagcatgaagcaactgtacatccgtgtgtctgttttcttccctgtagaaggcttctctctgcttgagtagtagaagcctcttttgcatttgcttacaccagaagccaggagcagctggctgagcatgacttaacgatagcaatttccatgaagctcctagaagttcctgagttaagacaatccacttagaataacacatgcagctttagatataaattggctctgccacaaatcccatgagattaaaaaaaatgtattagcattaaaggagtcggaggtggcgatgacacatacctacatctcctgtattcttcattttaggatggtggcgggtgtggcagggagagaagagaaagagaaaggcagagacagacagaaggacataagtgctcatttattggccgtctgccaaaggccagctactgggttcatacattaccttgttatctcatttagtctctataataatgtgtgcatttattatcacttgaattttataggccagcagatagaaagttaggaatgttaacaaggtcacctaatggatgtgaaattccagatttatctgacgtcaaaactctgtttttccaccagtgctagtaccgtagtcctcaacacctgtctcagggctgccagaggtgaaagatataatctataaattaatccataaagtcaagtgaccaggaaactgagtcacagaaagattatagaaactcgtggaacagtttcagagaatctgaacttcctcgttctacagctaagtttactttatcaccctcagtaagtattatcaaagatataaacaccagactatctctattattctgtattatagaatgtcattaaagcatcagacaactctttgaaaagtccaatatgaactttatagacagaggctatgcccacaagcaaacaggtgggtggtaaaaagggctcagactacaggtatattttcatgatcctcagatagatagagaatgtggaagaaagtgtttttcaaaggaatttattaatatgtcctttataatatccatgaaaatactcactagttcaaaatactgagctttcaatatactagtaactacacaaaaaagttaatagagaagaaatcactgcctgtgataagcactttggtcatagttcttgaaatctttccagaattactgtagtgtttcaaattagtattgttaccaaaaatgggattttgcaggaagtagataattatacaaactatggaattcattattgattacatcatgaaatatattcattttatggcttcatgacttacttaaaacggaggcggacttttcatcttctaaaaccatgactaagtaaaaatgtgatgtacttaattatctttaactttaaatggaaaaatcaatacaaatgttatttgttcgagtatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatggtggtgcatgcctgtaatcccagctactcgggaggctgaggcaggagaatcacttgtacccagaggcaggagttgcagagagccgagattgtgccactgcactccagcctaggtgacagagtgagactctgtctcaaaattttttttttttttttttgtagatagggtctcactatattgcccaggttggggtcaaactcctgggttcaagcaagcctcctgtcttggcctcccgaagtgccagaattacaggcatgagccaccatgcctggctgcaaaatatagttttgatatttgtaatgagctatgactttgtgtgttactctcatgttcaagttcttagaggactcccaaaagtctgaatttcatcacaggatttttaatggtctgaagtttttccacacttcatttgtaaaatcatgtaacttctcaaactaaatacaattagggggctctgtaagaaaaaatcaacaatattactttcctttttaaaaacaaaagactagcaagacttttaattttacaaaaactcaggcattcaaatatgcttaggaaatgaagagaaagtgtgttctcataattactcattttggcaggagattatctggaaaatttatatataattcatacacacacacacacacaccattcacagttttagtgtctgtctaaagagcccctccaatttccggagctctgaatgggaaagcggttgaaaccgcagcgagttgtcaaatcaccagtaacagcattacaaagatgtgttaatacgccttgaagtcggtggggtggtgacttatacactgtaagtaattgtccctttataaaacccctttgtaagtgaatcatgaaaggaaatatttagtaactctgaaataaacttatcttcaagaaagttaccagagttcagtttgcatcaacaaggaaaatagaacaatttatccatttaagttgtaatgtcaatccacttttttttttttttttttttttttttagacagggtctcactttgtcatctaggctggagtacacttgcactttcttttaaaagaatcattaattttctaaatctgtagctggcaaactgtaaatattcagccaatattttaggtttataaaccagcctcttccacatattttttttttttttttttgagacggagtctcgctctgtcaccaggctggagtgcagtggcgcgatctcggctcactgcaacctctgcctcccgcgttcaagcgagtcctctgcctcaggctccctggtagctgggactacaggcacgtgccaccaagcccggctaattttttgtattttagtagagatggggtttcaccatgttggccaggatggtctcgatctcctgatctcgtgacccgcccaccttggcttcctgaagtgctgggattacagacgtgagccaccgcgcccggcctcttccacacaatttaactctactcttggtgcacaaaagtagccatagacaatatgtaaatacatggatgtgactgtgttccaataaaactttatttacaagaaagaggtggtgggccatagtttgccagttcccgttctaaatgatttgtcctgtaagctcaaaaggcagtacagcttatgtgtacaataaaagatgtttagtgcacgaatactgatacctatttgggagctaaaatttcttttcccttttcttctgggctttcagctatgcgccaaggtggctaggcagccatatacacatgtggcctctaaataaggagggtggtggtgttcaaggcaatgtgtaagcaaagcttgataataatacaaagtgacatggaggcagtacatcatcagatggagtgaggtttgttaggaaagctgccttgtaaagaggcataaactttaaacccgtgctaaaagaataaaggcagatgtggccttggataaatgaatcagagtgggagtaactggaaggacaatgagatgggcaagggtgaaggcagcagggaagatgagaatgaacaaactctaggtaggaataggggagaattgtaagacttgagtcagtgtggaatagggattaagagtcccggctgagcacagaggctcacctgtaatctcaatgctttaggaggccgaggcgatcacttgagcccaggagttcgagaccagcctgggcaacatggcaaaatccccgtctctacaaaaaaatgccccccagaataaattaaaactaacagggcgtgatggcatgcatctgtagtcccaacgactcgggaggctgaggtgggaggatcacttgagccctgggtgttgaggctgcagtgaaccgtgatcatgccaccgcacttcagcctgggtgacagagtgagaccctgtctcaaaaaaacaaaacaaaacaaaaaactatgtgggctctgcaccccaaatgactagctttttttgttgttgttgtttgtttttttgagatagagtctcgctctgtcgccaggccggagtgcagtcacgtgatctcagctaactgcaacctctgtctcccaggttcaagtaattctgcctcagcttcctgagtagctggggctacaggtgtgcaccacctcgcccagctaatttttgtatttttagtagagacggggtttcctcatgttggccaggctggtctcgatctcctgacctcgtgatccacccacctcggcctcctaaagtgctgggattacagacatgagccaccgcgcccggccaaatgactagttttgaatcccaacccttctaccaagaaagtagaaggacaatttgagtaatttgtcctttctatgcctcagttttctcattggtaaaatgggaataataatagcacctacctcataggattattatgaggatggaataaactaaggcgtgtaaagtgcctgtaacagagtctggcattcgccagagctcgggaaaatgttagagaatgagagtagaaggagagagaaaaaccactcaagggcagctgtgctgagatggcaaaaaaacctacgcctaaaatttctcaagcggaaggaaataattacattccacccttcaatgatacaaaactccttccagtaagaatttctagtcgtagctgctgcctagatatactaaaaattgaaacccaagtcctgagaatatggtgttctttcttacagctttccttggcaacgtgtatttccctgaaggcagaatgcgatctatagatttctgagcatcaatatataaagtgagatcattacatatcatggatataggaagagaaaggagaacgtggaaccaaaaataattctcaaatataagtttggggaaaccagcaagatagccgggatcctgggaaaagaaaggctagtgggagtgggtggtgacagaatgatttgttcccaactgccaggcaaacaaaaccatcaatttcttttctgcaggtttgccagaataatccatacaatttctgggaaatcgggccaggcgtaatggctcacatctttagttttcttggcaggaggttttcttgaggccaggagttcaggaccagtctgggcaacagagtgagatcttgcttctacaaaaatatttttaaaattagccaggtgtggtggtctacacctgtggtcctagctactcaggaggctaaggcaggaggattatttgagcccaggagttcaaggctacagtgagctatgctcgtatcactgcactatggcctgggtaagagagtgagacccctactctttaaacaaacaaacaacagagtttggatgatgcagccaattctttcagaaacatttcttccaaaaataatgtataaataagtcatcctaatctatttaaaatccaattctctgcagatgactcagagtgaactaagaatgtagatagaagacttcaaaactcctgtcttgaattcccctgttcccgccgccacttttaatctttctggttgaaactgggatgacaaggttcacaaaaccacggatattgccaaattccctttttgttctttgagccttgatttcccacaactggtggtaaacggaaggtgaagattactattttttcttctgatgagaagttataatactcatctttcctgttgatgtcatttccaggccattccagcaacaacaatgtccttgacagcaagaaaaagagcgtgctgcaacaacagaactggagtaagtatgaagcagtcggcgtggaagcagaagtgcatgaacagttattgctacctaagcaaagccacactgagtcactcgcatctaccgaatcacagtggggctccactgacagagccacagccttagaaacatgctatttttatttatttatttagagacagggtcttgctctgttgctgagactggagtgcagtggtgcgatctcggttcactgaaacttctgcctcccgggatcaagcaattctcctgcctcagcctcctgaatagctgggactacaggtgcacaccatcacgcccagctaatttttgtatttttagtagagatgggggtttcaacatgttggtcaggctggtctcaaactcctgacctcgagtgatctgctcgcctcggcctcccaaagtgctgggattacaggtttgagccactgcgcctggcctgaaacatgctatttaggatgattatatagaagtagaaaaagtgagacgggtttttttgtcccacaaacatttagagttggccttctgtcccttcctcagtcttccgtggattgtcctttcctcaatctaaaggttttcaaagaaaggagattggtaagtcacgcccacagctgcaatcaatttcataatactcgggtgtgatatttttgtggcgtatataaaatactcagggaaaatgtactcagttctctcatgcaatgacagactggtttgctaggattagaatgacaattgcctttatccagttaaattaaaggagctgccaggtttttttcccccaaaacatttaatgcctacccactatgtataaagtcgtaacgaagttaaaagtaaattaagattcattaaccggagtgtcactctgctcagaacactttcagagatgctgtttcatttaattactactcaaaacccttaagtgggaaaaagtaagaagtgtgtttgattgacgaaggaaggacgtcagagaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatacaaaaaattagccgggcgtggtggcgggtgcctgtagtcccagctactcaggaggctgaggcaggagaatggcgtgaacccgggaggcggagcttgcagtgagccgagatcatgccactgcactccagcctgggcgacacagcgagactccgtctccaaaaaaaaaaaaaaaaaaaaatagatggttaaaaataaacaccatggcacttcttgatgagtacatttaagtaactgcacaagtcacagtagcatggaagaatcaggatttgaagtagactccaaatccatcattctgaacttttggctggaagaagaatagtgattaaagtgtttcccagctgtgagagcctgacaagttttgtccatctccatgatacacagttttctcatctataaaatggaaataataatagtatgctacctcttgggattatgaaaagaattaaatgagatgatatatgtagagcacaacatccctcaacacaactctataggtagccaccttattctgcactcataaaaggcaggtctcaagaacacaacacacagaccctgtgggagctgcattatcccagcaaagaaaaaggaaaagcattccctcgcttcatttctgctgattttgaaataatcatcagtgactaacaacttcactgaaacaatacaaaagtttccttcttttttttttcttttagagatgggctcttactacgttgcccaggctagtctcgaactcctgggctcaagcaatctaccctccttggcctcccaaagtgctgggactacaggcatgagccactgtgcctggcctaagagcttatttttggaaaaacaaacacgaactttcattcagtttcctatgccaaattccatgccttcttctgctctcatgactgactcacgaaataaagatgtgtacaatctttctaacacagtggctctcaaccggcgggttattttacccacccacctccaccccaagaggatatttggcaatgcctggagacatttttggttgtcagaaccgggctggaggtggcaaggcgtcgggggatgatattggcatctagtgggtagagatgagtgatgttgctaaatatcctacactgcacaggaaaggccccacagcgaagtgtgcaaatgtcattggtgctgaggttgggaagtcctgttctaactctatgctgttgactgatcactgtgggatgctggccactggccacttaaagcatcagggccaaattcacttaaagcatcagggccaaacgcttgcgagccaagagaccagacatgaagataaacgtagttaagatccagtcaagattctatgaagtaggaagtacataaaacagggaggaactagatctcagtggtcagaagaaacagatgagactcaggaatatgaaagttgagattttccagagacagtgacaagccaaaccatctttttttttttttttttttttttttgacagagtcttgctctgtcacccagcaggagtgcaatggcacgatctcggatgactgcctcccgggttcaagcgattctcctgccttagcctcccaagtagctgggatcacaggcatccaccaccaagcctggctaagtttttgtatttttagtagagagggggttttgccatgttggccaggctggtcttgaactcctgacctcaggtgatccacccaccttggcctcccacagtgctgagattacaggtgtgagccaccatgcccagccccaaccatcttttattgagtgtaatcaaatagcagagactgccctctgcctttttgtatcattcacacctaataaactgtgatcttaagatccaggattttagggcgactggatttaaaaaagactgtatacgctcctgaagcttgaaacagatcaagaacatgtcataacatgtgcaaatggctctattttatttttcagatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcaggtaagtaacttgattttcacaggcttactgtctcacacagttgaactagtttgattagattaatgcagtactggaacaatgccatgtttttatttgatgcaactgccgggacaaacggattcttaggaattttagtacattaacgccagttagcacaactccacatcaaaatggaggaatcattagatttacaatgctctaaaaggacttttagatattgtctaaaaggactagttgatctcaaatggcttatgcttgtctttcaaaaatctacagttacatatgtgtatgtatattaaaaaattatgcaaatatacaccagaaacttaactttcatccttggagaatggaaataggggattccctttatgagagtgaagagaacatttactttctacacttctgaactaattaaatttgtcaaccatgagcaaatattacatttacaatttaaaaaatttaataaaaacacaataaataaaatgcagagccttgcctgtaggcttaaatggaagagcaaccaatggattcatacagatatgctataaatatactgtatgcatgggaatgaatccaaattttaagtcatgtaataacaagtaatactggagagttacatgtacttaataagtggctcattttagtcttttaagtacatcattctgtgactgaatctagacacaatttgtaaaaactggaagaaaaaaactatctaatccattacctctctgtatagcctgctcagtttagcaaataaccagaatttacttttgtagttacatacaaaaaattttttctccttttcccttaccttgctacattaaaaaagaaagtccctcaaattttgtgtagcatatttgttttgaaccaaaacccaaggaaggccaggcacagcggctcacgcctgtaatcccagcactttgggagaccaaggcaggtggatcgcttgaggtcaggagtttgagatcagcctggtcaacatggtgaaactgcatcactactgaaaatacaaaaatgagccaggcgtggtggcacgcgcctctagtcccagctactcaggaggctgaggcgggagaattgctggaacccaggaggcggaggttgcagtgagccaagatcaagccactgcactccagtctgggtgacagagtgagactgtgtctcaaaaacaaagccaaggaaagtctccttactaatagacttgaagtaaagggttaaagatttctaccacagatgctatgcacattaaatccccagggaatgacaacagcccacaatgtaccaggcaccaggctacgctctgcagacaacagcgctcagatattctcagcctagttgcggagatgggctaggctagcaaagttacaagagagtgatccttggcttgctacacatttcacaaaacactcatattccatgtgctgaaaatactgttgttttcccaggttgaatgtcagttgctgatatccagcaatgcaaactccctaagaacattccattttactctacagtaaacaaacaaaaaatcatcttgagatagatgtattagggctaaaagtttctcattttccacagccccgttaagaacaggcacatcactttaatcagacatatttaatcagtaaaaactgtacatctggttgaagaacggacgccacgctgtagttctgcactaagaactgagctcatttaatgggggtggcggggggtaggggaggctccttagtttttatatctagcaagtagaagagtatctgaataaataaaataaataggttgaaccacgaaaaactgttgacattcaactatttctgacatcccaaaacagcagtttcataccgttcaacctaagagaagatgtaccatagagatgcttgttaaatgatgggctatataagtaataaaagttttgtaactagtagagtatatggacacatgctcagaaaccctgatctctgtcatttctgggcacgatatttcaaaagtacattcgtttcactcattcttttatgtgcacaatgctactttcctttggtcagggatatttctgaatatctgatttttatcttttgtttttcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcacggactcaagtgatctgcctgcctcagcctcctaaagtgctgcaattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaaatctaaaattttctgaatgttatttctatatttcaattgtttatgttcattgggcttaaggttccagaaataatttgcagtacctacattatagctgcctaaataaatttagtaacatcaagagcttataagccttttttctgaacatttactatataaaaacattcttcctacacccctacaaatacttacttgtccttaaggcctagcttaagtatctcctacttgaggaagccttcccagtgctcatgatccaataaaccaagtcagcacttacccaagcctctattatcattcctgtcataatgtaacatacatgtgtttgtacgtccatcactatagtattcaggagcacaggaaccatgttcatcagccctcacctcttcaggtccttagcaacgcctctcatttccccacctccagccccattcctacccccacctgccttatctctggcagcactctttatccttgacttcagcacaaataccactttttctgagaggctattcctaaacgtctaatgaaaactaggtttccctttactcttttaccatgctttcatttacagcatttatcacaatgatgattgcattttcctttgtgcttgcttcttaaatttcactgtcccccattagactataagctccaggggtacaggaacatgtttattccctcctggtataaagagtacttagtacagtgcctggtacaaagcagaaacattgcatttagttgaatgaattaatgaatcctatcttcagtactcagcttttagcgaagactcgatacttactcaatgaactgtcaaactgctaatggtcatgtaattaaaacaaaaataagacagctcactgtactctagtgaacaagggtcagcaatggtgcttacaaattttctcatcaccccccaaaatatttatgccatgtactttccccaaaatgtgacttcattaattcagccagtgaccagagtatccttacatcaatgagtaaatataaaaactttattggaatagcatgttagcagcagtgaacagggcatggcacagaaggtttccaaaacaagtttagcatgaaggatgccatatgctgttgccaacaactagaacacggtgactaaagacacagttctgaatgtccagcacaacctctggcctgcaactatgttcagtgatgatgataaacaaggtggtgacttggaaggaatccctatgtcaagtgagaaaaaaaaatgatgtctgacctccttatatatgtaaaaaatataccttcagagtccgtcagtaagctggaagaagtggatgttgaagtttttaacatcgatgatgggtctccagttgttcatcaacccatggtgaaatagctgaacggttctgaatcaaaggtgatcctaatagtgaagacattaacattgcagaaaaagtgcctacagattatatggtgaaaatacgtgatgggcttcttgaaggactagagcagtgtgtattcaaaacagaacaagaaatcacgtcagtttataaaagcaaagagaggtttctcagacaaaaacattgttcatgaggtagatgactctggaagaaatactttaaaaagccactgagaagaatgcctcgtctccacaggatccacttcctagcctctcaactgcttctcatgtttcttctcactgaaaaaaatagtgtccagtaatctttactccaacagtaccgccagtggggacaggaaacttgccgtggctgttcttggttgtggctgttgtctaacagctggtgcagtatctggtgatgcccctgtgctgcttagttacttgaacgcagttttttcactgtattaatagtgtgtcattttttaatgttaagtatttatgtgtgaaaaagtgttaagaaaaaatgactgtttattggcagcatatacactcagagtcaggaatgatagtgatggcaaaaaacccgactgtccacatgcgtggctgagatatcactatgacatctttgctttttgctttctgatggttcagcatacacaaactttgtttcatacacaaaatttgaaatattgtataaaattatctttaggttatgtgtagagggtatgtatgaaatataaatgaatttcatgtttagacttgggtcccatcctcaagatatctcattatgtatatgtaaatacttgaaaatctgaaaaactctgaaattcaaaatacttctggtccaaagaattttggataagggctgggcaatcactatagttaaggagctggaaacacacattcatgcaggaaggaaggaaaaaggaaagctctcttgaaaatatactacttccatgatgttatccttcaaagtgtaaacaacctgcacatacttcaaccataattactagaagtggggagaagggtgcactttcagtagtgcaacaatatatttgctatacttagttgtatgatacgactttggctcctgactgtatccatttctccatctatcatctgcacctggaatattttcttgttctttctctgcttgttgaaaggctcagctcaaatatctggttatactaaccaggaactaatttgttcttctcaactccaaaatatatttcaacagtaattaacaatttttaggggaagtacacaggtgtttaatagagatcctaactttggagttagagagattcaagcttttctacttctagatatgtgacaaggtcaggtaaggcaggtttcttggttgtccccttttgcactgtaaacagagttttcattcaccgtctgttggggtcttagcttcattcacgagtctcctgttacagctggtgcctgcctgaggtagggaagtcgatcttctaccccttgcacaatcattaagggagaaagctccaagtgtccattctttggtaagaatcatgagggaaaaaaagggcttccgcacttctctctcagtattcctgcttttatttcattttttgacctttgtggaatccttttcatgtctgtttatcaaaagatactaaccttatccatcatttttcttcatttttgtgatttcaatttggaggataaccacagaaattaccttctggtatacataaatctagaattaatatagttgcatcattaccaaaagtcagaaaacttctaagtacagagaagaatctttgtcttgatattattttagagggataagaagcaagaacggaaatgctaaatctaactctatccaaggaatttcctcaactgcctttccccaaactccctgccttggaagaaagataccaaagatgtgtggagaatgttgcacctaactgaattctacccatttctgaaccgaaaatggggaaatataagttttgagagctaaaactgtctagcacttggcttcacttggtttaattcttttgagatttacttttaaatttttagtttttttttgagacggagtttggctctgtcactcaggctggagtacagtggcatgatctcagcttactgcaacctctgccttctgggttcaagtgattcttctgcctcagcctcctgagtagctgggattacagctattgccaccatgcctgccaccacacctggctaatttttgtatttttggtagagatggggtttcactgtattggccaggctggtctcgaactcctgactcaagtgatccacccgcctaggcctgcccaaagtattagnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcagaccacctgaggtcaggagttcgagaccagcctggccaacatggcgaaaccctgtatctactaaaaatacaaaaattagttgggtgtggtggccagcgcctgtaatcccagctactctggaggctgaggcagaaggatcacttgaacctgggaggtggaggttgcagtgagctgagatcatgccacgggactccagcatcagcaacagagcgagactccatctcaaaaaaaaaaaagtatacacaactcaaggtatttaaacctgaaccactttatagatattataaattagaaaaccacctacaatgcaaccaacagccaccaccaccaggatgaaggtctgaaaggaagcacagcaggttcttgctacctaccaggtcattaattgtattacttgctctgagacgggaagactcataaggtaatatgatacaaaatgtagctgattgcacaaatgatgaaataaaatccttcaacagacaaatacttctttggttgacagtttattaaatacactacatttgtaccttattctgtcgttttttaaattgttcacgcatgaactgagtaaaaacgtactttatagaaaaccaagtgcaaaactaaaatgaaagaatgcacatattgcacacatatgaaactgctgcaatgttagaaattaatctgtacaagtacctaatgaagaaggttatgaaatattaggtggttcgagtttcttaaatctggcaccagaccatgactttgaaagtgttaatgttgaagtgtcgatgcaaaaatgtctattaacaaaactgcttaacactgtttgagaaacaggacaaaataattgtttttctttcacagacacttttctgaatcaattctctacagactctctcccattcagaatcagttgggtggactgatgaggcaaaaaataaattccttttaaaaaacaaaactggagcctatttacaaaacatgcaaagggagaattttaagcaggtgttactgcagaactgctcagacgtgaatacagctgagtgacagaatatacctttacttctacaaatataggtccttcctccagactttctggaagaaatacattttcagggtgtggactataaaatggcatacaatgcagagacagaaacaaagaagtttgcaaatcttttatatttccagctgttgagacagtatttttgagggctgatgttacctctagcggcgaaaccagagccagctattaagcagccagaaagctacagtaattgaatacatgaccatttctcttttagcacgttctttgttctcctcttccagaagttgtagacgtctatttagtttgattatctaagtgaaaaacaaacacacaaaaaatataatatagaggctttaatgaatagggcaatcagattcttataaagtaagtagtataataatttgtcaacaaaagtattattacaaacatggaaagtttcatttggagcaaaataaacacaactacacatagaaaaacatgtcattcatgacagcttaaattcacttaaacatcctttccctttcccttcttcagatttctgagttaggaagggtgtatttccttcctaacttgattacatagtgaggtgaggaagcggttacctactgttattctggcagaaaagactcagtatgcattttggcaggcttaccacagcagaaagaatacgggactccttcccctttctatgcctctcctatgaacttgtcactcaacctcagttgttcatcttgaacctggcataaccgccttctctgtccacctctgagttactgagacaatccaataaaataatctactgtagggggccttgggatatggcacccaaacccttcaggcctgaaggctaattccccagctgctggaaatgctgctggctgacagtaccatccttgctgttagcccttactgtgaaaatcccagggctgaacaaccacctgctaaagcttgtgttctcctactgatcttcacctaaaaatatcttatttaatccaatttccctctatatctatttggtatagacgcaatgagaaaaccaactatgccttcttcacatgtgtgtatgtctgtgtgatactcgaggctgtgggagtacatattaaaaaatatgcatgtgcaactgcagttctaagaaaggatttattacagaatacaggaaatacgtatgcagggacgctgtgcaagctgcaaggagcggtttccaaaatggagttattaaacacagtaacaaaggttccaaagtgattgttccacatttcaaaagccaaacaagcaactgatggctgtactggtttgctaaagattctttgttactggccagaattacattaatctatcttggtaatactgttttacggtgatcaaaacatgtaaatggtagtttaatatatctttaatcaaaatgagaaaatcaatgatggcttactagtttgatagtcccacaggagagaaaataataaaatgttgagaactatcactttaaaatattgtatgaatataactgagaaatatatcttatttggtacactaaatacctgtcgtcttagtgaagctgcatctacaacagtcaggtcatctgacgttccttcaatggttgtatctatatttgaaatgccatacctgcagataagagatagaaatacaaatgaatagtaaagtagaactcagagtaaatggcacgccacatcatgctttgtgtaatgctcaaagtagtattcagaaaattggtacttaataatatgaattactaaaatattttactacctgaatttgtactaataaaggaaagaaaaaagcttaaaatgacaactgtctacaatattgaaaaagggcactaaaaactggagaatgggaaaaaaatcctgactaaagaaacacatagaaaattctcaagccagaaggattggcgatgctaaaaagggtccctggctgaaaaggtttgagagctgccacttaggatagaacaaaatataattcttacacaaacttatgtccatatgtaagcccataggcacagactcactagcagggaacacaaagtagactaactctaaaaaaagaaagactcatcacctcttctcactgcctcttgtcttgccatttttattctttacttcttgtctttttatttttttgagacagagtttcacttttgttgcccaggctggagtgcaatggcacaatctcggctcattgcaacctccacctctggggttcaagtgattctcctacctcagcctcccaagtagctggaattacaggcacctgccaccatgcccggctaatttttgtacttttagtagagatggggtttcaccattttggccaggctggtctcaaagtcctgacctcaggtgatccacccacctcagcctcctaaattgctgggattacaggcctgagcaaccacgcctggcctattctttacttatttccaattacttatgctctactgtgttctcccgcagaaacaattataaaatctcctgaatacatcttaccactacatttagctccagaattggcccaataatgaataaaatgctgtgtataaaataatactgaaaaaccattaagacaaaatccagagaaagcatattaaaaaagtactttttgttccaatgtagttacttctaaagcggcactaatttctaggtgaatgacactaaacctctgaaaaacaaagacaaacgccattcctcttctttgcctggatttccacattttaaaatttagtttaattaatagcttcattgagatacaacttatataaccacataattcacctcacatgtattttataccctaaatggttattttagtaaaatggcatagtaaattttctaaatgagcagaatataaataaactaaattaaaagttattcctgtgtagtccagagaattggcaaatggatcatctattctaatacctatcccagcaagtccccactacaaaaagtacatacccacaaaaagggatatgaagcagaattatacttttcatccagacatgttaaagacaagtctactcagaaaatccttttgttttaaatattgttaaaagtaataaaaatactttaataaagtatgcaaaaaaccttaaacaatagatggtgtgtactgactctagataatctacaaccatctccaaatattccttctatggctaaattatcctgctttctcattaactgtctccttatttcatgagaacacagtaaacaacctggagcagttagggtaattataccagttagagaagtaaacttctaagttagtagatgctggaactatgggtttacaaatgattagtggaaaaaataaaggtagaagattcccttttccttcacttcatcctcaaaataaaactcttctcttttactgaggccacataacagaggaataattaggaaaaaaatcaaacagaagcaattgttaaannnnnnnnnnnnnnnnnnnnactgaacatacagaatgaagtacaaatgaaagcgattactcacaatttatatcctgaattaactaaggtttagatatctgaaatctcgatttgcaaagaaatataaggatatgacaaaagattttacctatatacttcaatttaaaacaaaaatatgttactttacattgtgttttaaacaaaaaccgtatttattagaactaaaaaactctaatgctaagttagaccactggctgaaaatactctgacagaaagataaaagatcacaaacttagagaaaaatataagggaaaacgacaatgaactgaactaagattgtaaaaagaaacaagtcagcagagtggtaagggattaccacaggcacgcttttcaattcctccaccatgaattcaattttaatgagcagctaatgcttcccttttctcttgcttcaatgaatgcaccaacttctaagcacagaaacgatgctgccagttttaaatctactgctaccgacaatatatttctgcttaaataaaactgactgaaaaaattatacagtaatagcatctgtgaataccaacaagtttttgattttttccagactataggaaaactaaatggggattttggcacttaagaactgcatgtatttgtatgtgccattctgccagcctctgtgcgtgtcaggaagaaaggaacgctcaacctacgcgtgtctgaaagtgtaaaaagggcaaaaataagagagaaggccttaaatcaacagatgataaaaatgcttaaaactaaatttcctttctaaatatgtaccttcccaaactgtggagttgttaatgctgatttctcccaatttaagatgaagccttacaaacaaagacaggtttgttcacacactaaaagtaacattccagataattaacaacttaaaaggaaatgctgggcacaattcaggcaaccattaaaatgatgtacataaaataagatttaagacttttttctgttttagcatgtaaattattataaaccacctataaactattaacactacacttaaataaaatagctgttcacatcataccataattattaaacattttccctcatactaattggccaaatgtcatgactgattattcactgttcttagagagaagcaagatgtactcatcgaggaaagctgtagaaacaagttcagctacaaacacaggcatggctacgacatgcaacatgccctgcaacacacaaattccgccaagcatttaccctggtaattacgaagtctcaaaatttacctgacgttgtcatgatgaggattagaagtggcggcagcagacccaccacgcaacacaggtctaaggcaggtttttgcgggagaaggcacaagacagaatcaggaaacagagaagtaataaaataaaagcaaaaacaagacaaataaatgtcaaataggattatattgtatatttcaatacaatataatatctctcaactactttaaaaaatccttgtctcatgtgtcctccattttatcattttcataaactcaacattactattgatcaaagaaacaaagggaatctatatttacacgacaaaacagcaccaacatataaaataattttcttggtgctttactttatgaaatttaagacagaggacaactctgcttaaaaagtgtaattcctttcttccagttggaaaaaaaaaatcactagcacctttaaaagcatatcaggacctggttagctgcaccg

SEQ ID NO: 65 - DNA, 2294 bp, Homo sapiens
atagccactttgacaacgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcacggactcaagtgatctgcctgcctcagcctcctaaagtgctgcaattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaaatctaa

SEQ ID NO: 66 - protein, 229 aa, Homo sapiens
MTCCEGWTSCNGFSLLVLLLLGVVLNAIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 67 - DNA, 171324 bp, Mus musculus
  misc_feature (1)...(171324): n = A,T,C or G
catctataggtgtgactcctctataaatgatgcattgggaaatgtaaaagaaaaataattggtgttctcttttctctatttagatccttgaccctttagcacatagtatctaaagtatctgaattgttacttaagtgtatgaattttcacctgtgtttcctggtagtcttagaattccttccttccttccttccttctttttttttcctttgagacaaggtttcactacatagctcaggctggcctggaactcattatatagccctggttaacctcaatctcatagcgatcttcctgcttcagtctcttggctgctgagataatggatgtggaccaccagtcctgatttggagatcctagacctgtagcctatgatggaagccatgtcaacattactggggcacaagagctaaaggcattgtggccagaggacactccctgttaaatgcagagagagattagcctctctgcaagcatctgacgagtcactaatgacagctttggatttggaaaaatgtccctgtaatgacatcacgttcttgaagtttccttctgaggaccataaaccaaggccttcgttagatgcagactaccttaaccataagtaagaagcttcgacttgtaggatcctcctgagacacacactgggagcggtacatgctgagcaagcaaatgtctagtgacacctgccatgtcaacattaactgggaagaaacactgagggttggactgggggtttgccctggtctgtggtctcttcaagcatggactgcagaaggtcttgcaggcagagatgacttctttattttttatttttttaaaatgattccttttgactcattttttaaatgtgtattggtgttttgcctgcatgtatgtctatatgagtgtgtaggatcccttagaactgaagttacagacagttgtgagctgccattttggggctgggaatagagagtcctctagaagagcagccagtgctcttaaccattgagccatctctccagccccggagattagtccttacaaagcatgtacaagaaaatgttccaagaaattccttttgcctgttcgcaaagtacagtagcacagccaaggccttgagaggtccatagcaaatttacttcttaactttgtttgtttgctagagacaggtctcatgtagccatggctggccttcaactcagtgtagccaaaactaacttggaactcctgaactttctgttgtcatctcccaaatgctgagattacaagcatgggctgccgtgcctagctagagaagagtgctgtttgtttgtttgttttgtaatactgaatttgaattgaagccagagcctcccacgtgggtaagtgccctgccaatgagctatatcctcaactctccacccttgttatttttagtaattgtaccctttttgcacaatgcctgccaagcagcctaaacaactacagccataggaatacacactgaataatgctactttaatttctccatgtaagttcagctacttagagtcagagagccaggtctcccaaatagtgtatgtgttcatcataaaaaagcagaaacacagtaaatccacgttgtatgatataatacaatgattgggtggagcatgtaagtaaaccaattatgtgtgcactattatcaaacattaatccattagctaacatatatatttgcatacttaaaaagctaggtgctagtgaggtgtggtggtgtggtaatacccacctttagccccaacattcaggaagctgaggcagtcagggagaatttgaggatactctggacttgtacagagagttccaggtcaacctaagatacagtgagacactggctcaataaaactaaaaataaggaagtaaaaaataaaagccaagcacttaacaaaattcttttaataagaccagcatttagaagataaggaagatcagaagttctaggctagcctgggtcatataagtctgattaagaacaaattttcaaaaatatttctttaagcttaaatcctcttatcgggcaccttatagtctgacctgtctgatctgtctgtctgtctgtctatcaatttatactggggcttggactggggcctacacatgccaggcaagtgctatagcactgagtccttattttccagggacttcctctggctacattgtaactaactgacctatcagctgttgcttacctgacatctttctactacaaagctttctttttcttttcttttgcgtcagagtatcactgtgaaaccctgactagtctggaacttactttgtagaccagggtggctcagacttaccgtgatttttcttgtctctgcttccccagtggtgacacatgcccagctcttaaattatacataaagagatctcaatttcatgatttcaaagatattcttttccttataatcaccttgctatcctgagtagcccaaagtatttgttttgcgtttttcttttcttttctttctttctttttttttttaatgctatcgtctcttcaagttctaggacagaacactgtctctgctatacaattgattgtaacatttcacatacataagttttaaatttaagtctctgaataaaaatgaaaggatgacacgactgctcctaggtacgggccaagaagtttgagaaggtgtattgtaggcataagggagagcatagccagaaccatctagaagggtgcagatccaactgggccatgagaagagagggagggatggggagattgagagaggggaagagaagacaacacaagagcaaaccaggagactaagaggtcactgtgtagccaaatggctgggttatatagggaagagaagctgggcagagggcccagcccagctcctgggctggacagtttaggggacaggacagatatgtcagacaggatgtgcacatggcaggaggttggtgagaacctagtggccagcatccactttaatatgttaaataggcactcagttaagcttttgtcctgagtttgagatctaaccttaaagaagcacactaatggacatttaagcatgagttcaagctatcgtctctgccgccatcttgggctatttatttacaggtggtacttttccaccctgactagagacttgttttcctagcatgatgtttttgcaagaagcccaccacagctgaacacactctgataacatcttggttttctcctatacatcctggatctgtggttaagtgtgtccagctttacttcccagcgagtgcatatatacctgtactggctagttttgtgtgtcaacttgatacaggctggaaggagccttatcacaaagaaaggagcttcagttggggaaatgccttcatgagatccagctgtaaggcattttctcaattagtgatcaaggggggaggtccccttgtgggtggtgccatctctgggctggtagtcttggttctataagcagagcaggctgagcaagccaggggaagcaagccagtaaagaaacatccctccatggcctctgcatcagttcctgcttcctgacctgtttgagttccagtcctgacttcctttggtgatgaacagcaatgtggaagagtaagctgactgaataagccctttcctccccaagtgtttcttggtcatgatgtttgtgcaggaatagaaaccctgactaagacaatacccatagttgcttttcaataaacgatactcgagactcaagacttgagatttaatccctgatccttgatagcctgttttgtttctattcttcgagtctcttgcccctcagtccccactctctcttgcagaccccattgactgacccccggactgggtcattcaagtgtatttatgaaaacaaaatgaagactgaactaagtattttaccacagaaaattatccatggtcactatgagagtggttccaggagatggcttcattgaaaatctgtgtcaatagcctaaattctgtagtttcttctgtttttttgtttgttttttctttttctgttctgccctcctcctccccctcttccttctcctcttcctcctcttcctcctcctcctcttcttcctccttctcttcttcctcctcctcttcttcctcctcttcctcctcttcctcctcttcctccttctcctcctcttcttcctcctcctcctcccccctctctctggagacaggctatcactatgtagttctggctgccctgccccgaaattccctctgaagaccagggtggcctcaaactcacagagatccacctgtctctgcctacttgagtgctgggattatagcaagtgctgtcatgcctggctgtagtttccttatttagtggatgctgctaggaaaaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaagaaaccagagatgagaacctgagaccccagaccctgggagggaactcagtcaggatcctttgggtgatccgcatggttgtgagttcatttcccaatgaaacagcaatagccgcacgacacaacacagtccctcctaacagaccttatatgctcaatgacaaggagaggactccaattttaggagaaatgaaataaacagggcatctaacaaaagagacatgtccatgcttttgaagaaacaatgaagcggcatgagagccatccaaaaggacacatggcatatcttgattttttttttttttttttttttttttttttttttttttttagaaatattcaggattagtgtcaagaggcaaggattcctctcagtttgaagaaaaagcgcctccttttgtgcagaaaaaaatcatttaaaactttagagctatcccagcaaatagcaacttgctatgagacattgtgcagcctttacatgcagaatactgtaggttttgagatactgggaaggagagagaggctaagaggatttggttacagagtttgcaggttggaaatctgcacaagatacaagagactacaaggaccaggacaggacaggacactggggggcggtaggggggacttggatatttatccaaagtatacactcattgtctttgctcctctaagaaaggatttttaaatttaaatctatttttatttaaaagaagttatttatgcctgttgtggtgggtgtattcagtctacctcttgttctgacctaggtttgtagtccattggggatgggggcaatagtcttcatctccctgctagattttaagcaaaaggtcactgaggacaggggaaaaaagaaagatcaatttttatatgatgtaaatatgttttcacttaagtaacttcaaagtcacgttagacccttttattagtgtataggcttgctggcttgctttttttgggggggggcaacttcacacaagctagaaggtcatctaggaggagggaacctcaattgagaaaatgcctccatcaggttggcctgtaggtaagtctgtgggtgcattttcttgattgatgattgatgtggggggggggcccagcctactgtagtcagttccttgtgtgggcaggtggtcttgggttgtataaaagaggaggaggaacaagttgtgaggagccagccagtaagaagcattcctccaacgactgcttcagctcctgccactgctctgacctctcctcaggatggctaagctctaagcgtaaacctttttttctctaaattactttttgccgtggcgttgatcacagcattagaaagcaaagcagggcagtgcatgttcattgtgtaagattgtagattttcataatgacatttttgttaaagttagctatgttcttttctcatatctcctcccattatcttctctggtgtcccatcaaacaagtcccccttctcttcccagataggcccctttctcggtcatcaactccctgtgttagagtatttgtcttcctgagtctggcatatattgcacagtatgctgaactctggatctatccatttcctcgcaaatgacacaatttcgttcttccttatgactgaacaaaactccgctgtgtatataatactgcctattctttattcagatgcccaggctgattctataacttgtccatagagccacagatgtgtgtgtatttgtagtgcattggcttaggctcctctgggtgtattctctagaatgctgcagctggatcagaactctttatacagatgttctggtttttttattttaatttttttttattttctgcacctggcattctgtctttatctttcaatattccaccacagtatataatataatatcagaatgtggttctacctttattttagttttggaagacccttcatgttgatttccacagtggctatactagttgatgttattgctaaagggacctaaggcttccttcccctcctctccttcattctcatcagtatccgatgctgtttgttttagtgctagccattttatctggtggtaagatgtattctcattgcagttttgattacagctccccctggttaaggactctgaacatattttgcatcttttttttttttaaattatttgtactttatcttttgagaagtgtctgttcatttcatctgcccatttgttgactggatagatttcttgggtgtttaatatttttctgtcattcttttaacatcctagatattgacaacctaaatttcaaatgatgctgggtagtcaaaacaatactgaacaaaaaaggtaatggctggaggaatggcaatagaagattctaagtatcacagaactgcaggaagaaacacagcatggtgttgccacaaaaccacgtaactcaaaggagcagaagattcaggaatgaatcagtgcagctgcacctaaggctacctcactaggtacccaaagcacacaccagagaaaagaaggtctctggcacatcgcgctgggaaagctagattctgcatgtggaagaattaaactggatctctgtatcttgccctgcccaaagatcaattcaaaatggatcaaagcacttaatgtaacactcaaaaaccttaaatggtcaaaggaaaacaggaaaaaaccctccatgatgcaggaattgggaaggattctctgaaaagagccctaagctcacaggaaatgattacaaaaactgtcaagcaagattgaatgaaatgaaaatgcttctacaccacaaaggaagcaacagatcgaagagaccgcctacagaacagggtgaaaacaaaactaagcttaaggcacagtttatgaaatcatagagacttgaaggaagtggagccagagaggaggaagggtggggggtgagggcggcacaccactaggtggcgcctgtttcttccggaataagtaggatttgctctcagcctggaatctcaggaattaaggggtagccctgtagcgaagtccatgcaagtgacatagatcatgtcatacttagtgctgagcccaagaagtcattaggtccacgcggctgcctagactatcacagatctgcattactgtagtatgtatgataaagttgtatcatgtccatacttcactccagcctcatttctccaagccgagtcactccatagagactatcaagctttgggtcccaggctgttaaggtgtgggaagggaatggaggctttatcagtcttccagctgggtggctttaggtgacacaggtcctctggctcttccatggggtgcaaggcctggctcaggcgcccactgtaggtcaacccatggcagaagatttgtttgcaatcagacagttcagttcccatgcctcacatgaataagaaggtggcgcacccggaacatttcatagtacctaggcttaggtttaagatatgacctttgtgatcactaggtctttggcgttctaacgcttggagtaataatttgggtattttatcataaaaattaccctttctcaaagcccttcctctatagatttgtctatttgccctgaagtctttcttgttcctgtggtctgtagtgaaggtgcaaaattttggtgactgtgggctgcgtgttcgaattctgcaggggtgatcgcggctcgctttaacttcctctcgctgaaggaagcaatttttccactcacagatttcctggatttagtgagagattttgtatggtaagcacctaaatgccagggggcgtccgtgagggtaaacccacagtggaaaaactgcttttgggggcaactctggatcaatcaaccagaaccactctcctccctgtgaccttgtattccaaatcttgtctcccgcctcgcctgggttttcataaacggcttaaaaaaaatcccagaagacaaaaacgaaaccgacaaaataccctggcccgcagatgtgtaaactccaaggggtccggctggagagaaagtcacccagaatgtgcatccagttccagccagcttcgggggtggagcgccaacaagctgcggaggaggagcggcgggcgggggcgcgagcacgagcagacacaggcgcgccaccgctgccgtcgctgccgccgccgcagcccttggctcccccggctggaaaccttggcgatcgaactgctgcctccacctctgcgccgcttgccgcccctcccgcagtcccgcggctttcgagggagcgctgcggggactcgggaccgccggggaaacctgtgaccccgcgcaggagcggcggggcgggggaccgggagaagatggcgacgccgggaagcgaaccccaagctttcgcgcccgctctctcggtaaccgccctgcacccgcatctccaccagcaccaccaacaccaccaacaccaccagcaccacggaggcaccggcggcaccggcttcaacctgcccttgaaccgtggtttggagcgcgcgctggaggaggcggccaactctgggggcttgaacctgagcgccaggaagctgaaggagtttcccaggactacggccccgggacatgacctctcggacacggttcgggcaggtgagacaaggccggggctggccacgcgtgtgcgagccgggctgtcgctccttcccgccgggcccgaatgtgttactagattggctcggcaggagcgggttctgcaacgagcacggtggttgtagcgggcacggtggtcctcctggccccggcgacctgcgaccgtggtgcaggagcgcagggatgcgcctaggagctgttcctggcgcgcgggaagtgggggcatctcgggcgaccgcgagcaagtccagaacacgaaccaagtcgtggacctctacatggaagcattctgcgtcctggtgggtggggaaggccagacaaaggtggccggccgtcggctagccctgtcctctccgcgtagtgtcggggccccggcctccgcgccgcgcgaccgtggcttgctgcagccagagaggcggtgccaaccttggttctgcgcctgtgcgagcagaggctggtgtctggctctccgcccacacattttggttccctccaccggggctccccggttctcactaaccccggtctttgcgggggccctggaggggaagcgtggcatagtaaatgaaaagtaattaaagtgagcctgtttgccagtgtgagcccggcaagttgtaacccgcgccacagagcagcctgcttcttcaagttgtgtcatgtgttgacatattttggagatgtctgctttccctttagtagtcggagttgtgggagtggacccataaacaggaaggagggtggtggaagagggttggggccttgggaatccgtgcagatctgacttaagtttccgaccatatcctgttctgttctttgcgggacgatttgtaccccagcgagcgcctagcgtttcccagggcagtgggtgccccacttttgtgccattgcctagacctcacgactgtcgttgtctcttccgacttgcatcaggtctcttaggcttctgaatggcttggctttcagatggggtccttcagctacttataaaggaagactagggggcggggcaggggagccagctgtggctttcggaggctaggtttctggttaattccataaacatttaatcaggagaccaattgaaaatttagatggagttctgaatccattggaggctagaagcactcctctggggtcattaaacggtgatatttgggtttaaggattgtcaggaatgggtaagcagaggggaaattccagaactcagttttcaacagctggagaggctcttgataggacctcatagttacagcttctcaagtagaagttattctaagagtcgcctgaatcattaaccttaaaaagtcaccccatgttttccttcccatctgccatagttagaatggctgtgtactgcagaatggagaatcagaatgccccatgctaacgtgttcgcgctattcagtagcaggcttagagttattccaacacttcagtattactcatgattcctcccaaggttgggtagagttggcatgtgtgctgtgctggcatgtctttgagaataccattgctttaaaagtagtggagggaggtgttcatctttcagttaccgcctctgtgagttgacactgtgtggaaagggtccttccttcctgttctctctgtgtgcggtggggtgtgcaggtgtccaggcattaggagtgttacatatattttaatgctcctaaaatccttaagtagtcaaaagtaagaggcttcatgctaattctccaccctaaaacagttactatttgggagcagcagggcaaaagaatgtcagctacgtttgtgggcacttaaggcaataccataaagaaaacaaaagcaaaaacaaaaacagtagctgaagagtctgttgttttatgtaaaagtttcaacattcacatgtgttaaggattgcttgccttgacctgagtcacacatgtgagtgagtattcctctcttctccagaaatgcttaggttggacacggggactttgcctgtgagcccagtagttggaggccagtctggacttagtagtaaattccaggccagcctccgttacaggttaaggcggccctgactcattcttcatgcctatacacccccacatcccccaaagagtgtattaaattgagcattattctttacttgtgaaagcaacaaagcaaaataaagacattccgtggggggtgttgacatttcctacacataagggagttgagggagatgttgaacctttggtaataataaatcccatacagatagtggcttctcctgggctcaaacatctaaggatggactatgacgatcctcaagaccctttcataagtttacttgggtagtggggagccttttctctctgttaagttatgtgtttcattgtgtcttgtaaaatttagcctttccagcagctatttctacagacagcaccacatacttgggccacacagcccaactgaacagagatgtaaagtaagagatgagaggccctgaactgctcagtagtacaagaaaccaaaaccaaaacaaagaccttcttaatttcacttttaggctgttatttccctgaaattcaatcaaaacagcatgctttgtgccaagacaggcagtcctgtagtaagtaagcttactgggaagtagctggggacagtggcagaggcgttactatcctagactggattagaactgatgtgggcatggtacttacttggctaactgtgaagtctgtgtcaggagcacagttggaacatcatctccccgtagagagaagccaggttacatgcttaaagtcatacccctgctgagacacagaccagtgatctgagtcctcaaggcttctctctagtgtttgtgtcctgaccgaagcctgttgggcagagggcaaccgtggagagagtagaatttgggaggcttcttgaaggttcattccatagaccttcatcccttcacctgttctgtgaggtcccactctggtttgaggaagggatgggagataaacaaagcaaaagaaaacaaaacaaaataaaacagtttatcttgcaagatgagtaagaggggttttttggatacatgcaatacctttgttttccaaacacaggcactgattctcatggacttgaggttgctcataacaagagtacgtgatgaccatcataagtgtagacagaaacacaacactgggtctgatgagaagaaatagacaaaggcatgtcagtgaagcacccccgtccccgctagcgttgatttatcacatagcaccagttcagatggaggagttcaaagtgggtgtttatatgagtggattcaaaaggaaagaaatctgagagtggcctcctgtgtgaggctctagaaaataaataataataaaaaaatccatgtacaggactttggaaattaatagtttagccaggcctgttggcaagggcctgtacctgagggttacaggaaggctaggagattagggatatccgtttgtacattagaccgtgcctgaaaaaaaaaaaaaaaaaaaggtcggtgttgtgaccaaaaggtcggtgttgtgaccgagtggtggagtctgtcattctgagtgtcttaccaagactaaatggggaatggagagcttgtctaaccatgtggcataactactcactgagactggacccgatagaactggcctgtgatcccagcctcttgggactgagagaagtggatcacagtttcaaggccttcttgaactacaaagtgagctcagagccagtccagcatcttagtaagagcttgtctcaaaactgaaagtgaaaagagggtttggagagattgctcagtggttaagagcactgactgctcttctgaaggtcctgagttcaaatcccagcaaccacatagtggctcacaaccatctgtaataagatctgtcaccctcttctggtgtctgaagacagctacagtgtacttacatacaataataaataaatctaaaaaaaagaaaattaaaaaaaaaaaagaaaagagaaaagatggtttgggttaatcacaaggtggtggagaactgggagcctgtatgagacttggtggaaaggttcagggcttgaacatgcgaggcaagtgctctaccgttgtgccatccctacccccggcatgccccaggaagtgaagctgcaaagtgtaagacatgaaaagccaagtgtaaagggttcaggaagccaccggaggagccccacgggacaatcgatgtccagacagcaccggcactgtgtgcagccttcagaggcctcctgcagtggagggagggtgcctgacagggcttgcagggttggatgtgggtagacatgaccacgaagcattttctggtgggaaagatgaatccaggatggggagggagaacctgtcattaaaagaagagagaggatatttaggtctggcttctggtcacatcctctcaccccacctaatagcaggtgacagggtgacagggtgacagagccccttttcaccccactcctgctttactggggtgacagagcccagagcttttatgagggctctggaatttgtcagtgggtgggactgtcatcttgcctgccttaactctacctcttttcagtgtctgtgaagattcaagacctgggggcaagcttctctgcagcaggctgacttcctctacccaactccctccaccgcctccccaatagctgcagagtccttggatatgagcatatatgagcccttggaatccatacagaacttggtaatgaaacctggttttgataacatgctctgtgccataattttggccatgaagattttttcactgttagagcgagacatttgaatccaccaccccttccctaagacagggtttcttcggtgtagccctggcttcccctggaactcatcctgtagaccaggctgggcttgaactcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgaacctcactttattaaacccaaatttcctccctttgaagtgtgtgtttgtatcccggtgccctgttttccagatctatcgagagtgttatataaaatccttgaataggctgagcagtgtttacttccggttcctctctttgttgtcaccttcccatcccctctaatgtgattctctcaagattctgtgtagtaaatggtagaggtggttatgagtgtatagtggtttgaataggaatggctcccacagattcacgtgttgaagctgggccgtagggagtggcacagttaagaggtgtggccttactgaaggaggtgtggctttgttaaaggaagtgtgtcactgtggaggcggggctttgaggtctcaatatattcctcaagctctgccctgtatggaaacacaacccccttctgctgcctatggatcaagatgtagaactctcagctctttttccaacaccaagtctgcctggatgctgccatgcttcctgccatgatgatcatggactgaacctctgaaccttaagccagcctcaattacatgtttgccttataagagttggcttgggggctggagagatggctcagtggtttagggcattgactgctcttccagaagtcctgagtttaattcccagcaaccacatggtagctcacaccatctgtaatgggatctgatgccctcttctgatatgtctgaagacagttacagtgtattcacataaataaaataaatctttaaaaaaagaagaaaaaaaaagagttggcttggtcatgatgtctcttcacagcaacgaaaccctaagacagagtccatcagccaagatacaacacttgagctgtttacactttagacttagccctttggagaaatgtatttagttttagagagatattagccttggttaggtagttcacgaaccctccctgatcatgtcagttgttgggattacagtgggttggtgttaaatgcagcggtggagtcataaagttataatagattataaaagtttaatagccaactggtcttacacacctgttatcggtggatcaggcccagcctgggttctagaataaggccctgtctgcagaatacaaaaacaacaaaaatttaagtctgtaagttgtacaacctaactatatttccatagcttgagtttttttctttagcgagatagcacggctcatgggaagcctagcttctgtccattgctactgttgtgttgcatgaaagctgcttgtgtgtgtgtgtgtgtgtgtgtgtgcacgcgtgtgcgcccgagtgtgtgcaagtgccagtgagctgcggaatctgcctctctgtgactctcacccctacctgattgttccaggcttttaagtaggaattggggattaaacttgggtcctcatgcatgacagccgctttattgactgggccatctccttagtagcaaagtttctttttgtgacagaacattgctatgctaaagttttttttttttttaaataattattataaacaatgagaattgcttaacaaaacaaagacaaacaaaaacactaaagaaaaaggagaattccaacttaaacttattttaggaaagctccgtctatcagaagcatacttgttcttcctcttactttgcgagtccaggggcctgcttcctccgtaccccgtaggaagaaacaatgcatttggaaaccacagagcaacagaacagaaagtgagcttgcctgcacggacagaaggaagtcgacagttgtgaggactggattgcttctgcgtgttccaggatctgaggagaaagggaaatgtgctctaatttttaaaatatttttacgcatactagctttttgcctgaatataagcacatgtaccgtgtgtgtgtgcctcttgcccatggaagtcagaaaaaaggggggtgggtgccctagaactgtagttagagatggctgtgaggtgttacatggattctgagaagtgaatccgggtcttctgtaagagcaagtgttcttaactactgaactgggaagtgtggttttctgtttgtttgtttgtttttgtgtgccccctcctcctacccctcagctgagggctgaacccagggccttgcgcttgctaggcaagtgctctaccactgacctaaaatccccaacccccttgggatatgtggttttgattagaattctgtgtattcagtttgcctcagctgtagcctcctctgctggctcaataaggaaggtataaatctgggggcacacaaggaaaaaaccaatcagaacaacactgttgattttcatagtagaaatgttccccccccccatccctctccagaccggccttccttcctttcttccttccttccttccttccttccttccttccttccttccccttaagacatggtttccttatgtggcttgggccagccacaaactctctctatagccttgaacttgatatgtggtccatacaggccttcacttgggatcccccctgcttctctttccccaggttgggatttttttctcttaattagaaatgagttgttttgtatcagtatgcttttggcataggcaagtgggcttgatagacgtgagagcacacactgcacttaggtagtttcaaggaggtaatgagtctggggatcaggtaatgggtcctgggatcgcccttgaggctggctttcctcccaggtttcccttgttccctctgctgcatgagccctaaagagagcatgagatgaacagggcagggcatgagcctgttggagaattgttcccagcgtgctctactgtgcccaccttctattctccggcttcccatatggccacgctcttgacagcagaccccatgggcactgtacatttgttgggtcatgtactccactgatactcttccatatttttggtgtttatgtggtatggtgtgtcctacagtgtcagcattcctgacctggtacagaactttagcgtagtcctgacttaatgcccttgatctctgcagaccacagtgacagttcaaaattgcgccatcaatagactgcctaccttgcctctttagactgttttcgttttgcttttccacgtcttcggtcacatggtcccactcttcactgctctatggaattctgcacgcccagttcatattccgtgtagccactggcctgtcggaagcaagccacctccctgtcaacctcttcttttgcatcggagcattgactcatatgtcgctccaaggcgcattagttagtgccatttcctcatgcattttgtatttctttatttttttttcccctttgtgtataagtagccttccctcacagtgactccacttccatggtttttgttaacctgtggccacctgttgtccaaaaatattaaatggaaaattccagaaataaataagtcgtaagtcaatcacttagtagtcttttttttggtaatctggcgaactggtgcagtgtaacattagtgtacaggtatcccttatgtagtagtgtgagtctctgtcagcatacctttatcacccatctctctttgtcctatttgtcctattgtatgggcattgtgtcatcttatatcggcactaagaggatgaatatactacagtaggatatcatgtagatatgtgtgtgtgtgtgtgtgtgtgtgtgtgtgtgcgagagcagtaaagacagacattgcctgaagagactgtcttgtaaagggggtatgttgggggtggcacctcaggttgtcctctggccacgacatgtgcaagcaggcatatgtgcacatataccccgcaaaagaccacatttattacagtatttttatcattaattttttgtaattattcctatttttaatgacgtctatttgtgagtgtctgtgtatgggtaagtgcactgtgagagcaagcacctaaggaggccagaggtgacattgttacaagagattgggagcctgaggtggggtctgggaactcaactcagattttctgcaacagtagcaagttctcttaactgtcaagccatctctctaacccctagtagttactgtttcttatgtcccactgtgcttcattgggaaattacgccttagcataggcatgcatagacaggaagaagccttctgtagacagagttgagtattagctgtgctttcaatgacctaccaggggcctaggattgtttccatcttagaaaaaaggggaagtgctgtgctctcctcaagtttaagtttcttcctccttgactggctcatgagagtggctagacagggactttcctgattgtgtgtgtgcatgtgtgtgtgcatatgtgtgtgtgtgtgtgtgtgtgtgtgtgtgtgtgagagagagagagagagagagagagagagagagagagagaggtgtatgtacatgcatatgtgtttgtgtatgccttacagatctctcaaaccagaatagttcgatagattcccttgcttatctgccttctctttcttgccttgagactctgaactttcacttgttatcttgaatctatggtgaggttgtcccaaacttgtgccttgttagtcagtctgctgtcttttccccagccagctttatatgacatctgtaagtcaagtgacttacaaggaattctggaggaggtggacaaaaaaattccatcaaagcaaatagtggataaaatagctggtaaaaatgaactctggtgtggtgacacatgcctttcagctcagcatgcaggaggctgcagtaggatttttgagcctagcctgggctatgttgcatgtttcaggctagttcaagctttatataatgagacctgtcagctaacaagaagtcaaacagcaaatgcttgtccagctttggggaaaagggaaccattattcatacagtattggtgggaatgtatattagcatgtccattatggaaatcattgtcctcaaaaaccaaggaggctggagggatggctcaggggttacgagcacttactgctcatgcagaggacctgggttcggttcccagcacacccatggtggttcactaccatctgtaatttcagttccagggtatccaactccctttctgacctctgtaggcttttgcacgcatgtggtacacatatgtacatgcaggcgtagccacatacacatggactctataaagataatattaaagtaatcccttaaaaaaacccatgaaatggaactagcatggatttagggagttcacatccctgtacagcagagacacctgcatgcctgtgtttactgccgtgctatttgtgatagccaaggtatgaatcagctcagatgtccatcagtaagatgtgacagatatacatgagtatggtgtcatactcagctgccaggcaggaaaatggatggaactggagatcgtggtaagcaaaataaatgaggctcaaaagataatttggcttgttttcccctcatatccagaatctagactttttaaaagaggacttgaaaatagagggggcatgtttgagaagggggagggggccatagtgagggttgggaaccagcagggggctagtaaggggcttgaataagtaaaagcacatgcataaatgtgcacacacatgataatgtttggtgctcattttttttttgttaaagttcattaaaatctttttttttaatttaaaaatttgttaagatttaaaatttttatgtgtgtgagtgttttgttcccatgtgtgttcccatgtgtgtctgtgcactatatgagggcctggttagaagggcatcagattcagactcaccgggattggaacccacgtgcttgtgagttgccgcgtgggtactgggagtcaaactctggcctctgtgaaaacaaagtgctcttaactgccggggcatttcttcatccccaaaacttaattataaagaacttgcaaatgaagaacatctcaccctcactgaatttggagcctgtggtcaggctccagcaagcttcagtgatctgcctccgcagtgctagcaatacagcaacaagctgggcttctctgctcttacttgggtgctctggactagaacccaggtccttatgcttgcatgataggtagtttactaaatgcaatgaacaccccctcccagccctcatcaacatttctggggtacatatatatatgtatgtatgtatttatgtgtatgtatgtatgtatgtgtatgtatgtgtatatatatatatatatacatatatatatatgtatatatatggagaagtggatttttaatattttaaattttaaatattttaatattttatatttatatataaaaatagagatgtagttttatctccttcatagactggtaaagattatagaagtaatgtgtgtgaaagaactttacacatttaagtattctcattaacaaatgctgattaaagactttcagcccttagctagtggcactctcatcaggatagctcagtggttaaaactgatgattctcttcagcttctaaggcttgagtccaatctcaaactaaaaacttaaaaatctcgtctccttggccacatgaatcccgaccatctctttctttacctgggcaatggagctaatagagttgtccagcacggcggggggccggatcctgcttcaatactgttctgtggttaatgcttgccaggtgtggtgctttgagcatgggcggggcttagtcagcctggccacaccttctgttgtcttctgaaaaagagggaatgtagaaacctagaaactgttcttcctatttctttgtcattcaggtggaggacaatgagtcccagaggaatctgttctttggccttggtcatgtaacaagaatgtcgggtgcctgagccaagggagagcctttcatggtcctgtgttaaagagccgtcgatgtagagtcaggaggccacagtagacccgagaggaggcttctgtccctctgtaaaggtcttagctcatgctctactgattgtggcaggccccaccacgatcagaaaatgccctgaaacctttaatgacatctggtccaaagctggagcaaatgacataagaccaacagtagttagggattaagcgtgttagttcaggattttactgcctgtggtttgggggacttgcgcaggctccttgtgaacgggattccaagcacttaacagcctcgttgggcagccctgcttcacaaactaggcttcaaagttccttttgtagcaaccttggtaatttgggattcgctcttccaggtttcctgtgaaagcaatgatttagttcccttaccaacccaggaaggcccattaaatgctagcagatgccagccttcatgttcatagttaattctttcttcttcttttcttgtgtatgtggatgcatgggtgtctgtgtgtgcgtgcctttgtgcaggacagatgtcaaccttgagttgagcttcctcaggaccggttcaccattttcttttacaggcatggtctttttctgttctgacggtcaccaattaggctagattggttgccagtaaaccccaactttcctcctgtctccatcttctccaacactgggattacagactggcacctggctttttatgtggttctgaggattgaactctggtccccatccttgggtgacatttatcttactgactcattatttctcttgagacacacagctgcattttgaagggatactctgagttctgtgacatggtcatcaacctgtgaagcaggattttttttttttttttttttgcctctggaaggtcattcttctagctatgcccagctatgcccagagaccttagagggtctctgtctccaccccattctaggctccttgatcagtgggcctaagctggatttctctccacagtggtgtgggcttctaaaactgccacaagtcagggccttgagttgtctctgacactcaggctgccaggcagaagtcctggatttatatatttcctcattcattcattcattcattcattcattcattcattcataatgcaggtcttaccagtacagtgtctttaaactcactgtactctcggtgttaggattgcaagcgtgtgctactatgcttatttcctttctttctcatatttgttatctaacaaattacaaattttagagctggagggaagttattcagtgtctttaatggtgatatttgtaaatttgctaaaaacaaaaatgctggccgggtatattggcacacattttttaatcccagcactcaggaggcagaggcaggcagatctctgagtacaaggccagcctagtttacaaggagagttccaggacagccaagctacacagaaaaatcctgtcttgaaaaacaaacaaaaaaccaaaaccaaaccaaaccaatccaaatcaaaccaaccaaccaaccaaaaaacagaaaacaaaagaagaaaaccaaaaatccctttcctgcttggatcctctgtagagtcaccagggtgcacactagatagagctcagcagatttgccatagggtaggtgactagagctcagcagatgtgccatagggtgccccatggagtacaaatggctctgttcatcattcagggcttggaaagtgccagcctgtcataggcacagtgccggagaactcaagctgtcaggacttcatccagctgcgaagggcacagcacgtcatttcctgcgcctcagtttccttactgtaaaaggagcactgtgatcctctgggttcttgtgaagagtcaatgatagtcggcgtgtgtcctgtcgatcaacagtcggcacagaatttgctgttatgaggcacctgcggagaagatactcagtcttctaagacacgggaagatttgcttcctagaaaatattgtgacattaaccaagtaatcttaatacacgcaacggttgggttgtgtgagctggcggtgtgtggaggcgctgtttctgttctcctgacagacttgggaaggtggaagtaggtggcgacattccacatccagtctttcttgagttatactgctggttctgggacagtcagaaccatgttttatgggcttttgtgttttgttttccaactggtcctcagctcgacagtggcctttggttgatttgacaaaggtatcctgagggaatgagccctgggttctgtgcatcttggggctgcattcctgatccatatggtatatggaggagcaggctgctgcggtcagctctttagtctggggaattgaagttgggacaaggatagtagagtctgggagtacttggctgacctcaaacctgtcacttctgttttgcctttgctgccattatatccccctccaagatgtctcacatccctccttcacccaagattttgttaaggaaagccaagggggcactttgtgttaagcaagatcacatgtggttcctggatacttagcatggtccctacttggttcccaggtcgcccaacatctttgtttctgagaagggaactcaaatgatccaagtacgctctgaacaagaaaatgtggtaacgacttggagctcagctcttgaagaagctacggagcatccttcgctttggggtcactgtaggagtggatgagagggagggaggcattgcttaggagacccggacctagggcactgtgacagatgagcctttgggtagcagagatgctggagtccatcccagactatgattcttgcatgacttcctgtaccgatccgaagcagtgtgcagagtgaccatgtacaagctgagaagaatccagccagagcctcccccttgtgtgcctccaactccttttgtaagaaatgaattctaaaggaagtaaaaattctaaaggaagttaaaaaaaaaaagatgtattcaaaacttccaactgtaatgacttgaaacagacattttgtaaagggggaaagaagaaaaatgtaggcatatgttgtttatttgcttggacgtcaatgtttcctactagagtatataatctaacttttttgatcctttcattggcatctgactagactttaatctctctaatgagaaatgaacaagtgtcattttggttggagaccaagaagttgaggacccagaacattacaagagacaagtacctattttatgaagcaagcctgcctgcctgccttcctttccttccttcctttccttttctttcctttcctttcctttcctttcctttcctttcctttcctttcctttcctttcctttcctttcctttcctttcctttcctttcctttcctttcctttcctttcctttcctttcctttcctttcccttcccttcccttcccttccctttcctttccttccttccttccttccttccttccttccttccttcctatcttgtttttttgagacagagatccacctgcctctgttaggattaaaggcatgccccaccatcgcctgcctgaaagctgccatttttaggtaacaagaattattgatttgatctattaaaatgtgtgtcttacttagcacatttgcttggttacatttaaaacctttttaagtgtggagccaggcctggtaaagtagactttaagtcctcagccgttaaggaggttgagacacggggattgctaattcatgactannnnnnnnnnnnnnnnnnnnagacacggggattgctaattcatgactagcctttgccatagatttagttcaaaaccaacctggtctagttaggaagaccctgtctcaaaatagaaagtaataaaaagggctgaagatgtaactcagtggtatttcctagtatatgtgattcagaccacagtactaccctaaagacaaaagaaaaccttgtaagtgtgccagagggtagagtgatctcggtggtagagtgctaacatgcaagggctctggggttcaagtcctagcactgcaaaacccctggcattctgttggtttgcaatttgaacgtaatttaaagggaggcatctttctctttttgcatagttccctcagaggagtggatggtaatctcagcatgcagtttaaagtagatgtgtgtgtgtgtgtgtgtgtgtgtgtgtgtgtgtgtgtgtgtgtgtgtgtgtgtgtatgtgtgtgtgtgtgtttgtgtttaggaagccttgatatatccaaattaattacagttttagctgtggttcagataatgctttctggtaactgtggccaactttctccggtattgttaccaggagcccattagagacggtcagtcccacccaggtgacagccaattgaaagtctttattccagcagctgggattacactcaggtactcagacctagagtatagccctgagcatttagatcaaggggcttttaaagacaaaacctaccttctgttatctcattcagcagctgcaggggcttcttagaagcatgaagtttaacagaagctaagataaactgttagctggaggaggtcctgcacaagcaagcagtttaacagaagctaaggtaagttagctgggccatcttaacctcaggtcctagaatggagttgggtaatttgccacgggattctccatcagaaagatcagattctagttaaagctgaaatggcttcagcaagaatacaagatggaggaacccccacactgccttgccctgttgctgtattatgccacacatttatgagagggaatgtgttgaaatatgatctgttttatgaaacttggttggcagctgagaagactgactgactgctttcttgagttggtatgttaacgaagataggatagcttccctcacacagtgggagttctgaatgcttgtccgagcccttgcagcctgtccctgaggagtccattgaagtcaggtagccctggtctttccaaagtggctttataggttctgggttctgtgtattttctgtggtgactctgggtctcagaccacttccctccgtgggtagactgtgtgtgtgtgtgtgtgtgtgtgtgtgtacacgtatgtatgcatatgtgccccttcaagtgtgtttgtgtatcacatctgtgtggaagccagaggacagcatcaggcattactcagtctctggtcatcctattacagggttggcctgaagcttgctggttagacgcctctggctggccagtgagccctagcatccacccatcttcacctccccagagctaggattatgaacacacgtcagcacgtgtgccatttttatatgggtcctggggattgaagtcaggacaagcattttacagtctgagccatctcctcagccctgtttataatcctttaccactacctaatagaccgacttgggcaagctctggcacctctgcatgaaagacttccacttttgctcagtctttcactttctgagagaacgtctgaccacatcatctgagggacctcggggtgggggtgggggggtgctcatgagttcagattgcctggatggttggcaatatccttcttgctccagcctagttactgctaaaaccctccttaatatatctcctaatttttgtagttattcatgcacatgggacatggtagaggagagactccatcttttaaggtttttcattcatttatttacatgtctatgtgtgggtatgcctacaccaccatggtgctggtggagaggtcagaggacaacctgcagaagtcagttctgtctttctgccttgtggctctgggataaatggttgaggggatgggtatcaaactcaacaagtgtccttaactgttatgtcatcttgtgtacatgataatcttctaagcatagtttgaaatggatgaaaggatgcgactttcccatatatgctagctgaatgaaaattgaggctatagctgctcctaggtgtggctgaagagaggtttattgtggatatgaaggagagaatagcctgaggcatctgaggtggagtggtgagaggggaagagagaggaagcaggagccaagagggaggccaggagcaagccaggtgaccaagacaccagaagaccggtagccagagtggctgaggttgtagggatcctaggaagggaagcccagtctctgagctggagagttcggggttggggcagggtcagaggtgctggggggagctacaggtaccaactgagctctggtgtctttgagatctaatagcagccagttttgtaaaatcaggtcctaaagtggacaagtgcatcccggtcatctttgccagctgccaggactgctgtcctttgaagggactaacaatacttggcagtctttctttttaacttccataaaataaggtgtttggcatttgtcactaattttgactagcaagatctagcactaatttaaaaatcatgagatgtagtcatgtagatacgatttaaatagtggtagcaaggcagacatggggacgtagagctgggtaggtaggtgtagcaagtagtcctattccacactggccttgaacttgtgaacctctggcctcagcctgccacacatgcacccccatgttcgctaagagaatgcttgtattgattggaacagcgagtacacaggtgaatacattggccagcactccctactttaaatgggtggattttactacatggagattgtgtcttcctaaagttgactaaaccgcacctaagcgtgtgctctcccacttagaaagcggctcattcccataggttcgcagccctccgcctactggcgattcccaactgacaaagctgttttaaaatagaacagctggagtttgccagcaaatagaatcagtgcctacctttgcaagggtggccgttctgttttcactttcttaaagtgtctcatcaacattgtcttcatgaaatgtttgagttctgttcataaatggcccttaaaagcatctgatgaacaaaaaaactggtgttgaaccagatgtgctgggaccactgggttgctgttagctgagttcaagatggaagaacatggccccgcctattgtgaatgccccatgctatagagtagccaccccctccgactatacaacaggtatcttttatgttatcacagccagagcttataaatgcaaagtagcttgtcaggatcacgcagaagaggggatagggactcagagtttgtaccccagttgtctgatgctgaaacttgacccatctttctcacacagttattgtgagccgctttttcctagggacagtggagtgttggttggatctagtggccctgggaccatgtgacctggccctttccaacttcccaaggcacagctgtgatcttgcacactgcctgtcagaccccctccctggctcgctcctgccagcccacccaggctcagctgcttgacagccgggtctctaggggctctggaatctgacgccgccctgcttatcctactgaggtctcccgtgagaccttccccaaaggcgttggtggctccagctgcctttcttctgaatgtcttcatatattcccggcttagggcttccactttacatttgaccataccttttctatccctactatattcattgggggaaaagagaacagaaacacaaaaccccaaggcttttttcatccctgtaaatcaccttagcaccttagctgctgctgcttttgtggtacccaacttccagcctcaagccccgcctctccgctcctcacctccatttgtgtgccctagtgggcagttagggtgactcggctgttcctaacgtgttctgtgtcctggatcttggatcttcttaacacaattaatcattatcattgtcacaatgatgataatggtttatttgagtcagatagcatgctctccccttcatgtcctttttcccatttagttccctgaacaatcttatgaggcaggtacatccactccacagttcttcgagattcagagagtaagacccagcgtcccatcgctaccaagtggagaagcagattcaaattcagtttgactgctctgctggctctttgcagcttcctgaggggaggggagaggagagactttctgaggcgagggatggaggtgctaggcctggcatctcacattatccttgctgtggtgctggaaggttcccaggtctccaaatgctgtgtttaaataattatctcaaggtcgcggagctgatgagaagaggcatctgagtcaagccagagctcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaggatgaaatatgtgctcagggcctggcacagggccaggtactgtttccagttagttctactttgggtattgggagcatgagcctggatggcatgttctcgtagggagtagtacaatccacagtctgttcaatttctaaaagaacactcagaaacaaatatgtatgacaggtaaatgaatgcccatagccgccacaggctctcttctgtctgtctgtctgtctgtctccttctgagtcagtctctctctctctctctctctctctctctcagaaacaaagatgtgtgacaggtaagtgaacacccatagcaaccccaggttctctgtctgcttgcctgtctgtctatcactcactcattcagaaacaaagatatgtgagagctaagtggatgtccatagcagccataggctctcttctgtctgtctgtctgtctgtctatctgagagagagagagcatgactttatatgtgcacacatgcatgttcaggtgcgtgtgcatatgggatgaagttgtgtgtctacattgattattcttcactttgtcttgatacagtggtctctcactggacctggggctcacaggttgaccagactggctcgctagtgagttcctggcatctgcctgcctttagctctaggcttatgagtgtgtgtgacatgtctagctttacagaatgtatgctggtgattggaactcaggtcctcaaacgcttgtgtggcaggcaccttaccaactgagccatctccccatcttacacatctttagaggacatcaccttattcttttctatagtggagaagtaccaaaacctaagcggggaggtgccttcctcctctgatgtgcagcttgatgttgttagtcttctccaggtggctgacctcacaccttatcccctttcttgcccttcacggtgaggaagtaaatgataatggcatgctactttttcattggtggagtcttgcttctaaggctaccctagagctcctgttagagtaatttgctatattaaagccctgaggaggcctggagaggtggctaggtggttaagaacactggatgctcttctagagacccacactgtggctcacaaccacatgtaactccagttccagaagatctggtgccctcttctggcttctttgggcaccagacatgacatggtgcacaggcatatgtgcagacaaacccacgtgcatataaagtaaatacaaaaatcaaaaagttctaacttaccaaaaaagaaactttcattgatacaatgttataatatatgggaatccgggtgattaattacgtgactatgtgactgcctgctcatgttggtggtgacactgggtagtgcttagcataggtgcaccagcaggttcaagggactgctctgccccaggtgattcctggactttgggttggactttcagtttttttgttttcagttgctggagaggagttagctgtgcacactggagttccacacagtgaactgctttcatggttgctttctagaactgtgaatgacgtgaaaaccccctgggtgaggagacactaagtgttcagttctctatgtctttgattggctcgtgtgcttttctttttgtggctgttcttagaatttaaagctatcttggctgtgagagtgatttgcttggtgaccaagatcaaggtcagattctcattggatgagtgatttggggcaattcatacacctttgcaaacctctgatcctccccacccccactgcttgtagctgcactttgatgttcaaacccttgttcaaacacaagggctatttttagaggaagggtctccttgctgttcctaaccacctcttactggggacctgcatctgtctctgtcactagtctggggacatagctccaggctgttacagctgtccctctgttcccttggcctgccagccctgggtgaggccactcccatcccaggcactgcctggggctccctgtcctgactttccagctagctcactgcattttgaagggaggacttttgcgatctctgatccacagtgcctgaaacacagatgcagaacctctgaagctgctgccgtgctcccaagcagatacacttatcattgtatttgaactacactgagacttactgcaattcttccataaggtctgtgactgggacttggcccacaacctctcacatggctgggtgtcttacttagcccttggtaaaaggtgaaatggatgagtgaaagaaagagatggcaccactcaaaaagcagattctgtctgtgttatctgaacacctctgactaacctggaactcactctgtagaccaggttggccttgaactcacagagatccgtctgctgccacctcccaagtgatgggaataaaatggaaataaaagtgtgtgccaccatttcctcagagttactcttaacagatggggtgtagtttggaaacgacacttagaaccttatgttataagcacttccttctgggtataagaagatgccatcctatactgacttatggcaactatattagtgtccgcaggtctgtggtaatgggagtggagctgcttacaatcttagggagggtctgaagaccttcatgagggagtcccagctgttacctctcataacctaagtgatcttggcagatgcctttacccgctgagccatttcattgcgttagtagcctacagcatggcttagaaccacagcatggcttagaaccacatcgatgtgtctaaatagagagttcttgctgcatcctcgtggtctgggtaaagacctgggcctgagagaacttactttgtgaggtgtaagctcaggaatgattccccgggtacacgctcctctacagagtacatccgtaaatctaaaagctcttggagagtgcatgcgtgaggaaggaggagatacagtggttggaggtggtctccattctgacttctcaagcccttcaagtaggcacttcaaagctttgcctagagtgtgtgttttgtgacttcttgtggtgactatgttttggcaacccttcattagcaccggccaatgccttgaatgaaaactgttggtgatcacctgcaagtgaaaatttagctttcttcaagtgggtctcactggggaaacaaattactcttaaggctaggcagcatgcccagcagcagatgatctacagaaaacagacccaatcagtatcactggagcctctttgtcttataacgttgttgatgttgtatcagggtttacatcatcatcattacatatttattttatttatagccctccaccttttttattttaaaaaagaaactctcctggttctttgggtatatattatggctttcagttaagcctttttgtgggatgcctgagtgtgtgaatcaatggggacaagtggatctctgggtctatatctggttatttgggctctttttcttccatttgtttgttttgtcctattctgacgtgttagttatttgtcctatcatattttattattatccccctgtttattttctgagagacagaagggtttactctggatgggaggggaggagcagaggaactgagaggagagggaggagggaaaccttagtcagcatatattgtgtgaaggggaaaatctcttttcaataaaagaagaagaaaaaaagaagaaaatcgtggtgaaccatctgtgtgtgcttataggacagatgcacatggaacggacacagcaaggatgaggtataaagaacatcaaccagaaaagaccccccaccccccaccccccaggatctctgtgcatgtctgattgccaatcagaggaaacaaagaccgtttgcatctggagtcaccagcccccacctgtcatagtttcctctgaatctcagtgagagcctccagctgctgttaacatgccatctctctgtttctgcagtgagctagaggagccgtgcttacacaagatggcacccaagccatccgtcccaacaccgtggccctgtggtctcagccagctggtacagaagtggcagttgctgggttggacccgtgacccgtgcggtcacgtggtaggagctagaggtgcagggcgtggcatgagtgccaggaaggacaggaagcatcctctggggagctccccgtactccgcccccgcccctcctcccatgggggagagaggcaattcttagttccatctaatgcttttaaccagcaaggccagacttcagcctctagctctgcagagaaagctctgacctgaaaagttctatcccgttgaggaatgtcggggtgcttctctctggagggaccgtaagtagtgggagtataatggagggtgcgctgtgagcagagagaggcttggcgttttcaagagtccatatgtggttcttggaataaacacaaaatacaccgaagggctgtttttctagaaaccatggtccggttgactctgccaagcagcaggctgttaatgttctcccacagtgtctgattacagcacctgtttgggggacatgcagaccacagcgtagctctgccagcaattatctgtctatttttatagctcaccagggcagtattggtcactaaaaaagtgggccatctgagaactgcacgagcaagatatcagttcactgaggctgaggcaggaggattgagagttcaaggtcagcgtcggttacaaagggaggtctgtctacctatctctctctttctgtctctctctctctcacacacacacacacacacacacacacacacacacacactgtatgtttttgtctacacacccacacacagcaggactggtaatgtttctgtttatacacccatacctacacatggtggattgatatatgtttttgtttacacatacacacagtggattgatacactacatattttggtctatatatgcatgatgaacttatgactgtatatttttgcctatatatacactgtggactggacttattacttattattatgttttagtctcttgagctctttcttggctttttattttattttatttttttccctacagagtctcaccatgtagctgggctaatctcaaactctctcggatcttcctgtgacaccctccccaaacccctaatgctggcttttcaggctgtgcagccaaaaccaagagagttcttcccccttagcactgtacccgttcacttggtattgaggaataatgatttttcccttcgaaaatcctcatttggctgactttagtggggtatagggtcagtagttcctttcctgtggcttatggctgcagatctgctgatgtgaatgataaagcgataacaccatattcctatccactcatttccggtttctttcccgagttcctttgttgccactttgctcacacattttagatttttgtcttcccacactcttgtgagaggctgccaacctgtgtccccacccaggtgcaacgcagatgtccacgtcgttgtctgctgaaaggatcctgtttcagaaatgagtgttgcgttcttcattgggaagtttgcagagtcaaagctgacggaagcccagggtcagaatctcagctccatggggtgagcttggtagaatttcagagttccctgggaggacttggcacccgcccttgggaatgacaggagtagaacctgtctcatagagatgtggacgtctgtatcacatgagtcgtagggcacttggcatgaatgccactttgggttccagctcatggccctttgtggctattcttcctctcccagactcactcctgttgcttccaggttggggagaaaaagttgtgttcaactcatttttattactgagcaaccccccctcacccccacccccctccaataagctttgtaatactattttcagtggacgagttcttaaaactaattctgtcacttgcctcgtctgcgttgtgggggccaggtaggcagtgaagcttgtgttgctgatgttgtgaagatgtgggctctttcccatggtgatgaagagctgcctagctcttgtctgagtgtgacggtccctctaagtctctttgtgccttatgtgtaggggtgtgagtgtgcacacacgtgcatgtgttagtgcatgttcttacaggcagatgtgtataggtgccagaggtcagcactggatatctcttgtcactcactgtctgccttgatttttgaggcagggtctctcactggtcctggagcatactgtacaggctagattagctagcccctcccctcctgctgggattacaaatgctatgcaaagcattttaattgcatgatctgggggttgaactccgggtttgtgtttgtaaggtgcgctgtttattggagctgtctcaacttcccttgatctttctaaatgtttcttaatgaactttggtttcttaaggttttgcccatttgtaattgtatagacttaattcttctttattgcttgttttgggggtaagggagtgtgagacaggtttctctatgtatgtagctctggatgccctggaactcactacacagaccaagctgcccatgaacttgtggtagtttcttctgtttctacttccttgggttggggttacagatgcgagccaccacatcaagttgacccttagctttcacatgccagactagtcaaaatccacaaggactgatgaacactgttttataaaatgctgcttgtgaaaaaaaaaaagaaaaaaaaaaaaggaccttctggagctggaccgtgtgcacagcatggatggcatctgtgctgtggttgggaaggaccacggcagtgcagtttggtgtgtttgctatagaagttcctctctcagagtgctcccgtgggaaccgagcaagcagagagctgggcattttcacgtgtttcactactgaaaagtaaagaggggaactcctagtgacatggagacataattccaggcggatttctgagttcgaggtcaacctggtctacagagtgagttccaggacagccagggctatacagaaaccctgtcttgaaaaaccaaaacaaacaaacaaacaaacaaaccaacgagacgtaattccttaagggaagcacagcttctcagatggttgggaactttttcagcttagcacaggggcaggcatctgtgtgtcaccactcgggtgcttagagtttctgtgacctgtcttagaacgcttggaacctacctgtgaggagaggagcagctgacactcatgctgctgtcacacgtgaagatgccatgggtctttccatggctgggacagaaatgagcatgacgcaaaatcctggccttgaatatgcctcacctactggtgtgttgttaatctgagtcattgctactttgggctgcagctctatctcccgttcacttttaatcatttttttggtcctgtccctatagatgtctgcttttagacccaccctgctgtgtaaagtcccagctataagccttgtgggccagtgttgtgtgggaggatactggggcaggggtggggggtggagaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttaatgtgagaaaatcagaggaatgtgcagatccgagggccccattttctcccccatgagcctgatagttgtaaatgcagttatttgatctctttctgaagtgacttattttgtagtcatttgtatttacagcacgctgcttgcccaagtgtgaaaaccagagccatagagtttcggtattatctgaagtcataaaataccttttatgtacacagtaaatctgggagagattatagtagaaaacccctacagaccaagcacactgaaagtggtggcaattttcagagataaataagttacttataattctgattaaagtctctgccagttacatgttaagtaaccctcaactctgctcttttccttgtttcttttcctggtagatgtgcctgctctaggatggttagagccttagccagtttcctctaccctggctcttgacccataaaccccaccagttagattcacaattactattgtcctatgtgtgctgtgtctgcgtgtttggtatatttggttgtggatatgtacatacatagatgcatgcatacaaatgcatgtatgcgtctatatgtgtgtatatatgtctatgtgtattatatatatgcatgcatgtatatgcttgtatgcatatatgcatacacacacacacacacacacacacaatttgaggtaactggggtgatcagattccttccccttgctattctgtgtttttccttcctgcaggttgtagcaagactagactcagtaaacagaggcattctcttacagaaaaagcagtgacatttcaaaacacaaacactggcagcggcttccccggcttcctcggtcctctgtgagccacactcagcccacactcccaccccgcagttgtctccaagatgtcgctggcagatgcttgtgttttccttgagctacagtccattcatgctcggtgctgtgatgtgcgtgctgattctgggatctctctggcttcattctggagacgagaacggttttcatgttcccaccaggctgacatttttaagagctcagccaattcgagatgttggattttactttttcttgtctctctactctggatggaatggaagtcaggcaggccagaaggctggatggcattgttccgccagtctcccagacaggtgaggcagagggattaaggagtaattggtgctctctttgcagaatgatttttgttcaaacctgagcttcctctgaggactgggaaaagtgaactgaactggtggtattcagtttattgagcagtggttctgtacacatctgtttggtctctcctgattttaaaagactagctgttgacctggctgggcctgtccctaaatcgttgtctgtttctcctttggctgtcctgaccatgagtatatgtcactaagagtgtttcccataatggggcaacccttcccaggtctcttgtcttacccagcagccttggagttgttgacagcaagaatagtcttatttcattttaagaaatctttaaaatggtccttattgttattgtgtatgtatacttgcttgtgtgcacaggtgctctcatgtgtgtgatcatgtgtgtgtacacatgcttaggagtgtgggaggtcagccctggatattgtttatcagtctctgtctgtgttttctttttttgagacagggtctctcactggttggaaagaactgtttaggcaaggttggccagttaggactcagagatctgcatctctgtgtgctcccccctcccctacccagagtgctgtgattacaaattcatgtatcggggattgaactcgggccctaatgcttgtgtggcaagcccttgagcctctgagctctcaccctacttcaagtctattatttttcccataacttcttgaagcccaaggcaactccacgccactgcaagtaagttaatttattcccatttagcactttcttcctaaattgggtgaggaggaagatgattcagggcccccagcgaatctcccctgcactgtgaatagatgtcttgtcgaatgccgggcagatccagttgtggactgcgtcagtttagctgcttccccttgactgccgcttgtcccctcccagggacaaggagatgatagttctcttgtgtgtttgtatttcctcttctcaggagctgaggtgtgccttctctggtccccacctcccactgccttggcatttcttatcttttggggttcttttgtttcacttgcccagagctgggaattgcagttaaaccaagtctccccctgcttggcactcctgtcccgtggccttggaactcccagcaaggatacttctctgtttgccccacagcgaaacttcagctttgctataaatggcaaagttactgaattgccttggctccacgccaaatgctggaaataatttgagagtataaaaacatagctttcatatgaaaatatttattttaggagccttcggtaggcttgtgtgtgtgtgtgcgcgcgcgcgtgctagtcattttcattatgaattagttcctttctctgactgtgtggataaaccttcctgaacatctgatttactgagatggcgacgattcttgtcccacactgtcacccctcccatcagggaaggcataaatgacgcaatcgaatttgaattaaaaaaaaaaatctgctctgagatgcctttggtacacaggaaaggctgctgggaacacgtactttttgttgttaagatttgtttttttaatgcagggcgtggtggcccacacctttaatcccagctctccagaggctatggcaagttgataaaggatctctgtgagtctgaggctagcctggtctacccagtgagttctacactcagagaaatcctgtctcaaaaacaagcaagcaaacaaacaataacatcaaaacagcaccctccccccccaaaaaaaaaaccacaaaccaaaaagtttgtttttactgatatacattcgtgtatgtctgaatgcatgaaagtgctacatatatttgggtaccactgaggccagaggagggtattggatgccctggaactagaattataggctgtagtgtgccaccccaaatgggtgctgtgaaccaaactcaggtcctctgcaggagcagcagacacacttaacgactgaccatgggcccattttctagccttccttgtttttgttttttgctctgagccagggctcatgcagctcagactggcctagaacttggtgtgtagcagggtctggcctagaccttctacccttttgccttcacttcccaagtgctcagatcacaagtgtgtaccccaacatccgacattcacggtgtgctcagcgaggtccaggctagcaacttcacccccttcccactggcaactaaatggatggataaggacagagattggttctggatggagggaaatggcacagcgaagcaagccatcacttcataagctcactagaaaataaccaaagataaaaattgtgatttcagagaacttgccgtctactaaactgtccttgagtccttgcatctgaacgaggcctgaggaggcttaaaccacgctgccccctgtccttggggtcagggtgacacttgtgctttgagttaataaagcagggtaggtgttggagcttggtcatagttgttctaaaggttttacatttcagtcaacccagtagattagtagcttgggaaacatccccagtttggggcttttggggcctgagggggctcagtggttctttgcaggtgttctgccactttgtcatggaactgggagtaaaaccttccccagtttgcaaggcttctcagaatcctgtggcttaggaatcaagacatagaatccagttttcaaattcttaggagaggcacagtgtcttactcaccgagcaggaccggatgcagctcaagcctttattttgaatatgactgtgccacccaatagcctgcaagtattctttgcaatatgcaatggaatagattttaaatcatatctgttcatagtgaagggtacccaagaatatatctatttattcctttttttattcccttgtgtaagcgtgactgacctggaactcactctgtagaccaggcaggccttgaacttagacatctgcctgcctctgtctcccaagtgctggggtaaaagacgtgcaccaccactgactggctatttattcattttctcacgaacagaattgcacttttgttcctaggttacaatctgtgctgtgtgtgaaagaggcccactgaggtaggtcactgggtcatccattgcacgtgtcctgcttctggagtcctcatcttcagccgtcttaggcaagggcaggagaaaacgagaatggatgacacttcttgctatgtatgacactaagtcctttgtagggatgtggggttctctccccgactctcattacagagtgtcaggttcaccttgacctatatagcttggtgactgcaggtctgtcaggcctcctccatggcttcactggtaaatcatgctgtacccagccggcatattgcaaaccatacttggcatggccagttttatcaccccagactttttccttccccagtgtaaccaccttcccaagctctggtctgagtcttgcctctggtgattctctgatgctctatgggccaaaatccaaactagtttgttgtagaatccagtccaggtgacatgactctccgtctgctcttgtctgggcctggcttttgacatgactttggtggaggagacgcaggctggatagagagtacattgtttgcttagcatatgatttctctgcctcttgcatgcctgtgtccctcctgtcactctgggccaaggtcccccctcactacaacctttcccaatcctctcaagcattttccatctctaagccttgcgtttctactttttcctgaaccttaaggaagtccaggcatttgaaaaatactcacgagtgtcttgatattttcacttctttaatacaagaagtttcactaatgtgtaaccaagcctcatttgaggtatttttggttttatatatctgcgtgtgttttgtttgtatatatgtctatgtgcatgcctggtgtctgcagggccagatgaatctggagttatagatggttgtgagctgccatgtgggtgctgggaattgaacctgttctagaagaacagggagtgctcttaaccactgagccatgtctctagccccagccaagcatgttttgacaagacttaaaaaaacaaccaaaaaatgttttgtatagtatttatttatttcgtcttcccaacacatgagtggcctagataaatttagctaagcacgacatgtcattcttcaggccgtgttttaaatatctcagggcttaggacatggccaggagtaaaaagctgtttattaaaaagccttcatggcgagtcatgggatttgatgctttttttttccctttctcactgctgggatgaagcagagagcctggagtgtacttgggaagggctccagctccgagccacaccccagcctgagtcactggattttagagctggggtaaccaaggtgaattcagttactgtagtaagatatggccctcagataagggagaggccacactgtgccccagttgttctgggactggttcaggtggtcactgctctgtcgtcagccactgtacttttgtaattaatgcctcggtctagctgctgcctgctgcctgctgcctctgctgggtcgggtgaggagcaaggtggaggagtatcagttccagggagactcccaacttctgtcaacttcctgccctcgaaatcctgagctcaccctgctctgatttcattattatggttttgattatgtcccccccccccccaccatcccaaatcagaaagtggaaaaacactggattgttttatgtgacttgtctttttgtgttgattacatctcatgtcctttataaagctaactttaaactgctaagatataaagcaaaggtgtcattaccgatgaaggaaacttgggacgaactgtgcatggagaagtggcccttgtagcgtttgccttgtgacagaaacaggtttttttgttgttgttgttttttgagacagggtttctctgtatagctctggctaacctggaactcactttatagaccaggctggcctcgaactcagaaatccgcctgcctctgcctcccgagtgctgggattaaaggtgtgtgccaccacgcccggccagaaacagttttaaatgctccaggtatttggttgacccacttaggggtcatgaggtgatgcccgttattatcctcattgaagcacagaagggttaatgacgtgcccgacgtcacacagcccataagaggcagagctgggatttaagtagaagcagtctgattctagaaaacggatgaagatagtcactgtgtcttttcatttcttacctatttcttacctgcgtgtgtgcatgtgcagtgtgtggagatcagaggctagttagtccctaggagttgtctactgctcatttttgtgtgtgtgttttttcctgtcaggatctctcacttgcccagggcctgtccattaggcgggctggtcaggtcatggagtctcaggagtccattgcctttgtcaccccaatacatactgaaccaccaaacctggcttctcacaggggtgctgaaacccctacctccctactcctgctgcgagtaaccgtgtttctgacgtgcatcctcagtaacagggtaccccgtcacactgagtacatgctcagtcatggggtaccttgcttggcagctctaccccatggcctgattctcctaccgtccccacactgctgtaccaagtcgggcaggagagtggtgaaaaccattatgttcaagtgaggatttttcactctggaccggagatgcacctcagctagcctcacggtgcttgcccaggtttatcactgacatctgttccctgtgtgtatccagctggggccgaagccacgtctgctcttctagcttcctcctgcctataaagggtaatcttaggcttggtttgtctttgatggtgactgcagaggaagatgggttctagctacgacttagtgtgaacctgcctgtcatgatcctgtatttctggagcctttgcacctgacaggaataggcccaaggaatcttacaggtcaggcaaagccccaggctcaaaatcctaccaagcctggaaaaaaattctttgttggtgactggttcagagtgaaatcagccccttgcaatctagttttttctttgactagccagcgtaggcatgagatgttgaacttgggaaatccattaagaatgatagatctagctgggtgtggtggcttacccttgtaatgccagcatttgggaggccgaggcaggacaattactgtgagtctgaggctctatctcagaaaaccaaacgagaaaagactggtaaatatagtttagggataaacatgtgaattatagcatcagctaaggcttaaaagcttttcattgtgatatcaaaaagcctttcacagggacccccccccccccccccccacacacacacacatgctttgagagttgaaagcagaagttttcacaggcagtgcctcctattttagcttcacagaaaggagaaggagcttggtacagtgggggaggaaggcgacaggatcagggtaggatgtggctccgtggtggggcaggtgcctggcctgtgtgtttgagaccagagccaacccccagtctacaaaaaaatcaaagtcaaaagtttcttccgggctggtgagatggctcagtggctaagagcacccgactgctcttccgaaggtccagagttcaaatcccagcaaccacatggtggctcataaccatctgaaacaagatctgacgccctcttctggagtgtctgaagacagctactgtgtacttacatataataataaataaatctttaaaaaaaaaaaaaaaaaaagtttcttccatggtccaagtgtggaggcctgaactccttatacagcatggaagagaatcactttaatgagctgcaaggccctggtcccctggccccgagcattctggatcgtaagcaggtgtctcattctgattgtaaatccatgtgtatttgtcttttccagggaattaaaaaaaaaaagtcatttgttattttgcaaggatggcgtgatggtgacagtatgcctgccatctgcttcggctgctatgatgtaagacacttcgatattaacccgaaatagcaaattggagcagaccaggcactttaaaatcttgagttttatctgaagtgtgaatatggaacggatacagaaatcttggaacagagactcctttgttgcgatgtgggagaatatccatgaattttaatggaagatgtgaatagacaaaggagatgatttttgaagaagctggaggcttccttctggaggcggaggagaccctcctgggtagaggtggcctgtgtttggatcaaagtcaggccggccttagacaccggaagtcgcagctgctagggcccgagtctctggccctttgttcagaccttctcctgatgaattttggagagaaggggggagttcccatcattcctaagtatctggctctggacgctgtgtggataaaactcagggaagctgatcacatgatcataggtcgctgctgataggtttgaatagattttatatttattgctatacttggaaggtctaagagagtccagtcagtcagtaacattagggttaggattggtcctgttcatgcaaagttgtgcttctgtgagtgtgtgtacatgttaaaatttgttaccccaaagcaatatttaaggtgctttcttgggtgttggtggtccatggatgtgtctgatacccaaacatgctagtagttcaggatgcttgtgccaggtgaggctggacaaggctacacttttcttgatgtttcctcaaactgttagtgtttctgtggcagtctacttaaccccaggctgttttggattttcatgtttctgttggtgatttctatttagaatgttctcagttgtagggctggtatgtgtttagtgttcctaaggatgggctgtgatgtgtcttaggaagaaatatctgtatgttagaaagccactgttgcctgtgactaatgcttataaggtagccatatactaaaaggtttcttttaaaaactagaaacataaataacaaagttacgtgttgatcgtttgagcaaagtatgttgggaacctgtaggaacctgcctctgaacatctggcaggattaaaggcaggtaaatgctaatggggtgatcaaagccatcttgtaccttaggacaatcaccttgatcagtgaggggccctttgagaaaccctttgctcctttctagtcctccaaagtgtgtgagaggcctgttgggttctgaagggtcttgaacccgtgtttactgttggtgtgcatctttgcaagtgtgggtatgtggaccagaaccacacaccagcagtagaactcaggtgaaaagaaatccgtgcgcagcgcattcttcccttcagaagtcccgctgttccttcatttgataccagtgggctctgtggatccatgtagaaccgtgtagatcccagtagcttttcactggcttcctgagctggtgccctggcagcatacagtcggtgttaaaaacaggctccatgggaacctactgtatgtggcaagagtggcttttacgtctatagaaggctttgcatttcaatgtatattattctgtaggttcaacaaaaagtatttaatttttaaaaagctcatgtgtgtatgtatgtgtgtgtggtgttatctacttttctgtattttgtataacttttattttgtcacttacaagaaaaaaggattgaaggaagtgatagaacaaaacaggctctgtttagggaagtgtttttttgaggtcatttggctagacagtgaatgaaagaggcagaatttccggtatgggcttttggtaggggaactgaagtccgccacaaggcctgggttcagtgtttacagagtcattgtaaagtgactctgacttacagaataatgggtaatattcaacaatacatgaaactttagaaaatctctgtgtgtgtgtgtgtgtgtgtccacatctgtctgtccgtgttcacctgcctgttttatcatcattctgtcctgctgtctgtggtgtctgtctgtggtgtttaggcctggtgtgtttatgtatttaattgtggtaagatacacataatatttagtctttcaattaggttcacagttcagcactgtttagtgcattcaataatgataaatgatggggcttctagaattcttactgtctggcaaccctgaaactctgtctgtgtccagtaaacagtacccctgtctctctttatcccagtctcttgaaattgctgtcttgctttgccttgttatgcatttgatgactccaaataagtcacataagccacacacatggcatttatggttctgctttttggtgactggcttatttaatttggcacagtgtgagaaagccgggcatcatggcacgcacttgttagagctgtaggacttggtgttcagccagcctagcctaaccaaggaggccctggtcccaggtagagaacctatctcaaaccaaagtggaggggaccctgtacacacacacacacacacacacacacacacacacacacacacacacacacacacagaggatgtaggtggggaatcctgttctgttttcccacactaaggccatgcctgtgcgatgatgattcttgttctttagaaataagagtttgtttccttgtctgcctgggcttttggtcatagtagcataagcagtgttatttctaagcatctttatgtttggtaactgtattctcaacctgcctcttcctctttctcttttttcctccctatgaacatctgggcttgagatgtttcgtgttttataatggttttctcagatagttgcccggcttccagctggaaggagcagccaagctgaggtcaagactgaaccacacggtcggtcctttgaaaggatgcctttttaaatcatgtttgctcaccttttcgtaggccatggtcattactgtgcttgcccagggttccgttcgtgactgacccagcagggagctttctacacttcccaagcaagaagtgcattcttaaaccttagcatttgtttcaagtgagcaatgaatgcatacagttatttctaatttatacagaatgcctactcctggttctggtccatgtcttgcttatttcatctcctcctgcatcagagagacagaggctctagcttacgctgctcttgaactccttggtagcccaggatgacctcagacttcagattgctccatttctacctcctgtagcgttttgagattacaggcgtgtgccaccacacctggctcttatacactactggagatcaagcccagaacaccttgcatgcactgccagcctagccatgttcctgggtctcatcatgtgctgtagtcacagagccagggagtggggaggagggagaggagggaggagggaagaggaagtaggaggtaggatggacaggccttccttcccatgtggtcttcagtgcatgggatgtcagacagaaacccgacctgcctcaagacatcgcccccccccccccccaactggtagttggtgcccatctactgagaccaagtttttcagtgatttttttttccttcataatttttttctaacttctttttgtgaagctcttatttatttttaaatacattttcaattgaatagatcttaagtatattttcaaattaagatataatgacaccacttccttccttccttccctttccccaactctgttccattttctttcgctgggaaacagcctgtttgatcagcctaagaagaattcatacttggtattttgtgtttgtgtcccggatcttctgtcttgccacactgtcatccaattctagctgtggatccagctctgctttaatggcgactgtccttgatggagactcaaaaggtcagactcactctctaaacatgagaagctaggcggatgtctttggttcaagttgaacagagccatgatttggggcatgaggaaagtctttggagagaatctagcttccttgtataactgagtgagtttgctgcagtgcgtgctttcatcatgttgggatcactatgttgactgtgtgatgtggagttgagcccgatgtctgctgaaggtggagggcagcgtctgcatcagtctgtagaccgaccacccagcctctccttgcagttcatcatgtttactgctttggatgggaggcctgacttcttgtacactgatccttcctatgagatgaaatagcaagaaggcttttgcttttgctttttctcttaaagggaatccgtgagtactgaatggtgatagactatacaatatgttcagtgcaatggctggcacccagaaaatgtccactactattaacccttagtcaaagggcactgatgattttggactaagacgggggtgttgagttccggtttctctcttccatcaacacttatctgaaggtgagtctccaagagttcagtcagggtcatttattaatagctaccacaacacacgtttctagcagtcaaccagtcagtcattgcttgctggataaagggctgtttcattataatagtgtctgccttctgtggctccatcttgtagctgtgttttgtctctagggctctctgatcctggagggagaaagctcttcccagggttgcagaggcctggaacagagatatggcctgtctccagagcactgttgctggcgggctgagtggggagcatgggtgtgtctggtcaccaggaacaacaaagccacactgtggatctgaggtcctgggaagccatccagtttcctcctcctgaccctgactcaagtcttccctgaagtcctctgtcagctccagccctgttctcgtctatcagccacccgaaccctccttatataacccagctgggtctccaggtcaggcagtgagcaagtgagcgaggtggcacatggatgttctgtgcttaatagaagaaaacaaaacaaaacaccaccgccaacaacaaaaaccctggggtggggggaggggcacctggtcagtgatgcaggtggaaagctgaggacctgcatgggatggcaacaatgtttccacctttctgattggacactcaatactttagagtgctaagaagaaaggttctgtcctaggcacttctttaagattttgtgtttcaggtaatgatggtaaacttcagtaacactttaaaaaaattattagtttaattttttttattcttctctcatatattccatcctgattgcagtttcatctccttcccctccctttccagcctccctgagacatcaactaaacatgatatgacaaactgcagtaagaccaggcacatatcatcacaaaattattagtttatgatttgaatgactgtactggccggttttgtgtgtcaacttgacatagctggagttatcacagagaaaggagcttcagttggggaaatgcctccatgagatccaactgtaaggcattttctcaattagtgatcaagggggaaaggccccttgtgggtgggaccatctctgggctggtagtcttggttctataagagactaggctgagcaagccaggggaagcaagtcagttagggacatccctccatggcctctgcatcagctcctgcttcctgacctgcttgagttccagtcctgactttcttggtgatgaacagcagtatggaagtgtaagctgaataaaccctttcttccgcaacttgtttcttggtcatgatgtttgtgcaggagtagaaaccctgactaagaccatactaagacctgactattgaccacaattggcctgttgattcctccccacccagcaggcaacttttttgttagtttgtttttgtttctctttgtatcttatttctttttatattattaactgctatggaatatggaaagatgaaaggggcagaatgtgagatgcagaaaataaaagaccatataatgagttaaattttaaaacctttaaaagcatttatttgtgtgtgtgtgtgtgtgtttacacatatgtacaaccatggtctgcttatacaggtcagaggacaacttgaaggagttgtttcttctctccttttcccatgtgcgtctcagggactgaattcaggacctaaggtctgacaccaaaagcctttatccaccttgctggctagttttatgtcaacttgacctaagctagagttatctgaaggaagggaacctctgttaagaaaatgcttcatcagatctgactgtaagacattttcttagtgattgatgggttaggccattgagggtggggccttccctgggctggggatcctggattctgtaagaaaggtagctgagcaagccatgatgagcaagccagtgagcaacatccctccatggcctctgcatcatctcctgcatccaggttcctgccctgctaagttcctgtcctgacttcaaggatgatgcctagtgatatggaattgtacgccaaataaactcttccccccccccaactcttttggtcatagtgtcttatagctgtagaaaccctaagtaagagacccactgcaccattttgacagtctaagagtgttttttttttttctgtgtaagatttcatctctatgtttaaaaaaaaaaaaaaaaaaaaagaggattcttgagcatccttcttaccacagtcagggttgtgtccagattaaatgactagaagttgaaaataccgtatttttgttgaaactgtggaaatactgcatgtctaaaacacattgataaatctcactatcctgcctaaggcctcctttccttgtcttcttctttttttctatttgcctgtttgtgtgtcagcgcggaggaggaagagttggatgggtggggaagatctgggaggcattgggggaggggaactgtgatcagaatatattgtacgagaaacatattttcagttaaaagaatgcactatgcacttggaacatggatattagcatttaattgggcaaaatcattcggcatgaaggccattttagaatagtgttggctttcatggagtttattgagtgctctgctaatgtcaaacatagaatgagtcccaggctataccttcccaccaatgaggggattatctgggactgcgtttatctgcagttcaaagcaaccacagaagcctgttttatctggcctccttaactgggtgaaggcactgagggagggacagcccgggagggagccagaagaaagggcttagagtcggtggcttttttgcctcccagcctcattgtcctgggtgttcagccttctctctggtgtcactcaggatacagtgatggcagtgacttgaggcacggggtcagctcagttgtggaggaacacagtgggcctgtctcctggaaacagttattcccaggccatggtgcaatgcttagttgtctgccctttctccctattgctactgagtgagctgcaatggtggctggagagacgcagggtttgtccttctctgctcttgaccccaaggctgattctttcttctctcttgtcattgtctgacaagtgagacacaccagtgacgacataatgtgacaaggatctgtgaggtgctttttattagctgtagttaaaaaaaaaatgtcttttttatctcatttcaacaccagctgcggacttttcatctctcattctaaggaaccagacaactactgaccacacgatgaaatcagcaacacacttagcccttgagctctgatgcgatccagaggttcgtctgaggatattcttagccatattcagtatcagttgaggaattagtggcgctctcgttggagaggcagtgcaggaacctctctgagacaaggatgctgaagtcatctttccagccctttctacattgtagctattctgagctcctgttttctcctaggaaagttggattgacgtggactcgcacatgtctgggattatctgagtcctttctaaacagaccgacacttggaagggaacacctttgcttgctgactgctttcctgggctgggttccaaagcttcctgactcctgaacaataacgtgttctttccatgctactttatatatttatttttcagaacccgtggcccttttatccccttagatccacctcgaaaacatgcttgtgtcctgtcggagcagaggttcaaactgtggagaattttctgttttgacattccacagtgacagtgggcttcggaggaggacaagggaaccctttatgcaccccccccattccttcttcctccattcctgctccatcttcctcctctcccctcctctcttccagtctttcttttctttttttcacaaacaatcgtaacatgttcttggtgctcatgtgcctttctgcatttttgttaggcattcttgaccaccatcagccatccctatgtggggaaggttgagtatttcttcaagacatacattccttaagggaaggtttgagccattctgaccttttaagatttttctctgacttttttttttttttttatttgctgtctgaaaatgtgctgtttctacttttaaggagaaacaagactacagttgtgataatggctgtgtagctggagtacgttggaggtaagctgttggtggttatagggacggaaggaggcttgcgattctcaggttcaggctctcccttagaggaaatagaagctgcttcgccaccagacaggagagtgggaaagctgaggtgcagaccttgctttgcctggttccagagacttctctcccagcggttgagaaactattgagtggaactgcacttttccgacagctgaaaggaaaatgccattgtagctgcttttgggtcacagtgtcttctttgaatgggcatgaagcccagctccctgtcacagacctcagccgctgaaggactctaccttctgaaagcctgactatgtgaaacatgattcagctttctctgtttcatcacaacagacgctgttttgtgagtgttgactattattgtctagtcctattgtcctttgcagctggggacctatggctcttttggcctggttatggcaaacctcttgcagggaacccgctcttccttgttgtgacttaagcaccttttgctgctctaggactgatgctcatgaccctgtcctcttccctgtcatacccacaggattacagttgcccgagatgttgactgtatcacagaaagcccactgctagtgaaagcagattgtctctaaagaagggacatggtggcatgcagaatctcacagggaagctataaaaatgggagaaggggtagcctgggctcaggagagaaggggaagcctgggcttaggtcttccttatggtttccatagactaacaagcccggacagggaacagtgcagggctcgttcgttgggatgttagtggcttctaggctccagacactgtatagttgcctatggtttggccttggtgacttggggcaggggacatatgtgttgaatatgtgagaggagggtatggagactctggattgctggcccgatggaaagcactttgaccatcaggttgtccctgtcattaacggaaggctaagaagcatggaacagctgccgtgtttcagtttctcaaagttagccaggcatggtagatggtgtctgctgcatgctctgtagatgtctggaggagggcatttattattttatgagcagtgagctctatcttattttgagctcttcttatgattttggacttatggtaaagactagatattttcataactagaaacaaggctcctttgtttgaaaccctgtagattcttagtgacggctttcttgacttggggtgaatccttctctctctctctctctctctctctctctctctctctctctctctctcattcttccttggtagttggaaacctttcccagtttaaataaagcccaaacaccatctgtgtgatatccttgtataagtcgtcatttatatatttacatatttattatcttacattttatgttattatttggagaggttctcactctggctgctccggagcttactatataaaccaggctagtcttgaactcagggatctgtttgcctgcctctgccctctgccttccaagtgctggagggtaaaggtgtccaccatgctcggcttcaagtcgccatttcctgccacctcctgtaagcttaagtctggtgtccttctgtatgtccagggtggcaatcacattgctggattttctcccttgtgtattttttttccctacttttggcataattctttgttttcttgcctgtggtccagcgtctagcatcatccaagcatgtgctcagcgggtgtgtctggaggtgactttgtcaagtgtcatctgtgggactagcatttcgttactgttcacctgctgatggaaggcgagactctataggtgaggctatctgttgaaggaacggaagcctcgtgaggcattctatccaacaggcccttctaagcttttgtgggaccagtggagtagtccagttcttagaggtaggtacactgaggcaggggttaggataactgggctggagagtaaataccgactcagaagcacttcaacctaatcttgcctatagatgaggtgaaattatatttctatttgaatacaaatctcacacacagcactgaaacagttcagtggtatgagcagttgaacaaggaccaaaaaaagaaaaaaagaatgttcaggctatgatcctattattgagaattttaggttatggctatgtaggaaaacctagcttgggctacatagggagatttgacacacacacacacacacacacacacacacacacacacacacacctctgtgccaaagagaaatggtggagagaggtgtacgcatccctctcctgtgtggataccctcaaacctgaaaagatgcttcccagaaatttctgcccagatccattctcagtgccttccacatgcatatttaaattagtaggcttgttaaatacttttattggtaccattgtaaagcgcaatataaaaatctcaggcccttagccaccttaggaaaacaactgtcatttattgtctcctaaccaagtgagcagcttcctcgggagccaggggtggggtgggaaggtggggaatcagagagtcacaggtgacttaacgtggagaacttcccagagacagggagagcatcacctggtgggtctgtgcgtctgtaaggaagtcaagggtgatttctgttttgttgtggaacggatctcggggaggacaggatgcctcagggtgtctccgtagagcataaaggtcccaagtcactgttaaaagcagacggttgggaaccgctgggtgcactgggacccagggatgtgtgccatccaggaaggtgggggacttgtaaagagaaagaagttggggtccagaggactttttttcccctctgagtctaagtccagggactccttgcacagactgttgctggagagcagaagagtcgtgtcccaaggtttcttccccaaggtgtggtacaagccgagatgggagagggcgtgcatgctatccctcggagatgttgcggactcatagagatgtgcatgccctgtttctgcggctgatcacaggtcccacaacagtgtatgtcattcggagtaacttaatgtgcatttctactcagtgttgaaaaaaagagctaatacagaactggaatgatttttttttttaaagaacaagattaacaaaaagaacagtttcttagcttgtcattccagtaacaagtgtttgactatctacagagacgagtaccgttttctcccttttctagcgtaaccaaggagacggagtgaagttgcagatgtctgccattaatatcaagggacactcctcagcttgctgctaagagggttaataacgggaactttgtagtgaattaatttttttttatagagttgcagtagatttaaagaaataccaggtgtccatgcagttgacaatgagctctgtatatctatatctctatatctctatatctatctatacctatctatatatacacatttgccaggttctctccttcctcccaagttttcaagatgacctagtcaaacacctttaaaactgatattaaaatattactttatgtttatgtattgtgtgtgtgtgtgcgcacatgccatgccatgctgtgtatgtgtgtgtgtgtacatgccatgctgtgtgtgtgtgcacatgccatgctctgtgtgtgtgtacatgctatgctgtgtgtgtgtgcacaagccatgctgtgtgtgtatgtgtatgcacatgccatgctgtgtgtgtgtatgcacatgccatgctgtgtgtgtgtatgcacatgccatgctgtgtgtgtggaagtgacaggataatttatggatccagttttctcctcttcctatgtgggtctcggggattggcatcagcttgccagcccttgtgcactgagccatcatgccacagctccctccccccaccactcctgtccctcccccctagcattaacactgtgaggtggtttttcttcacaggcatttctacatatcactgggttatttgagtctatgtacttttcatattgagctggcttcataaatatgctcgttgggattttttttttttaattttgagttccatgtattgaaagtatgaaacagtcaagtcactaagtcactttacaaattcacagtgtcacccagtgaccactttttgtatcttttcttttttccccctctctttgggggaaagagaacctaaaacctagggcattagcagatttcgggcatataatatgatattattaattatggtcctcatgtgaaatagtcaattgttatttatctaggataactgcatctttgtgccctctaatctgcatctctctctctctctctctctctctctctctctctctctctctctgtccacttttcacacttgtgccttagaaggtgtgataatgtgatggttggcctccagtgaattctgggtaacttgttctctcttttccatgtgtatgcgtggtgtgtgtgggtgagtgtatgcatgtaccttgtgtgtgtatgcatatgcatgtgcattttgtgaggacataatatgcatatgcgttttgtgtgtaggtgtgtgtgtgttagaggcttggacccatcttgggaatcttcctccatcactctgactactttttcagtttattctctgaggcagattttctcagttaaagccagaactcacttatcagtaagtcttgctagctagcatgctccagggatcctgtgtttctgatatctgaggctgcaattacaggcaggttgtattaacggctcagcatttccaggggttctgtggggatctaaactctggtcttcttgcttcttgggcaaatgctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacccccagccccttagttgtagggaaatagaattgctaaggaaagaccaaatcaaagatgatacatgaataaatcataaaactaaagtcataaacatctggcagacaaatcttcaccatacaaagaaaagaaatgtggtcttcataaagggtgaaatagctcgggcggcttctagaagaatgcacccagtttaggaaaagctttagaaagagaattctaagaaggtttaatcttgagtggtaggtgctgtttccaaatcccatttagaactttatcttgaatcatattttctgattgatagtttttgttcttcatttgaaaacaagtgctttttcttagaaaacaaactcccaggttccttgtatgtgataatgctggctccttgcctcgggctgtcaactcagatggaggatagtgtgacattagagatgaggttgatggtgcaagaaggactcagctctattgtatatcacagggagacatcaaatgctgtattctgggaaggattgacagtgactcagaacccgggtggaacccagggccttatgtcctaggcaagtgtaccagtgagttacattgctgtatcctccatcctccttccagattttattttgaagatgttgtttttcaggactattcctactttcttgacccgagatattgatctacttaactcattggctagcagtaagtcgaggttattactaatcacacttgacttctcattcttaaaaaacgtggcttcctggataagatgtggccatcacaattctcgctttttacgaaccctccattgaggctggagatgaagcacagccatcatgggcttgcctagcgtgagcaaagccctgagtgtgatcccagggccacaagaaactgtatagtgctgcgtgcctgtgacctcagcactcaggagcagggcaggcagaatagaacaggcattctcaaccatcttcaactccattggagtccaaggccagtctgggatccatgaaaccctgtcttagaaatgaatgaatgaatgaatgaatgaatgaatgaatgaattcagctttgaactctcctctgttccttcatcaagacctctttggtgttaactgttcccaaggacagaggagatttaaacttttaagtgagtttaacatttttaaattgataatagcaattttacactgggggcacacagataattaaatacaggtatatgacatggaatgaccaaatcagggcagctgctatttccatctctagacacagcttaagcgtggacatctcagtgttgcttttgttctcaagtttgggtatccatcgatttttctccctgtctctgccacacagagttgcgttcagctatggtcttccgattggctatgttttcataagtgaaggctcattgataatggcttggtgggaaaattctggaagctttctgctttaggtgttgggaaagacaccctgtcagaatcagcacagacctttgtccctccttctgttctcaggcaggtggctcttgaagctgttgacgctatcatttgtcacttgtgtatagggctcctgtatgttttgctcctggagcaattaaacattgcttttttgcaaatgtaaacatggcttaggattgcaatgcatttggcagatgagctatgtattgggaaaaggaaaatatcttggagagggcgtggattttacagatcaagagattagcgtcattcaggcagtcggaacctgacaagaccctgtggcgtgtgtcagtccatcttcttagatgagctgacatgacataggacaggccgctagaataaaacttgaaagtaggcagcaggaagcagaaagggaggcctgtacgcaggctttacatttctagtgccagaaaaccaaaagttgctatcaaaataaatataaaacagccactggcagacagttggcccttcccgagtctctgagctggtgtcacccttgcctttggcagttaggcagtgatctgtagaaagtctagcttggtgaggtgcagggtcctagtgtcagtggaggctgaagtctcttcgtgaatttgtaaaagggaaagccagtgggtttgtcttcactcactatttcttagcagacaactcttatgttgaaaaccatagatggaccatcatgcatttgtaagatgctttggaatctagcacatatcttctcatgaaggtgactgagctgaagcttttctccctctgtctgtctgtgctaatgtctgtctgtctgtctgtctctctctctctctctctctgcatgttaaatgcatgcattggtgcatgtgcacctgtgtgtggaggccagggattgaccttggttgttattcctaaggagctaagtagacttgttttttgaaacagggtcttccattgggatctggggcttgctaggctggtggccagtaaacccggggacccgcctgttccccagccccagccctgggattctaagtatatgccactaagcctgggttttacatggatgctggggatcaaacttaggtcctcatacttaaccagactcctcagcccccaaagcaccttttatgtgtgtatttatatgtgtatttatttaggtgaagtctatgcctaagagctcagaaaaggccttcccatgtgccaggcaacagccctgggtggtattgggctctcagtctacagaagtgcctcgagttgtttatagttcatgcttgagataggggatggtagcaccttagcctgtcaggcaggcgaaggagcaagtggtaatttggatatagtttggccaatgagctgcagaacttggttcccaccccaagcccatccctgactagtgatatgatgtcatttcatgcatatgaagtgcctttctcctaagtctcttgccttatctgtggtagcagtaggggtagtgggggggaggggggtctcttctaatgtccaaccttaccattggtacctgtgggctgctccttctacccacacctagggagacagagcaaggctgttgcaggctgaggttcagnnnnnnnnnnnnnnnnnnnnttactcaacaaatatttctgaggatctgctgaacacctgatgacactagctgcttagacacaaagttctataagacagaggcccagtctccaagatgctgtgatgccttcagtgtgttccataaaccatgaatgttttgcacatgcatataaaattagaggggaagcccggtgttgagtgggtagtttttctgctttgtctgtactgaactttgctgagatgtttttcactcaccagtggctagagaaaaataagtagagaattctatgcatttacacgagtcctgcatccttggagaggaggaggaggatgtcaggtgttaccctgaggaaccttctctgaggaacaagctgagaaatgtctacttcagtggttttcaacctgtggcaacccccataggggttacagatcagatatcccgtttatcagatatttatattgtgattccaaacagtagcaaaattacagctacgaagtagcaacagaataattttttggttggggtcaccacaacatgaggaattaccattaaagggccacagcatttggtaggttgggaacaactggtctacctatgtgtagcagctcagggttgagtttcattcatagctacttagactgttgctgcttctccatctgcctctggactgtgagtccagtgtgggtttgtcttgtgaaaagaaaggggatttcccttgggttaaaaaaaaaaaaagtaaatattagaaaatggtgctttacttttaggagtcttactaccttggtatctaaaattcctatttaaagtttttctttttttctttagtttaagaaggtgggcttgaaaccaccacatgaattttcaggaaaactcttaaggcgtagatatttcagcagaacaggctggaagtgagagcccaggtttgtaagacaggccaagggagatggtaagggattgtacatggagagacacttcatgcccacaggagtcattgtcagggtctttgtacgacatcacccactgagctcagtgttggaggcagaaggaagaaagcgaacctttgctggatatcgtgatgtttaccaccatcctttcttcctgtgatgggtcaatggttgccgcataggtttcacgtgtttggacattgaactgaaatagatccccaagtgaggagactccttcagttctgcatccacgtgttttctgccagagatactttccagagtgtataattgcattttatgtttcatctcttttaatactgggttaagtctgtagttaagggagagagcacgttcaatttccttttggatcagtaccagcttaaattatgaatggaggctatgtaactgtagtgtctgctcttggtccttgaagcgttttgactcagtgatgcctttccaggtccagaggtgaccagcaggtatcagtgcataggacttcttggggccttcttcagctactcagccctttgtccagacagccaggcttaggaacactaaaggcatattgtcctctaatttttttctaacttttattaggtatttatcccctatacccttccccctgctcccctctaatttttatattgacggtgatatgctatgtctattatccagtggtgtttatagttatgatacttcctgagaaaaataatttaaaaatagactaaaatgaaataaatataattcttagagaattctgtagttttctagaaacagttatgcggttcaacgaatatcaaggttttaagatttaactttatttatgtgtgcatgtgtatgtctcagtatttgcctatactacatgtatgtaggtgcccacaaggccagaagaccatgtcagatccctgaagctatagacagctgtgacctctctgatgtcggtgctaggagctggactcaggtcttctggaagaacagcaagctgtcttaaccactgaaccatccttccagccattaattagcgtttcaatcatagcagaagccaggttaggtagtttatcagaacagggtgctatatccagagaaccatcttgtaagccagcatgtctttctgaagcactatggagctccatagctgaagtccacagggccttgctgtttattccctttgcattgttaactgtggagaactttgctttggggttggatgttttcctgcttagtatttaacccgagttttaattatgacagtaccagacattgtcagattagcactttcccttttttttctgcctaagacatggagttggtcattaactaaagagaattaattagctgtgttgtatggcgggctgaaacatttcctggattgattgtaagggttcttgactcccatgggctgtgtaattcagtttgccgagttctctttgttgctggtggtgtgggtgttcctggccctgcgagcagaggctggcagccttaggtgcctgctcagctcttcccgctgccatacagatgcctcagctcccagtctggggtcttctgtgagggctgtgatgagcacagatgtttggtatccacaagtttttctctctctatttcattcgtgttcacaaggttctttgagtactgatgaatgtacatcaaatgggatacttctgtcggcaaaatgctacctgcccattcttgagaagagggctgcaggctggctccacagtgcattttctacatctgtgcatgtctcattccctgaggagcttggaggggtgggaccagtggtgtttcaccgaaggaatgccaggcatactgctcaaataactagtcaggacctagatctgctataccatacttggaacagaaaatccagagtggcctttggtctggggcagcagcaaactgtgagaggtatttaacaggtgcgccacagacttgcatctgcttcctaacaggtgactctgctggtgttagagaggagccaggtggaggtaaggtgtaatgggggagtggagctgtacctgattcttggctgttgccctaactagatctctcagaaaaaaaagaattaagtcagactcttattgtatttgaataaatttgatattttaacaccctcgatattataaagttttataaagccagcatgtcaagaaaatgtaaagccaccagttaccttgtggttttgtggtcagtatttgtggacactgccttgcgataaagtggaacagtcctcaggtgggtgagcttgccctgaacagcttccactgtcgatcctgaaggcttctttctgtcttctctagtttgtgttctcaagtgctcaaggggtttatttgatgaataggtttattattgcctgtgctgcagacataagactctaaaccctatcaaaccgcattcttcttctctctgtgatagggtgcttgcataagctggtgtataaagcagtcctaaggagctgagttaaatggaacatgctacgttgctgaaggagcccagggataaaatgtgcgagatgcgcaactttcatagagcagctggaatggtagcgtagttggtaaaatgcttgccatacttacccgatgttagttcaagagagtgctgggattattagaatgttacacatacttacccatgatttatataacgcgcgcgcacgcacacgcacactcacacacacacacacacacacacacactctacacctttcaaaaacagcaaccatgttaagcgtttagcaggcttaactcgtgccttctctgttgatgggattcctgtgttgatgggattccttcggccagccatccgcctggttgagaccgttaagcaacactgaagacctacctagggcacagagctaacctgccacatcttgactgctgagtggatttgcttcccttcagcctgggtgggtatgatttgcatctttgctaacagacaagtgtctgcatgaggctcactggcagaggctcattaaaaagcagtgtgaatcctgaccttgcctctggcaacaggtacgggcttgtggaacccttgtaagtggattggattccagtatctgttgagcttcttcactgtactactgacatgaaagtgtggctctagaatattcaggacaaacgacactcgcataacccccaaaggaactgttcaggggtcaaaggacctgaaagatgaaaaatttcagtatatgtgttgttgttgttgttttgttttttgttgttgttgtttttttttttattctatcgtatctgttgaaatcatttcatactaagaataagctaaggatataaattagtttctaatttgaacaacttgccctcccctagggttttctagcagggtgcagggacacagggcctgcctattgagaaggttttacactcgctgtttctttaggaagtttgtcctcggtaatttccctgaactggctttgttgtgcaggagctgctcagtgaaagctgaagccttttgggaaaacagtatttgcaaggggccaggctgcccggtataatagccgatccctctggcgcgtggcccagagtaagccgaggttgaagcttttagtgtggtttaaagatgctggcctgtcattggcctccactgtaattgggcgagtggtttcggactgggccagcgttctgcttctcctgggagcagctgctaggaggctacagagtccctgtgagctagggactcatcatctggtatgtttaatgcaatctggttttatcttgggagcagtttctgattaatggtggtaattgccagggaccggcccaggtttttttgtgcaagataagatatagtgctcgggtgattagcatgtgaaggctgggtaggggctctcagaagtgccgtggtactgcaggagacaggtatggaaggagagtgagggagacaagacaagctgtaaggatggggagatccacaaatgtgattggcttaagagccttttaaaatcagttcatgggctggagagaaggtcttgagttcaaatcccagcagccacatggtggctcacaaccatctgtcatgagatctgacaccctcttctggtgtgtctaaagatagctacagtgtacttacatataataataaaattagtttataaatgcttactacatttatttattgtagtgcgtttgtgtgtgttcaccatgcatatggaggatcaatttcagaagtccgtctttctctaccatgtgagacctgggaattgaacttaggttctcaggcttggcagcaagcacctttacctactgagctatctcacaggccctaatttaagagtcttaaaccacctataaagtgtgagcttcccagcaccagtgaaacaaagtatggttagttagatttttgaaaaacacctactcatcctcatcaggtttggtgtgtgtgtgtgtgtgtgtgggtgtgtgtgtgtgtgtgtgtgggtgtgtgtttgcttgcttttcattgaagtcaaccttttccttgagggatgtgtttaagcatgtcaccttttatcactgactatggatggatgggtcatgctttccaaggctgctgccccacccacttctcttaactcaccgtgagttatgcagctctgcctctgttcctcactttcaacaattttgcctgccaggctaagttgctgaaagacagacagaacagaacacgctgccgtgcagtcaccttccttcattttgtcgcctggagtgtgacgtggatggcgtgggctggaggctggagggatgaaagcgtttcctgcagcatgaagggaactggctgggatccgattcacttagctttacagtgagagttttttgctagtgccctgttctcttccatttatttcctagcgaatacgtacgcctccaccttcggtggaatgctagtagtttgagttggattttaatgaaagccatagaggcttgaagtcttgcagaaaaaacaaaaatcagtgaagtgggggtggtgtgtgtgtgtgtgtatgtgtgtgtgggatggggatgggggggtagggcgttccattctagggaggtcctgggacaggtgggaggctggacagctgtgggggcgggaacttagattcagctgtttgccctggcgacacaatctgttttaaatcaagatgaagaagaaagcattaacatcatgatggatcacttggctaaccccaagaatgttaattatgtgtcagagatacatttttaacccttgatacagtggcatttagcaggattttgtggtgggtggattcatcttgttactcaagttcttcctcttcctttttttttaaaaactaaacattggcctgtcacctgtcattcttagccctgagttaggctcacagagagcccaggccatcttctcaggctgtttgctgcagtgagctctgttctagccccgtgtctaaccaaatccatctacctacccatgtaacggtgcagctttgtctaattgcattcccagcctctctcccatccaagtgcttgtgatctcctgttagcaccttgacatccagcccagatgttctgtttgccccctggttcccttcatcccagctatgggcattaaacttcaaacttgcctaacatctgtgtatctctgtgtttcatccagttatggccatgaaattgctcaccctcaaatagtagcttaaaacaacactggagacggaatgtttgtagtctcctcaaatgctctgttgaaaccctaacctctaatgggtgttgctgagaggtgaggctggtgggagataatcaggccattagagggaagccctcatgaatcagttacaagaccttttccaccatgtgatctgaaatgccttatcagctgtcttcttaattaattgtgagctctggcttctggaaccatgagaaataaataggtgttgtccaagtaacctatgatacgttcatgatgggccagagctatgacaatattaatcacttatcttgttctttattctgtgccatgagtggccccagccaggagttctggcttagagcatttctgagttgctgttagaaggtagctggagctgagttgaccccaaaggtttcttagctcataagtctaaaactgagtgtggaggaatgtagcagcctgggctagaactgctgggctccctgcaaactttgtgtcttctgcacctggcctctccttgtgggaagtctttgttgcattgggccaaggctctgaagtgagttttccaggagaaactggaagagcccatttcaccttggatgtcccacagttaaatttcttgcctcctgttcgttcattcagatagtaggactgcgtacagttgaggagtgggaatagagagatccttagttgttgcctcttggtggaaggaatgtgaaagactgtggaaaacctggtggtttgaatatttttttttttaaattggacaaaacacacatggcacaatttattgtctcagtcttcttgggtacagttcagtgatgctaagtacattcaaattactttgtaaccaccaccctcaccagacttggagcacttctcatcatggaaacagtaactctgtgcccatggaatgcttctccatcccttctccccactggctactcaatggtctgtaagtgttgactattcatttgccatgaatttgactctgaatacctcacatgcaagtgcaacatagtatttggctttctttggcttatttcagtgagcacgatacgcccagattcatgttagagcttgtgtaatatctcctttgcttttaaaagagcgtatatgcactgtgattctccagcctctatttgtgaacacacagtttgcctttggccgtttaaacaatgctgccctgatgtgggcacattggaaagcgtgtttgaaatcacagttaccgttaacattgcggcttctcaagtgtttttcctcactgaactggaaatttctgagggtaaggacggtgacttttcatgtggaaatccccaggtcccagcacaagcacagaaagtagttgctgagtgagtaacaagcacatggatggagtaatgttagttaaacctaccggggaggattcactcttacgtgtgacaggatgttgccgatgggattggggagttcccaaaagcagttatattgaacaccgctctgttgtaagatgtttactggatagcaccggggacatggcatttgtcaaacacaacatgaacttataagatgatattttcatgcctccagtgttttaaaaatcatccactgtgtttacacatgtggcttttatacacagtaatgttctatgtagttcaagggataatgatgcagaaccatttgctttttatattggttagcctgctcttaactaaaatggaagcccgtgagtcttgataatctcatatgatggggaaaatgtctaacaccagatttggttttcattagttcgcttttagcccctcacatgtgcaaagctgggtggtggcagcctattctaacagcgtctaatgctgaagtcagccctctgccgttgaccatggacatggggggagtgataataaaacttgggttgaggctaccttgccttgccatttttaaaaaaggaggagatagagttatagagcaaatgaataatcaagcttactttctttttcttgcatgaaccaccctctgtgtgtgtgtttatgtaatcttaaaagcaaaaattcctaaatggctatgatttcctgacttattgcctttataaatgagataaacactaagtagccttttcttttaactgattcttttcttgattgatttaacctcacaataatgtttgagtgttctcaaatgcttcttgcatagacctttagatttggtagttgggattccatcatttgtaaatgtcctgtgtggaaagagaagacaggatagtaatctcatagaccaaaaggagaagagtcaagattcggaataacccagatggccattggagagtgtgcgagtccgtgcagcgtttgatggcgatgtttgggggcttgctcgtctctatggagctgacataagttaagtcatctaacctcttgggagccaaggtgatgccaaagagtgcttttgtttgtgatctttgctcatcgtgaagtttaggtagcataaaagctttttgtttatcagaaggaaaattgaggctcagaaaattagcatgcactccgaagccccacactcgggagaggccttcagggactctgtcatgttttattacgtcacatctcactaatcttcctgtgattttttttttcttttaccatctttccattctcatccccccccccccccgttcagccagcgtgtgcatggatacacacgctgagatcggaaaggacactcggtctgagctcctcctccactgagcctaccagtgctggccgctcctgctggactgtcagccactgaagcaatggcgtgctcccaagggctaaataaagttctctttctaggttttcctttccttggcaggatttgagcccgtgggatatctttgagtcgtctgccattattttttttttataatccatactattaattttttttctctttattacttgtctctattccagcctcaggctcacagtgacatgactttgggtggtgcggggttggggtcaaccactttaaccatgttgctgtgcagctacagagccagttaaacagtagaagcagagtgacaacagctggcttcatagaatttctcctgtacagtatggaaagcatagcttgatttattggttggcctttattttttgagacagggtcttatgcaacccaggctgacctagaaatcagtttgtagtcaaggctgcctttgatcctcctgcctttacttcccaagggttgggtattgtaggtgtataccactatgtctttaatatactaaaatatgagggactacttgatgaaaggaaagaggctacaagaaaaaataggaaggggatggtgggatgttttccaggtgaaagtgattgccatgcaaataatataataataataataataataataataataaataaaaaagttagaaagaacggctataagctggtgttagctacaaaatgtgtagggcagtaagtgcctaaggcacgggctgcacaggctcagctgtgaccctgtagactttggagtcacgtggagggtctgttcagcttcctagtacccatcactaccagaaagagtctaatgtttggtcatgagtgcatgactgtgccatggtggcttcagcactctgctgcccccagccccttatgaccactccaactcaccatggaaatgccctggagcaggacatgggacacaggacacagcgttgctacagctgaagtttataaagcatcccctggactagccatcttgaaagtgtcacaaatcatctttcttttttttttttttaatttttgttctgaatttgacagtgcctgggaaatctctctgaactctaggcacccagccctgtgggcatgcatcttgtgccccgtgtgctgagcaaaaattaaaagaaccacatttataatgctgctaaccaacggcatggttaaggcctctaattggctggccgaagttggcaatgctccactcactggagccccttgtaattaaactttggttctgtttttaggactatcctcagcagagtaggacctagcattcgagctcagtggagtctcagccttggtgaagggcaggctgtactggaactcatggactaaggaaatgatcctgtgcctgtgagtccaagaagaacattgaccaatcagttatatagcaagaggagagctaaggctcctttacagcagggccatctggatccgaggtgcatctttcttattttataagacctgcgaggtaagaagtcaaagtgcttacttgctcctgaagctcagagtttggtaaaagtgctaccacgaggccagttctgatttcccttttagtttcatgttcattgagccactggcctgggaaccggcatggcttatgcgatgggaatgagactccatattgacgctttgcattctgggagaggtgcgtttgactttctccctgctgtgaaatgcagttaggttgatcctaggacaaagcatggatcctaggcagcaaagcatggattgacacagcaacggcagagtggaaagcatttgtcatctctttgtggtgagctcagacttcatagagctctggttttcccaccctgtgcttcttttgcagttctacccttgtccccctcataccttgtacccccactccctagttctgcctgaagggagaatgtcctccccagatctgggactcacatttgtctgaaggccacagggagaatccacgattggcccctccttcctccttcctccctcctccctcctccctcctccctctgaactctatttagacttacaggaaaagatttgtggctttttgcaagctttcaactctgaggtattttggaaaactgtaattttgtttgttccctgctgtatgctgtggcttcttcagatacgagtgtgattattttctgcatcctttccatagcaaacatttctcccttgactccaggctccaaaagtaggctctggaatgcatccgtcccacagaccctgctccttggcagtggctgtctccacagtcaacaagctggctgctctgcttgggctgcctctccaggtgcctcttggtcttgctcgggcacttggcctccacatgctcggcagtcagacgtgcccagtgtgtggcagattccctggaagccatgaattactgctgagttattatgaaacttaatttgatgataatgaggtagttctgggtaatagcactttgggtggattttacccataaatcagtaatttgtgggagaccattagcgagtggcagggattctcatggtggactgttggattactgggtttggatcctagagttttcacacaccccctgcacccctaggaattttatagtttctaaactgctaaaattttagtctgcttggaatttattttggtataagaaaccgattttggatctagctattcttttcaagcatttaaaaaaaatgtgtgttagaatatacatgacattaaatatagcactttaagcatttgtggctatgtgtagtgtatatgtgatggatatgtgcatatgtgagcacatgtgtgtgtagaagttaggggttggcactgttttcctcagccctttattttattttgttttattttattttattttattttgagataggatggctcactgaacctggagttcactgcttactgagactagctggagacctgcctatttctgcatcccctgctctgggatttcaggcatctaccatggtgccagcttccccttgagtattggctattccatttggagtcctcatgctgactatacagcgctttacaggctgagctatctttccatcccccactttacacatttttatttatgtgtagagttcgatggcgttcagtacatttataactttttgacctttaagctgtgccctagaagccaagttattttaacattccatgtcccactttcctttttgtaagtaaggggaaacaccctactaagtttttcttagtggaggttgaccttgaactcaccatcttcccgtctttgctgtgtgagtactgggattgcaggagtgtgccaatgagcctggcaaggttgtctgtaaatgagattgagaattaggaaagcttttttgttcatcaggctgtgcggtgagtgctcagcaatggtgggggctaaaaaggctcacagggacagccagggctgctcagaggaaccctatcttaaaaaaaaaaatcaaccaatcaatcaaaaacaaatgaacaagcaaacaaacaagcaaggctcgcagggacagtcagggctactcagatgttcacatggaagccaaggctactcagaaaaaccctgtcttaaaaaatccaaccaaccaaccaagaaactgaccaacgaaccaagaaaccaaccaaccaaccaaccaatcaaccaacggaccaaacaaggtggcttacactacaaggcaggctacttaagatgcattttgagtcttgtgtctcaagcatgccctgtataacactaacacgcacacgcacacacactcacacacacacacacacacacacacacacacacacacacacacacacacgggaataattactttccattcctttgctgtgaagacagaattctcattgcaaagctcagataattttgcatcatttttgtgtgacttgagcatagtgttaatactgtgatttggatttcaggagagaaggtttttttaaaaacagatttagatgatacaggattcataataaaaagataaagtctcttaatatccatatataaaacaatgcagtggactggaaagggggaggccttctgaatatattttgctcttttcagagtcttaaaggaaatttcttttcttaagatgttgtaatagttatttgttacttagaaggaactcaagatgaagaaatggtatgtgctcaaagtgagaaaaaaggtaaaccatgggcgaacagtaagcattcgcttatatttaaatcttttggaaaatttatgtgtgaacctaatacgtcagttaattatagcactttgaattatagccccgagaagccaagcctcgtgtcaggggggaaatcacgtgagttcgtttgtactttatagtgagcagccttcttgttctttgcttcagcaagagacacccaaattcatttgcaaagaggcgataggaattgttcgaatcaactcttgctagctttaaaattcatgttcttataatactgtattcagtcaccaccacaaacatgcctttcttagccacactgtcttagctaaatgtgaactttgaaaatgggaaaatcaggcacttttttagacagtttactctttgtttcatagtttggggcttttaaaaaaaaaaaaaaaaaacaaaaaaaaaaaaaacaaaacgttgccaaggggaaaatctcatggaaggagcctagcttttacgttggcctggtgttttggtcgacgatcctggtgttttgttgttttgcggaattggtagtaaccttaagtttaattgaacaaactcttacttctaaagcatagatcatacttcttttctaaaagtaagtgaagaatgtctaattaaatttcatcactcagatacatgtgctgggtcagggactcagggtattggggtaacagtgttgtcattattgcattaagggatacctgtgcagagcatgctgaggtagggatcacactgggcctgggggcagaaggtatgcatttcacaatcttgcactttctcttgctttgaacagttgtgacagagaaaggtgtcggcctcatggtgtagaggctgctggtaggctccttccttgtcacatgttcttggggcaccatgacactccttatccttatactgatgtcttcctagcccacattgtgccaatacacttcctgtggatggaccttaagtcccaagtcaagtggaaaaaacaggccctctacttggctacccaatgatgctcttaagtcagtttagtagaaacaagtgtcatggtgacacctctcccaccgtcaccccctaatttaaaaaaaaaatttctcctgtatttcttttagcaagtggtacacctgtgggcaccgtcctgcgcaggctggaagcctgagatacactgcagattagactgatggctaagctctgttaacgctgctgcttcaccgatggctctcttgtctgtcgtttcatccgtttccacattgctccttcccctgattctcctcaaggatgtatatagatgttcccctgtgcatccctgatgaatatcttaggtctcgggggggggggggtagtaatgctttctcagagagctacccgtccttccattctgcaccctggctgtgcctgtgatccaagaaggagtactccgcttgccctggcaggctcccaggtacttgtccagagactcatccacacacaggtccatgtttcttggaaaccttcctcaacctttgtcaaccaagcaggatttttaccatgtttagaaatgtccctctaactctctgtactttctcttttgtttgactgtctgccttctccatcagtctgagtgttactataggttataaattaagtctcactcatgtccgtatatactaacatggcatatgtgtctcataaatgacatctcagtaaatgactgtgtgattgtgggaatgttgcagtggtttttgctggagtgggaaggcacttacaggtttcccctcagtactcatgacctactactgagtagcaaccttccatgatctccagagggagggtttttttttttcccctacttttatctccccatcccccatcatggttgggggttagacccagggctttctttacacatgctcagtaaaggcaagtgtcatatgactgtgttgcactcccagatcccaggatgagcttgctggtgagcaaaagtcctgaggttgaatgtgtccgaccgaaagactgcagtgaattaattgtataacagtttgttcagggggctgggccatcagcacggtttcatgtttaatccgtaaactcatgtgataacccatgttgcattgtactgctgtgatctctgcccaaacactctctgttgactgcttcttacttcactactccccttctagttttgggagcttctctatctcctacactcccagctaactgggtcggcggacctcagaaggaacatctctctgtcctcaccagtcacaagctcggttatccacatctgtgtctgtatccactagctagcctctcatgctgaaggaggaccatcagtggacctggggagggcacaccaccagctacctgctttagaacttaggcctgtcagctcttcagctctgttccttctcttctaaagtgtgtttcccttccctaaggctattcctgtcagcatgcaaacatgctgacgcatttcctccctatccaaagccccttttgctccattttattttggtttacctaaacccactgtgacttctcttctaaaagtttttggttgtggtagaatagctataggctgcactttcaagtttactgtagagtcgggcatggtgacctaatcaggaggcagaggtaggtagatctctgagtttgaggccagcctggtctacaaagtgaggtctgggacagccagaactacatagacagttctctaagaaacaaataaatttttagtgtaaatgtttgcaaggtccaggagtatgaagtgcatcgcattgttgtgtaggcagtgtccaggactctgcatcttgcaaaacagaaacttcttcagttaaacacttgtcccattagacgaggcttcccttctcccacagaccgtttcttcgtcttctgcactgccctgcccctgtgtgactcagggcctagtgctccactctcttctcatgcttccaccaagttccttggtggtttctctagagagagatcttaactgtgccacttaggtccccacagccctccaaatgttgtctcccaagttctcaccttgcatgcttctctgcttcatatctttacctgtgtatgtagtggacgtctaaacaactctccaatgaccttgacctgctccaggtgcctgcccaggttgactcctgagggtggtcactccctgctttcctgcagaactcacagctggctactctttttttctcagagctatgtcagcaaatcttgccagctaggctttcagttgctcacttttcttgttgttaatgttgctatgacaacatttgacaagaagcaacttaaggaaggaaggaagggcttattttggcttacagttagaagggactccgtcccaccatgacagggaaggcgtggtgtaaggagcaggaggcagctggtcatgtgcatctgcctttaggaaggtagaatcaggctataaaacctcaacatctgtcttcaatgacccactccctccagcaaaggtccacccgctgtaagtctcacagccttcccaaacagtgacaccagcctggggtcggcgtgttcaaacacatgaggctatgggaggcatttcacagtcaaagcacaacagaaggcacgagctgagcctgaccactgtgtgttacgtctgtccgttcctctgtccgtctagcacttcagtttaactgcactctttccttgtcctggtttctgcaggctgaatacacttctaatgagagtcctttaaaaaacgagttagatcctggttaaacactccaagggatagtgggtgctggatatttgcagctgttggaatccccaggtcactggacacctcgtgagtgccatgttcttattgtcttacatgggttctctcagccagaacccacacggtcttccccagtgacccttcaatctgccaccctgtccccacgctagggcactcactgacccttcactggaggaaagcatctggctcctaggtgtcctgggacacgtctgctaatctttgtagctcttgatcgtgtgagctcctccctggtcactgggtttgaaaatcccagccctccctgtgcttgtggggcttctggctctctgtccttggttctacctgcggggttggtttgtctggcctccctagaatgtcagttctggaaggctggggtgtggatgacgtcagctgtgcttgccttctgtgtagaactatttctggcatgtggtaagcacactgtcaatatttatcaagtaactcttcagtttttacaaaccagacaaggctattttattgcctatctccctccttcttaaacttcacttgaaattttaaagtcttatttcatccaaatggttaccaagatgatttttgaatttcaccaaacagtgtatatatgaaaatgccctaatgaaattcattattttgtatgctatctaaaaaaattcctaagatgatttgttttctaagaacatatatatgaaattttaattttaatttttatggtgctgagcctttccccctccccccaagatagggtttctttgtgtagccttggatgttgtggaactttctgtagaccaatctggccttgaacttagagatccatctgcctttgcctcctgagtgctgggattaaaggtgtgtgcccccactgcctggctaatgctgaacatttttatactatgtcattaatgatacatttttttacttttatgtacacaggaaattgctatagattttcaaatagtcttacataaaatttttcttttctgaaggatattacacttaagtatgttatagtagttttaaatcttttctatctgcatgggagtaccactggtaatatctttgaggggtttggtggcaataattttttccccccttcgtctttttaaggagcagattgaaatgggcgcagtggtcacttcttgacgttttgcttgttagagattcttcttactgatgggattgatcccatgtgggatcaattctgaggctcctgtgatttccacttcaagatgctgttgctagcgtcactgtttctcgtgtttgacatgagccattacttgagtttcttgactccctagttaacctgaaattctctccacatcaaaggaaaaggttcatgtccctgtcttggaaccatttaaagtggtgctgacaccttctgttccaaattcattgatctcttaagagggggaataattttatctttgatggggaaaggcctgatgtatgtgctctcctccctggcaccgttcacattgctcccccccccccatcccccacagaactgctggagcctcctcacactcctccttgcgttcagagaatccggtctcctcgcctctcctcacccactgagcagctgccccaagttatgctgcacctaccaggcaatcccaggctcctctgcatctggagaaagctcactcctacagcaacctgtgcccctgtgtgcccctgtgtgcacctgttcgcaccccactgagctgtgtacacctttccacgctgagattgtcctcttgggagccatgacctcccagggtcagctgtagccagttgagctcgggctgttgctatctgttccctttgaatcatttcactccccagaagtatctgctgcgagccagtctggcacatggctagcagcatgaggagccagccgagggataggtagactgagcaatggatggcgggacagaaaactgttgtgcgatttagtggacagagaagccatcaaaatgatttttaagattttttttccccccactcattatagagaagcataattagtttggccagccaccacagcatgtacctgtgatcccagcactttgaaagctaaggcaggaaatccataagttcaaagccagcttagactaaataataagacgttgtctcaaacaccctctcctcaaataaaacacatatacccatatgtatatatatatatatatatatatatatatatatatatatgcatagttaattttaaaaagtataattagtttgctggtatctcatatgaaatatgcttgccagtttaatcttaagctacttgtaactcagaccttatttcttactatctaatggaataagacagggcaacgtgtttgtctctatcctccctagagccctttgctccctgtgggcaccactctgagggcttactctgaatgtccctgtccaaccctttcaagaattctggagcagctcctattcttgtcttcatgttacaggtaaagaaacagaggcataggcagatctgtcctttccaagtcttctgagccaagtggtagggacagggcttgaagttacttacactgggtggcccaagaacctgctctccaaccgtgtttgacattgcattcattcagcaacattcacagagctctagctgtgtgtctcagggcctcactgccgtagaacttatgaagttaaatacgcaaacaccatacacaactaaatagctatctgtgtgctaagggaaaaaagaaactatgggacagaaaatggttgtgatagataaagctttgagagcttatcagtgagagacctacttcttggtggatctcagagatatgtgcctgagagctggactctctccaggcttttaggaatttgcttgctatttctgcctgtttgctcctcgaagtctctggtggtaaaatcttcagagtcaggactcaacattgcctggagccttgttcccttattctaatgcccctcctgtggtgagtgttgaatcatggggctggactcttatgtgtgtggagagtgataggaagtagatttcccagctagaaggctttgtggggcagcgaggaagttcagatggagagatagaggagacctggcctaactaattggagaagggtggtgaccctaggccacccccaccacccaacatgtcctcaggagaagccacaatatcaaagtggaaagagctttccagagcatttggaggtacaaggtcttaggcgcaagtgagccagggctttgcacttccctgtgacgggcacacatctcacccagttgacaggacctcatggctggtactgacacagtagttcctaactatcttgtctcagtcactgttcatccaaaaatcacagtcagctgtgatccaaaaataacataagccttccccctcaatagagagaccaaagccacacagcttttatcacagtttgttatggaagctgttctacttctctctctctctctctctctctctctctctctctctctctctctctctctccccttattggtattctcttgctttgcctagtttgtaaattccactttatcatgggcacacatatagaataaaaggataggtgggctcagtactatctgggctctttaggtatctcctgggagtctgaggctgcaaccctcttgggttaggaaggggatgctggcttctgaagttaattacatggtagtatgtttatggtcttgcttggttttcctgaaccggctcatgatagtgatttccaagagtgggacttttcttctgaccaccaggatatggtccacaaggtccccagctgtcctggcccatcagagcttgtacatggaggatgctagtggctgcagatttcggatgttattgctggcacacaagggattcaacccgttcctcgtgaactaccactttccgttttttatacaaaaacagcgtccctccgctcaatcttgctgactgcacactgggttccacatactgttttccttctctaccctgcttatttttactcttttggccactttattttagggatttgcaatgcttgctttggcagcgtgatcctcattgttttatttctggctgcttggctttcgtgtgaatacttcaattaagtagcggatgtgggcagaccgtgtcttaggggtgccggtttgctgccccgagtgtgtttgtgttggtgtgtacttgactcttcactgcagagcaagaccccagggtgggattccagcaagggcagttgcccgcctgggctgggtggagaacaaaggcacccaggagacgtcccttcatttggaaaatgtgttaaagacctgatcagaggtcacgtagctttcacaaggctgtggagtgtctactgaccaggctcaaaaatgggccagttaatgttttttctttttacaagatttactcagatggacagtcaatctttccgagagctcggcttctgaggctgagccgagaaagggctctcaggaagctttggtggctgttcacacagctgggaattagttctgctttttactagtctgaaccttactgggaattacagaggcatctgccttggctcgttattgttaaggagggaaagaagagggggctgtgaagatgggtcactcagaagtacttgctgtgcaagtgtgagttcaatcccagcacctactttaaaaataaggtgtgtagggggtgggcagagacaagaggctccctggggcttcctggccagctccaaataagcccagaatagagaccaggggaggagggggagtctttccaaaaaataagtaggtggacagcaagggaggaagacacctggtgtggagcgcacatgtcaacaaaggaaggagaaaatctagttttccatgtccgtggctctttcaaaatatgtacaacttcattcctggttagatttttgttgcccggtttgtattggaaacttgctgagaagacaatgggagtaaggctcagatccagcgagggctgactccaacttgggcagtattttcagccccacctttggatcctgctatgggactctctgtgtgtccaaaccaacatcctctccagattagccctgtctctgggcacacactttcccaaagttatattttaagtacttactatgcctaagagatacataaaacaaaaatacctctaacctgtaagccacttgccctaagacagatacaccctgaaatgctgagggctatttatataagaagtgtttgccccccaaagcagcttgacccaacctcaccagatgtccctgatcacatgtaggtgggaggtacagaggcaggacatatgtcaggatatatgcttgcccctgattggatgtggtgggaaatacctggctttatgggtttgcttttataagcctttgtaaaatgtgactcgtggccattttctgggaaccccggaatagacctggccagagtccatcatcctggccagtatttaattaatgcttgtttcaaaattggctcaaaattgtagtagtggctttgttctccatggtgggaccgggcaggggtgctcattgcccttcccccatccctgtagactgtcggggcatcatatggataccacaagaatccccatggctccagtcgtgatccccaggcttctgaagtgactctaacatgccaacaggctgagaggttctagggaggtttttacttagggaaacagccctaaatggagtcactgatatccgctctgtatttatagaagcccaagaactgtaaataaccaaaaaacaaacacaaatcacccctccaagttcacggtcccttgcaaagcctgtttatctctgcatggctcaggtcttcctgagtctttcaccaaagtgtaccgtttgcttttagattttgtcattggagattaacaagtgaattgccctcttagcctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcttagtgttcacaaggcccagggtttgaggtctgagggtcattgagctctgcacaaacctctaaaccagatataccaatccctgccttgaacctggcagggggatcagaagctcaagaccacctactactgtgtagagagtttaaggtcaacttgggctacatgaaactctgtctcaaaccaaacacagccataatagtttcagatgggtacgataaggcaggccctgtggttgaaaggttaacagtggcagctgaggcaagagggttgtgagttctaagccaccctaaacctgcataggaagatcctgtctccaaaaggaaaaacaacaacaaaaccccgaaaccaagcaagcaaacaaacaaacaaacaaaaagagccgaatagcaagatattagacccaatttaaaatgagcaagaattaaggcttttcccttcagcggttaggactaacgccatctttggagaagctttgtggatgaatcctctcagaagtagtaatgggaggaagccgctgaccgttcgctcctccacactgggagaccatggaggagataggaggcgaggacagcaaacagcctgcactgtaaacactgtagtcgggagactacacggccaggttttctctctgtgaacttcatgggattttctgagctgaactcgcccggaaacagcgtgttttctgggtagatttcctgctttgtggcacaggaaaatctgcgtgtcttctgcagagaattgttctttctgtgatggccctaagatttcaggaaaggaaatttgcttcacacccctcttccctacatttgctgctcaggaattgacagtcgcttcagtctttgactaaagcacaaatccattgtgtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaagtctttgcaggcacagcaggggtctacagtgagaagccagtcccgtccatctgaccagagagccattgtctagaaagtgcagcgttcaccagtttcttaactctccagaaatagttacaactaagtaactgtgttgaacaccctctacaactcacaaatgctgcatgctgttctatacatggccatttaccagcatgggcagcttatcttagagatggtgccctgtcagccacagagagtccttgtgttcatgctaatgagtgatgtttcagtattccagtattcatagggaatgcaattgttgttacagccatgtttatggtttaatttaatattagcattatttatgatatttattaatggagtgtgaatatttaatcagccctccactgacatttaaattactttctaacttgtatgatttcagactctgctgaaaagtatatcacgcgtatttgtggctgtgaatatactacccatatttgtggctgtaaaaagattgagtcaaagtgtacattcatgtacatatgtcaggaatctagtctgttttggtatatgtacacgtataatacgtactgaaaataactatagtcagacaaattatgtattgtctcacatagttgacctttgtataggaagtacctaaaatctcttagcacatctccagtgtatataatattcttttaaaagggagaatattagaaagcagcctagtgaacttgaggggaagtcaagggaacaaatgaccaagatggtcatggaccaaagccacacacacagtgaaagaaagtgtataacaaaggtggaattccaaaccgagaagaaagcatgaggtccgcaagtcatctgaggaaccaggcatcctcgcatacagaagccgcccatccatgtagagagactctcttgtaagcgtcacctgtctgtaagcgatgctgatggccaatgagctgaggcagaagttaggaggtggggcacgggcaggaagagagaggattctgggaaatagtgagtggagactcgacagggattgctgagaggatgtgaaccagcaggtagctgaactcaggagagaaggaagaggagattcgccccagacttggagacatgaagctgaggagaggggcctaaccatgtggaggacagaatagtttgaatggactaaatgagttaggagctagtcaggaatgacgttgtggtaaatctccaacccaaatatgccctggcaatgaaaacacaactcaattaatatgaatacatgctgtgcgcctagattgggtagatctgccactacactaccatcttccacatataagaggccccttagaacttgtggtttctccaggccaggtgcttctgctccactttccttctttctcctcctccattgccccccggccccttctctcccaaaaccttcagctccaccttcccctctttctccacccaatcatcgactctagcctttataaattaaggtgggaagcaggtttacaggaagtcacctgagtgcggactcattccttgttcgcagcccctcacaggagaacagaattaacatcaaatacaattagccccagggctgtctgcaacaggatgagccaaagattgtgtccaaggcatttattaataaataattagtctcagagtcggcattctctagaagggctgggaaggaaaaagggatttattttttacacatccaccttacaccgtccattcctgtagcacctttatccgtgcattattattggtgtgtgtgtgtgtgtgtgtgtgtgtgtgtgcgcgtgtgtgtgtgcatgtgcgtgtgtgtgtgtgtgcatgtgtatgtgtgtgtgtgcatgtgtgtgtgtgtgtgtgtgtgtgcatgtgtatgtgtgtgtgtgcatgtgtgtgtgtgtgtgtgtgtgtgcatgtgtatgtgtgtgtgtgcatgtgtgcgtgcatatgtgtgtgtgtgtgtgtgcatgtgtatgtgtgtatgtgcgtgtgtgtgtgtgtgtgtgcttatgtgtgtgtgtgtgtgtgtgtgtgcatgtgtatgtgtgtgtgtgcatgtgtgtgtgtgtgtgtgcatgtgtatgtgtgtgtgtgcatatgtgtgtgtatgtgtgtgtgtgtgtgtgtgtgtgtgcatgtgggagcaggttatgcgcagctcacagcatgcatgtgaaagcgggaagacaactttgtggagttggttcttaccttctaccccaacgtgggtttgagagatggattctaggttgttgggccttcactaagggtcacttttgcttgctgagccatctttctgagccttcttcttctttaaaaaaaaaattgtatgtatgcaagtgtgtgtgcccttatgctgtgactcaagtttggtagtcagaagagagcttgcaggagtccactctctccttccactacgtgagtctcatagaatgaactcagctatcaggcgttgtttactaagccatcatggtgctcccaatagtcttttgttaaagaattatttttattttatgcctattgtttttgtctgcttatgtgtctgtgaactaagtgtgagcctggtgcctttgatgtcagaagagggtgccagatcccttggaactggagttatagatggttgggatctccatgtggatgctgggaactgaacccaggtcctctgcaagagcaaaaagtctcttaaccactgagctatctctccagcccctcttttattttttttaaacaaatttattttacttttatttttagcatttattatttagaaggcgagtgccatggcatgcgtgtggatgacatttactgtcatcggttctctgcatcaactatgtgcattccaggcattgaactcaggctgtcagccttgatgggcagtgcctttacccgctggcccatctgactagccctgctagtcctaatatggactggagccccaagctgtaaaacccttcccagatttactcattttaaatagctgcaacctcctgttgtttgatctctgcctcagtttctccttaccctcagttctattatgatggattctgctaaaatgtcaccagttaacagccttttgctgaccagtcttcatcatagtagtgtctctatcagactgtttgattcttgctagtgtgaaaggtaaacaatgctattcatgtaattacaatttatgttactttaattgaaacaatgttgcattgctttatgcacaggagcccttggcatgctcttctgtgtgttctatctctccatatttttggtggtggggctgcagactgaacccaggacttcacatgtcacgggactttccccaagccacatcaccagccctagtcttactaagagtagcatctccttatctttgtataggaagagtctgttggtttgtgaatggaatggctgctgtccctcattccctctcatgggttttctgatgggggagttatttacctgttttgtcttaagtattgtgctcatggaccaaatttatcttcttccttcaagctgtctgggaagtcttaagttcatgagcataaagttcccagtttatcctccaggtaactgtctggccttcactcttcacagttgtggcatgtgtttccttcctgtatttggcatcatgtctatttttcctatcacatcattttgtttgtatgtgtgtgtgtgtggggggggtcctgtgtgttcgaatcactccacaggcctctgtgcacttggctgtggagtctatttttactggtagttgttcagcagacactttggctcttaacagacacagttgttttgtcttggtcttgtatatcataagttttctggtgaataaaacattttttaaaatgtggattttatatttgttgaagataaaaagacatatttcatctccattagaagtggactctagttggaaagtcagtgcatataatgaatgagtgatagttatggtatttgtatatgtgaaaagagttacattcttgcctaagataattttcaaaataggtgaaaagttccttgtatgtatgtagccagatttataaatcagagacccaaagtctcaccagcatctttgtttcccttatgcgtgtgcttctgaatctgcccaagaaatagaaaccacaatagaggcacaaagacagcgatgctgataaagtttagatcatagcattaaagcagggacaaggcgtcgaggatgctggtgatgtgcccacagcatcagggatactggtgatgtgcccacagcatcagggatactggtgatgtgcagatagcatcaaggatgctggtgatgtgcccacagcatcagggatgctggtgatgtgcccacagcatcagggatgctggtgatatgcagacagcatcaaggatgctggtgatgtgcccacagcatcagggatactggtgatgtgcccacagcatcagggatgctggtgatatgcagacagcatcaaggatgctggtgatgtgcccacagcatcagggatgctggtgatgtgcagacagcatggaggatcctggtgatgtactgacagagtgttctttcctttttttcccatagatctatctaaaaacagactggtggaagtgccaatggagctgtgccaatttgtatcactggaaattcttaacctgtatcacaactgtatcagagtcattcctgaggccattgttaatttgcagatgttgacccacctaaacttgaggtaggtttcacgtggaaactttgcgatcgccttcattcagtgaccaacacagaaccatcctgcgttcctgtctaccttcctttcgattcttgatcacactggcaagtaaaccatagagctcattaagaatgacctttgtcctagatttacagggtctttagtgttactctttgttgctcaggtgctgggcttccccggatgtcagcagggcagggtcctgaaagggaacgacttatgtagcatcactgtgccctgtttgatggcgtgtgtaaggatgctagtgtgctatcttcaagaattcatgcagcttttgaaggaagaggggaggtgaaactgaaaaagaatgatagttaaggtgtttcaagaggaagggggaaaacccattctttgtaagttcagtctctttaaaaaagtgacacaatcctttgatcccagcacttgggaggcagaggcaggtggatctctgaggttgagaccagcctggtctacagagtgagttcaggacagccagggtgagagttgggggtagggggtcagggattgagtgccctaggtaattttaattcaattgaattaagccagggtttgctgagcatgcctccctcagtctacattggcttccctcagtctacattgtatagcatcgtgtaacactttaatgctgcagactagctctagggtttcaaggacactaattgttttaaaccttgggtttagactttgcagctagctggctgctctggtcaggccctgcctctttcaggagaggggatacagttgttctgctccctgtacctgaatggaaacaacttcccaggttccagcccaagtccttcctcgagctgccagcattttggtgtgtaaggggtagagcctagtcagagaagaggcttgtgccgcataacaaacacactcaattttaaagctcaaaattcccagcaagccagacacagtggctctttataacagataatgacaccagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaattcacacgtgaaaacatctttaccatgaactgcagttagaaacatgaaagtgtttcccgaatttctcacacgatggaaatgtaacatttgtggtaaacattgatgtgttgctgtttatgtagcccgtgtttgaatcgtcgaggcttttcatctttgctttttggtgttcacaaccaaaggttatgttagtttagtgtatgtgccccctgtgtcttcctgtttgaaaatgtctttgtccaagaaacgtggccaagaacaataaaactgattcagcaagcctgctgctctatagcaacaggcacttagagctgacaccacacaggcaagcctgaaaatctattttaaacggctggaaaggtgtcagagtaccagaagaagctcaaacagcccagaagagcacaggacctggcagcagttggtgttgtgaatcttagaacgcagactttggcatagcaggctcatttcagagaagggaggtgtgaaagactcaacttctttatagcatttaatcagactgcttccaggatgaagggcgtgggtttccgattctcagaggaaacgcgaccagctgggcctggattgctcctcagaaacccgtgctccctcagcttagctggaattggtttggagctattgccagtgtagaggtttgtctggtccacaagatgttattacactggaaaaggaatgtattttggctgccatctctgctgcccggtatcccttttggctgctaaacaatgtgcaaaaagagccaacttcctgatagtcacagaacccgtatccccacattcctctgaggctccttctctgaaagaatctttaatcccctggacactcactctcttactgagggaccctgggccagggcagctttagaaagcacagttgtttcatttttgttgttgttgttgtgaaacaaaaattaatgtccatcattctcttgccttgtgccattgtgtgtgtcatttctaaagaagccaatgtgtctcttctctctagaaaattggaaagttgatactgtttctctgagcttgaagttttgtttcacttactacaaatccacatctcctttttatgaagctctaatcaaaaggaaagtgagagcatctttgtgcacacatgtatgtgtgcttgtgtatctgtgtgtgtatttttgtgtgtgcttgcgtatctgtgtgtgtatgtatgtgcgtgtgtggacatgtacacatgtatgtgcgtatatgatggttatgttgtatcttacgaaatctcagatacatagaaacaccaaaacacagtgaaccagattggcgttcaataatattaatcttaaaaaaaatttgaaaacactttccatggaacagtagacgtgaaagaggccactgggacatgcaggctacatagcacagctgtctacatatgtcctaagcctttctagggttcccaggcatttgctcatatggttgaacatataggcagcggaccctaaacttttgggtgtgtttattaaattgtgtgtaaagtgtgtgtaactgtatgtctctttgttttgtgctggcaggctaccaaacacaagtaaattaataatgggatatttcttatcaaatgccattccttttagcgtagcccgtccttggcaaggcttccgtggagggtttttccacggtgcacacctgatcccagatgttctagctcactgtttgcattgggagaaagcaagctgcaacacaaaggcgacattatgctcccagcagaagcaaggctgagttcgctggctttgtttcctgctctgtttctgatcttcacagggatgtgaagatctttgtgccccgagtagctctctggaagtgaggggtgcttatttgctattcactgcagacatttctcttcacgtatggcaattctcaatgtttttttctgaggtcccacatgagcaagctcaaaattgcgatcatttttctaactagacctgtaaaagccctgtgaaacattgccactacatcaataatcaactaattacatttcctgtaaaactcctgcagttaatacgctatcttataaatagtgatatgaatgagaggagggattggagaaaaagaacatacatgcatgtacacataaatgtatatatgtgcatatcatatatgtgtttacatatattatatatgtatataatgatgtattttataaaaaaaagcagaggaagccagggatatgtttgataagagtgaggtttggtgagatggatggcggtacctgtgcaggtccatgctgaggcatcccttcccggtgaggtaccagccacacacacaatgagggtgggtagggcatggggagggggagtagagacagagaaagggcagtgggggagagagagagagagagagagagagagagagagagagagagagagagagagaaagagagagagagtgctccacccccccaccacccccagcccaagaacatgcatgggatgtgggtggttagaggcaggccatgaacacatggagagagagactggaggggatggggagagaagcaatagagagtgaagagggtaagagagggtaagaagtgaggaaggggcatacagcccttttatagtgagtcaagtgtaccggctattgccaggtaannnnnnnnnnnnnnnnnnnnatttaaaagttactcatttctcctccttctgcaacaccttttttgtttgtagctggtgttttattgagactttcgttgctgggattaaataactgagcaagacatcctgaggatggaaagctttgtttcagcccaggttcacatgggatccagctcaagggcaggtcccaaggcctgacactattactaaggctatggaacgctcacaaatgggacctagcatgaccgtactccgaaagacccaacaagcagctgaaagagtcagatgcagatatttgcacccaaccaatggacagaagctgctgacccctgttgttgaattagggaaaggctgaaagaagctgaggagaagggtgatcctgtaggaggaccagcagtctcaattaatctggacccccaagatctctcaaacactggaccactaaagagacagcatgcaccagctgatatgaggcccccaacacacatacagtagaggactgctgggtctgtgttcattcagaaatgatgcacctaaccctcaaaagactggaggccccagggagtttagaggtcaggttgggtggatggtgggaacatccatgtggagacagaggtgtggggaggaggtatgggatatggaacagtctcagagagtggatgggagatggggggaggggaataaaatatggtgtgtaagaaaatacattaatgaagaagaagaagaagaagaagaagaagaagaagaagaagaagaagaagaagaagaagaagaagaagaagaaagcagctcatgtggacccttgtcctgtgggagtgggagagcagggttgctctccttctagccgcctggaagcagctggagaggatgcctgtgctaatgggcttcttcctcctgccttgtttcctcttgggtccttagcctatgggctggcgtcgcctacattcttggcactagttcagaattctatcatgatgtggatgagttgcacagcagtgagctcattgaacagggctatagatggagaaaatatttcccagaggttacagattctttcacgtctagatcaagtattgtaaggagtgtgagggtcccgttggctgcaggtggcgaagcagaaccacagaatgacctgtgtgctttgagagttcacttgcttttagttagtaagttgaatgagagccctacagggagttcaggcaactacttaggagcactctccacttgtagatgatgtcttccatgaggccactgtgtcctttagccagaatgtaccctggaaaatagcttaacttccctgtggtgaccattgagtgtttggttacagtgatcttagatagaatccatagcactagccaggaatcctttatcgttgtctaaaggaagtttctcttctttattccttggaagtcaccaaacttttatacttagctctccagaaatcccataggaaggctctatagcttatatactgcagaaaaatactatcacaggtagtatataattggttgtagttcagagtgatgttgcctggtcctgacagggaggaagcagaactgtttatataccttttgtggggcaatgggctatgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctatctgatttaggataggtaaagatcctttcccaatctgttggtggcctttttgtcttattgacggtgtcttttgccttacagaagctttgcaattttatgaggtcccatttgtggattcttgatcttacagcacaagccattgatgttctattcaggaatttttcccctgtgcccatatctttgaggcttttccccactttctcctctataagtttcagtgtctctggttttatgtggagttccttaatccacttagatttgaccttagtacaaggaggtaggaatggatcaattcgcattcttctgcatgataaccgccagttgtgccagcaccatttgttgaaaatgctgtcttttttccactggatggttttagctcccttgccaaagatcaagtggctttgccccttcttggaattgggaacaaagcacccatggaaggagctacagagacagagtttggagctgagacgaaaggatggaccatctagaggatgccatacccggggatccatcccataatcagcctctaaacgctgacaccatttcatacactagcaagattttctgaaaggacccagatatagctgtctcttgtgaggctatgccggggcctagcaaacacagaagtagatgctcacagtcagcttttggatgggtcacagggcccccaatggaggagctggaggaagtaaccagggagctggggggatctgcaaccctataggtggaacaataatatgaactaaccagtactcccccagagctcgtgtctctaggtgcatatgtatcagaagatggcctggtcagccatcaatggaagaagaggcccattagtcgtgtagaccttctatgcctcagtacaggggaatgccagggccaaaaggtgggagtgggtgggtgggggagtgggtgtgggagggtgtgggggacttttggtatagcattggaaatgtaaatgaaataaatacctaattaaaaaaaaaagacaggctagagtacagatacatgtcaacaacagcacatgtttcaggacttaagactaatatacattccgttagtgagcactaaatctttatcacccagagaaatattttcacataagaaaattaggtatgcggattgtagtgtagatatcctgcactttatgtttaatatctacttataagtgagtacataccatacatgtccttttcggtctgtgttacctcactcaggatattctctagttccatccatctgcctacaaagttcatgatgtccttgtttttaataggtgagtagtattccattgtgtaaatgaactacattttctttatctgttctcagttgatggacatctgggttgtttccagtttctggctattatgcataaaactgctatgaacaaaaaaaaaaaaaaaaaaaaaaaagaactagccatgagggctgcccagtcagagtaggtgtgtctcagcaggagcacggcaagtcctatcctcggggttagtgataggggaagtagatactgaaagccatagagggttgatatctacccatgtgactaaggcttgttataaatataaaagtttgtgtgtcttttatcagagaactgaatgatccaaggtgcaaggtggggtagaaacccccaaattaatattaagtctttaccacaacaagaaagggcaaggtgctagtgtgtgagaatccatcctgtgtatttggcaggaaacaaaaaaagccagagatgtttttgagccctgttacttggtttatgatgaggagttactgaaaaagtgacatcagaggaccaggtaggagccaggccttcgtccctctcctctctccctgtcctgtttacccaggcagggcagggacagtggcaggaggaggcacacaggctctcctgcagcgaggacagggaatcctggggcaccacatttgaacctgcgattctttatcagctcaagaagcccttttcactgcaaatcaactcctttgtaatcaaggaaaattagctttttagacaggtgtcattggttagatttaagattgaactttggcctttaccttatcaggtactgtgtgaccttatccgtaaacattgttttcataaaggatccgtttttttttagccagtaggcttgaaggagagaagcggaggcttgggacccctggacttgcctgagagaaataagtgtcagatgaatggcttcaggaagctaagactgctgacataggcagtggacatggagctaaagggacacagttgcccctcccctttatgaatgttccccttggggaccttgggtctttgttacccatgtgtggttcctttgactctcatgaaaactgcaaataatccaaaaatacctcgtgacaaagtatatgagacagatgctgagggaacagatgtggctaagaggaaacatgcccctgctcgtgcatgctaattaactagattgttaactccatggacttggggtgggctaagcagcttttggttataaaactcattcgacccaccagagaggccttggatggttttataagcttagatttttctaaagtgtgtgtgtgtgtgtgtgtgtgtgtgtgtgtgtgtgtgtgtgtgtgcctgcctgcctgcctgcctgcctgcctgcctgtctgtctgtctgtctgtgagaatgtctttttaggttaaagaaagtgtggtcctgaagttagagttaaaggtgcttgggagccccccagcatgggtgctgggagtcgaactcagtcctctggaaggacagcaggcactttaaactacttaaccacctctccggggtccagaagcttagactgctcagtttgaagccagcactggccctcaaacacctccagggagagtgaaccagcacagcagagccttctcagagttgtttttggctgctgtgataatgactcagtcagtcttgtcactggcctggttaggtgcttgcattgattgggtggcaagacctggacagaagtataggaatggtttcagcatgggtttgagagtagaaatttctggaaatatccatccctaccaccccccaatcctcttttcagcaggaagttgagatatgcctttgttctaagagaatttccttgttagcattctttttggccagttttcaccttgtgaaaaagatctctataaactactctgctttgggagtcaggtctcagtctatccctggcttccttctcccttggcttcctaagtgctgggtcacaggtgtctacccccgtgcccggcttacatgcttataaatatttcataatcacaaattaccttgtgaattatgtacttgccacctttgaataactaactgagctgtcttcctagaggtggctgtagagctctcctcagagcttgagaaaagccagcagaataccaaggggaccgttatccaaccagtttcttaaacaggtcctataggtgggagagcactacgggaggacagagggacaggctgggcccactccatcctccactgtcccaagagactgggcagtgtcacagtctttgattttaaccttggaaggtagctaccttgtcccccagagccaggcccctgggaggttccccacttaactctctcctgggcctttatgggaaagctttctgtccagttgtagagagagctttcctgcagacctgggccgtgggagaaattgctgatgtgctgtttcttgcactgatagagctagctgggcgtcaagtacctggagtaggggtgatattgagttcttgctcagcacagcacctgctttttctgagcccataggttagcattgcctttcagtggaccagatcccagccccttactatgtgcagggaggtggggtctctggtatagcatatgcaccacagtgcatgagtaccacatatcagagagttggcctagatagcaacacccatgagagaaacatctactccagtttaccttgttccatgacgcttcttttcttactagagaaacacttgtaaggatttcggaaaatatagcaatgtatgcaaaggaaaataaaaaagccacttattggatacccccaaaggactaccaatgatatattgatatgttagaaatgtgtctctcttagtgactttacagatgtttttagatgtgattgtacgtgcacagagggtgtgacattgaatgcgtgtgtgcacaaacacagggaaagtttttaatagttccaatcccatgccgttggcttcatctatacgataatggggaaagaaagtcagagaactgtacccttctgtctctgtggtagtatgacaaagggctctgtgtcggggaggaggctgaaatgaatggctgacatgaacatgtggagagtcaatcacgtttcataaattgactctctttctctgtcttagaaaactaaacgtggacaatgggaaatttggagactcgatgtggtctagctctgcatgcagagtggaacaaagcctccatcagacttggctggctgctctgggaagctgaagccctctgggttccgggcatcctttggtagaaggctatgtttcttttttttcttttcctcagctcatttgcaggtactcagacagactttaggtgtagcagctcttgtaatagtgtggagctgagtgaaccccacttatttgtgcattgctgtaattttcctctctctgctaacaatggctctcctttgaaaaaccacacctacgnnnnnnnnnnnnnnnnnnnncaaacacatacaacagtataacccccaaacctatgttgctggttttgaaagtgtttgataaattaacattctcacgtatagtactttttcttggaagattcttccttgattttaagcatgtattttcattttaaatgaagcacatttcaagctggagtttttacagtgactgccacgctctttgaatttaacgagcttggtcgtaaggagagaagtgatctgaggccgaggcattatctaatcaaactgtggttattttttagcagtggttgctacccagttgggctgtaaacatatggaatattttaagcagtgagttatttatactcaagaggagactgatgggctgttattgtgggaaaccagtacagttgcagtccccaaatatggtacaggcaggcacagctgaaaggctgtgcagcagctactgcagaatcgtgctgaatgctgaggcctgcctttgaagatttagtctgggggcctgaatttggttgagttctcctttcaaactgaatccctgacctgctgcaaacatgcgttttatatgtgtgggcatgaaattaattggcatagtttccaagaacccagttcaagtcataattgaaataatcatgtgcgtttctagttttaaggcattttaagattgcagatgacaggagtggcaaggctgtagttatcacagttgctctcaaagtgaggtttaaacttgggctcccagattgggtgtgtgcattgaacttgaactcaatcctttctctgggctgaggttagtgaagaatagtagaacacgtgagaccctgggttcaaaactttcagattgaagtatttatgtaagatatttcttttgttctacaatgaggcataagtatagtgtttatttgattttagatttatagcataaaattaaagtgcatccatactatcacgaggtaactcaaaggcagcttttgtagttaattgtcacacattcctgtgggaaggaagggcctggggttaggagtgnnnnnnnnnnnnnnnnnnnncctccctcagtctacattggcttccctcagtctacattgtatagcatcgtgtaacactttaatgctgcagactagctctagggtttcaaggacactaattgttttaaaccttgggtttagactttgcagctagctggctgctctggtccggccctggctctttcaggagaggggatacagttgttctgctccctgtacctgaatggaaacaacctcccaggttccagcccgagtccttcctcgagctgccagcattttggtgtgtaaggggtagagcctagtcagagaagaggcttgtgccgcataacaaacacactcaattttaaagctcaaaattcccagcaagccagacacagcggctctttataacagataatgacgccagcgggcttcttgttcttctggtttccattttgttttagttggctcctgaaaaattagaggccttctgctttgtttgtagccgaaacagcaaagagggctgccatcatgagtctaggaatgtacattttcccctcaaggttaaaaacattccacggtgtagttgtcattagctttaatttattattattattattttaaaaaaataaaatgtaaggtactgttagggtagtctgcaggttcacctagctaattttcagttccacaggtttctggttagtctgtctagcttcacctacagcagaagcctgctccccaggacttgtctgggagctgacacagcagtgtctgtagtttctggttccctgacttctcaagagatttattcatgaactacaattgttgccaaagccaatgcagcccttgtgcttacttacccacttctgttctgttatagcatttttatcctaatagttagcttacgatagtaagtaaattagtgtaacatagcttcatgttaagtccatgtgcaccagaactttggggcatagttgactataaaatcttaaaaatgttggtgatctaatcttaattgtttttttttttttttaatattaatgttgagtgtgttctgaggagttctaggttgcgctcagttgagagtgaattattgctgccctcagatgagtagaaaggatagaatcaagcctgggcctcggaattcttgactggaaagggactggagaaatgcctctgcagttaggatcactggctgcttttccagaggaccaaggttcaattcctgtcactcacgtagggtctgtaactccagttcccggagtccagtgccctcttctggtaccaagactgcaaggagtatacagaaatgcatgcaaacaaattacccatacacataaaatagtctaaaaacagttaaaaacttaaaaaaagagagagagagagactaagaacctattggcgatgaacacagactaatgcagtgggcgttctgtggtgaatttctgcatgagggatggggaaactgctaaatgtactttgtggcttgcttaatttcaccatggtgtctcatctcccagttttatttgtaattttaaatttttgtctgtttttcctttcctacatttcctaccgtgaatattagcagggccgagaccgttcaggttcttgcactgagcctgtgatctttgaaggagcacgctataaggaatgaaagataagaaagagcctgtctcttactgctttatgtgaggaagtatcaaacatatacggcagcctctgagctttttaaaaggctacgcactgctgctactactgctattgctgcttcctcttcctcttccacttcctcttcctccccctcctcttctatttcattatatcttaaatttcttttgtgtgcggcaagtactgtgcactgtggtgtgtgtgtgtgtgtgtgtgtgtgtgtgtgtgcgcgcaggtcagagggcaacttaacagcagtcacttctttcatttatctttgtgggtcctggggattgaactcaggtccccagacttagttgcaagtgcctttagcccatgagccattttgagaacccaacatactaaacttcctgggttttctgtgatcaaccattctgaccaagggtaactcgggtttgtttggcttacagctagcttactgtccatcatggaggggcgtctggtctgtagctctaggcaagagctgatgcagaggccatggaagggtgctgcttacaggcttgcttcctctgccttgctcagtctgctttcttacacaacccaggaccacctgcccaggggcagtaccacccacagtgggctgggccctcccccattaggccagtttcagggtgacatttttgatgcccgtatatgaatatgtaaatatgaaatgatgatgagggaggttttgagtgttacgttgttattcagttagagtccttaattgctgcttgagtaaccgatttcggagctgtacttgctagtactacctgtctttgagcttccgttatttctaggcttgggaatggttttggtaggatgaatatcacactgctcttgcctgagatttctttgtttgtttttgtttgtttttgaaacagtaggtgactagcaaatttgtttacttacaaatatgtataaccttgtctagacaatgctgttgagttacatcacaacacttgagtcttctgtgtgacagacagcttcctgactcagactggccctgactccagctggctgcaagctagtaaccggaggggcttaggaggtcatatctgggcgacaaccttaacaaatacgggggtctttgaatttaaatatccattctttggctgtatgtgtggaacagcttgggagtctgatttctgctttcaacgtgtgttctagggattgaagttaggagcccaggttggcggacagaaccctagagccatttgctgccctgagtcctctccttttataagcaactaaaacattttcttttctgtggtgcttggtgcttggtgcttggttctcattcattcatattctctctctctctctccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgccctctctctgctaggtactgccaaggctaagtctggtgtggccacactgaaaccagtctagtgactccagccctgaggtgttttcttatcagttctgtggagattaaataatttcacatcactgtttctataactgtctgaagacctagaagtatatcccagggttcttgttttgctagagaatgaacgggtggatgactgcagggaaaaactcattgactgtctggactaaagacaggacttggctgggggcagagcccagtttggcaggtctttgattctatttatttttagcttgtatgttttcactgattgaaacatagaatcttattttaatcttttttttcctgttagagcgtaggaaagtcttatttactaaacggagtaattattatactctttaatagtataaaatgtcttaggtaaaattctcctaattgtcctacaggtttttaatgtgcctgtttgacttggggcatctggatgatttccatacttaataagtagttatgtcttttaggtctccagtggtgtctcccctgcccttgctagtcagtgcttaaaatcagttggaattttaagcaattaaggacaatgagttgaagtagctgagcacttatctgctctattgttaactctccttataaaccatattagtagtaagatatggatggctttgctttcatttagtgtttggccaagcacttttgcatctagaagctcctactaggtagatcttttaaaatatcttctatgtttgtttgtttgtttatttatgtgtgtgcacatgtgtgagtcatttagcatatgtggagatttgaagaccactttctgcagtctgtttcttctcttctgctattggtcctgaagattcaattcagattatcagtattggtggtaagctccttcaactgctgagccatcttaccagaccatggtagctcttactatgttcattttttagctagcaaggccttagagattaaatggtgtgcctcagcctatagaaatgaaggctttggcaaaggtgggattcagtccctccctcgtggttccggaattggtattcattctgcacagtaacacaaaggtcatagcagataaatctgttgataagcatttcctatgaattacttctgagtcatttctaagtcagtttattaagggaagaacatgtacacacacagttatattttgtattattccttgatagtgaaatcagataaagaatattacatgtctatggtttaaaaaatttttttcaagaaaaatatctctaaaataaaccaacaaaaagtaattaatttaggccttcaaaatggacactgataagttcttcagtcaagatacatataaataatactctcttaaaagtaaacccatcagaaacatcttggcctgtgaatcccttaatttaggaaggcagtgttgaggtttggtcttttgctgtgtattgtaatgctaaatactggcccccaaagttgcttgtcctcaggaacaagattttcttgtacagcaagggatgttatatagccttgctcattagtttaaaaccattggttgagtaaagatgtctacagcctatagctgggcagaagagaggtgggcggggcttcagttctctggatgaggaaaagagggaacagtggatagaaggcaccatggtgtaaagaactagccatgaaggggcaaagtatccataccttggtcttctttcttcccgagcttcatgtgtttcacaaattgtatcttatatcttgggtattctaagtttctgggctaacatccacttatcagtgagtacatatcatgtgagttcctttgtgattgagttacctcactcaggatgatgccctccaggtccatccatttgcctacgaatttcataaattcattctttttaatagctagtagtactccattgtgtaaatgtaccacattttctgtatccattcctctgttgaggggcatctgggttctttccagcttttggctattataaataagactgctatgaacatagtggagcatgtgtccttcttaccggttggaacatcttctggatatatgcccaggagaggtattgctggatcctccggtagtactatgtctaatttttctgaggaaccgccagactgatttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgacatttatttgtgaagcaggcaaaatatactaatgacgttacttaaacatggagaagtgatatggccagccttgattcaaggtcaaagactaaaaaaagattattttccacccatcctcatttatctttgatttagttttatttatttatttttttgattaaaatagtagtgttactataggtaaccgtgtcatgtcaaattatttttagttatcaattggggagagagttccctggagagccagatatcatttttgagcagaaggcttttgtttttgtagttacagattacggatttgtttttttttttaaaaagtaaagttgggcactccccggagcattcagaaaactcaccatttaaggctcgagtgctgaggaaatcactccgcccactgggctctaagcattgtttgttggctgttttggaaaagctgtttcaaacactttcacgtcagagtgttctgaagagaatcatacccacttttaagtgtgtaccaacatcacccagagttcacgaccactttagaaacaaaggccagacacctcatccatcagaaaggaagcagttgttccttcttagttttgtaaggaagtcaggctgcagaacattgtcctagccttgccatcacaacacaactaccttatcgtcttaagacaaacagtatctcatgtcagccatagcccgcacaggcagctccctgcacagccaatgccccacatggccattgccccacacctatgctcccatctccctgcacagcacactcattgtcccacccagctattgtcctgcacagccatctgcctacctggtcaacaccctggacaaccaacacctagccattcttctttccagcccctgtgtattttccatctgatgcaggcactggtgcagggcaactgataggatcttaactctgtatctgatccatttagagtcactactgataaatcagtctagaactttcagacccccttgcccactctgaatcatctcctaaccatctctcgaggtttatcttgcagcttagatattgtgtgtgtaagtgctgcttcgtgggaagaagagcgaaggctgacatgtactgagcatctgtttctagtaggctgttaactattttatttaccggcatcgttccataaagccttaaaataaccaggcaaggcaggtagcacgttgctatgttatagtctggagccggttccgtagttacttacctaaggggatggagcaacgtggctgattaaagtcaaacaccagtactgagctcagcggtgtggaaaatggtgatttctttctctggaattccttattacagtttgctgtgactttcttattaaacttgtgacaagccacaacttgcagatgagccggagaccttctccttgatggccctggacaaataggcatgtctgaatgtttccttacagtagaaccaggtcaggttgcgagcatctgtagccttctgtagactaaatctcacttaaactcaactaaaacctttggaacttgttgaacttgtgtgtgtatgtgtgtttgcatgtttataaatgtatttggaggccagagataagtcttgggtgtcttccttaatgggttctccatttgcatacgtgtctctctgtgtgtttgtgtatgcacaagtgttggtatggtagtgcatttatgtgtgtacacgtaacatatgtgcctgttcccgtgcatggggaagccagagaaggatgttcagggttctctgtcactctctgccatattcccaggagacatgatctctcggagaacctagacgctgtatttcggcaagactggcaggacagcaggccccagcagtcctctcttagccttccactcacagtgcagaggacgatagacacacagcaccacacttggctttgagattcactctggagatctgcctcaggtcctcatactcctgctataaggactcctactgagtgaggccagactccgggacttctaccttattttttgaggtgggatctctcactgactgagctattctagctgaccagcaagccccaggaatcttctagttcccgtccctcctcccagggctgggattacaggcagctgcttctggcccagctttttaacacagttgctggagatacaaattcaatgccttacaagggtttcactggccgagccatctctggaaatgtgcttctttttctgtccgatcctgctgacagatgaggtgtgtctggtgagaggtgctctatcatggccacatgttacagttgactagcagctgtgaagactggcatgctaacagctcagtaaagtcgggtccttttacagatgagacctttgccaaggacccaggagttccaccctggtgctgtgcacttgagtgggttgctggcctcgctggctttgcttgctttctctcatgtcctccctggctgagcatccccatctgccatgcagaagaacagagggcctgacttaggagcctgccttcacagcagaaggcccaccaggctggatccagtcatgctggtagaaggtctaaccctaggccctaaccagacacacagggtttttatttacctttcaaccactgtttggctgtgtggggcatttgagctaagagccagatgacaagcttctgacgagagtcctccctatcatgattttatacctagtgtctctgtggtaggtgtgggagtgtgtgccagcgtgtctgctgtaatcatttgtccattagtggtctctggtaatgcctttgacctttctggtttctgtggaaacccgggagttactcagagcctctctgtggcttccatttctgcctttagcagcaagaacagggagtggagcctgtgtttgtgggatggggagaggtctgaggcttaggttcacaatggagaggcaagggcgtgaggcggccatatgtcacatcaaaggctgctgctctgaaggggtcaggcttatgttaatatacttttattttttttttcctttttccaagttctgactgtaggtattgaggggttgtttgattaccaagaaatgaaaattgacattattgagtaccacttaatagtttcatttacttcttgggtagtcagtggattttcctgatatagaaattagaaattagaaatatttcatactctatttatttattaatttatttatatatgtgtactgtatttattcatatatatatatatgtgtgtgtgtgtgtgtgtgtgtgtgtgctttattgagtgagtgagtgagtgcaggttaggaaactttgatgagccccctcctttgcgggagtgaggcccctcctcccaccttgtggcttcctggagtcaggggttgagactttggtcaggtgctcactctgatgctcatccctcctgttttctgtgagcacagagagagtaaggcacttgcctcaagttgtatagggagacatgcaaaaggcannnnnnnnnnnnnnnnnnnnattatattatattatctattgctgggcatagctcctgcccttacaagtggttcgtgtatccagtgaggtcccattggagaaaactatcttttcctttgtaagcagttatcagctggagataggttctgggttagggatggagcttggtgtgaacttcggctttcaccactgggaccccatctggcttaaccctgtgcagacctcatgcctcctgccacatctctgtgtgttcacatgcatgtcagccctgttatatctggaaggccttgttttcttggtgtttccatctcctccatctcctttcgctcttagaatctttttgtttcctcttccacagagttccctgagccctgacaggagggatctgatggtccctttctctctacttccccatcaacccataactatctattctatttcccccagtctcttactctgtgtctaacctctgtagctatatggattgtagccctgcttaccggaaacttattagctaacatccacatatatgcaaatgcataccatagttgttcttttgggcctgggttctctcattcagaataatttttactagctctattcatttacctgtgaatttcatttttaaaatagccaagtaatagtctgttgtgcgaagagaccactttttcattatctgtccatcttctgagggacatctaggttgtttccagtttctggctattatggacatagcagcaatgaacatggctgagcaagtgtctctggtaggatgaggcatcctttggttatatgcccagagaggcatagctggttcttgtggtaggtcagttcccactgccacactgctttctctaggaactatacaagtttatactcccaacaacgatggatgtgtgtacccctagctctgtgtccccaccagcaggcactgtcatttgttttatccaccttggccattctgaccagtataaatgaaacctcaagttagtcgtcaaattgcattttcatacttgttatccagtcttgtctatccactccttcattcttttttatgtgtttttttttaccccacccccttgcccacttaaaatttaaaatttgagtgacttcttagacagagaattggcgtttttatttttgcaaaatgttcacagttgagcatggtgctgcgggactgtaattgtagcactgtggatgcagagagagaagattgtactgtttaaagccatcctagcctattgaggtttccaggacagctaggcctacatagagatctccagtaacccaaaggaaaacgcactcgccaacaaaagagagcccacttccaggcagcatcatgacgtggcctttctgtttacgtgtgtttttgttgtattgtcttcacagtcgaaatcagctgtctgccctgcccgcctgcctgtgtggtctgcctctcaaagtcttaatcgcaagcaacaacaagctcggatcactgcctgaagagataggtcagctcaaacagttaatggagttggtatgttactgatttctaagatgctcttgtttgtttaaccgactataagcgttagaggtcctctgaaagactttgttacagaaggaaaaaggagaagtctgtgatcattcccccatccccctcaccccccattgctctaacaaaatacctgagactgggaattttatacaacagacatttttagaatacagttttggaggctgaaagtacgtgtgatccgtttggccactgctgcgggctttccttcctcacagctgatagcatcatgctgggagcaaatgtgtgagggaaagagcacatggctagacaggaagccaaagagagggaggggccagttttactcttatatgatggtccactctcattggtccttagtgccatcctgtaagcagtatgataaccctgtctaagagcatgcccagtgctacaatcatcttctgctaggctccatccctgaaaggatccctgtggaggtttgaagatgcttggcccagggagtgacgctattaggaggtgcagctttgttggggtgggtgtggtcttgttggaggaagtgtgttactgtgggtgtgggctttaaaaccctgtcctagaaatcagtctcctgtttgcctcagatgaagatgtagaactctcagctcctcctgcaccatgcctgcctggaagcagcctggttctgggatcctgtaaggagttaggcatgtccaggacaaaactgtctccagttctggacacaagctgtgtgtttcttttgtagtgagctgatctttgctggggtctcctgtgttgttgccagctcctgtcctacaccttacagccacagaccgatctccctcgggcctgcaagttacagggtgtcagagtgccagcgtgttgtagaagtttcactgttcgatgacagcttgagctgtaacaccctcatccatagcactgttcagtagacatccaggacacacaaaaaatgtggtttaaatgtagtatggctatgtttaaacagttaaaagaaacaaaagaaagtaagtccttgctataaattatatttaactctagataggtcaaacttatgacctccagtatgtatatgagagaaaactatccaggtggcactgtttgtatcctaatgtttgtactaagtctttcctaccaagtcctgtgtgtatcatgcaggggccacacaccacacataggaccaaccacactctagtgcttagtgccaacagggctgagccaccactttgatgtgacagctgtgcaactttggtgtattttgttctgtagctccctgggtcttggcaagtgtgcttttggtaaagaacatttggggggggggatgcagtgggctggttcagtgggtaaaaaaaaccaagtcatcaagtcaccaaaagtcaccaagaccgatgacttgagttcagtcccttggacccacacagtagaaggagagaactgagtcccacagttgtcctctgacctccacatgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacattgcttgtgcattttcaagatagaaacctccccagacatggagataattattgctttttcacactactccttccgctaattagacataagtacccgtggggtttctttttatgatgaaacgcataacctctttaagacttggttaggttcagaggctcctgggaaataggatttgccctgtttttaccatattaaatatacaatgctgtatagcctgtctctcctttatgtaatagatttgcttgggaaatctattcctattatgttatgcatattatattgggagggcacataactgaccctcgtcagatactcttcaaaatccgagcaggcctgtgtatttgtgtttgtccataggtgtcctgtttcttagatggagaacttgggtgcctatcagacgcagcgctgtcttatgtgtagtaagtacatgctgaggttaccgcatgtgcttaaacacagcctgcaggggttggttggttggttacggccatggtgttgggggtttgtgccaggaagaatcatctaggctattggggtccaacctacgcctaatgatgctgccattaactggggacaacataaacacacacagacacacacagacacacacagacacagacacacacacacacacacacacacacacacacacacaggtttgatctcaggagaggccattctgcaagtgtgttgcctaaacatatagattatcttcccttttctcatttttattaaagaaaaaaaatcatattagttatgtctttcaaagccgtggaagcggttgatttcatacttgcgatgagtctccacaagcaatgataagctttcccatgtggttgcttaggagactcacagaaacttaatttatacttacatgacaagagtcctctcctcagacagaaaatcacccctgcagattcttcccccaaaccgtgtctcccctttggcactgtcagtcctgtgccgggcctgatctggagcctggaggaccgtagcatgatctcctgtgacactggcctcaggccggcctggcttccatgcttgtgagggccgttgtgaaccacagtggagtgggccaggtgctgattcataacttagttaaggcatggaaaggtccggctctcactggaaagacttgcttttagactccgtggacgatcagaattagatcaccaccgaattctgattttatgttcttgtatattttggtttctgcataagtactggtggtgatttgtagctgttttgtgatttttgttttagatattagagttgtatgtgcttttgttttgttttgttttgttctgtttttttgtttggatcaggttaagggcagcagctaaggtggtactcctgaaaagtctatgaccctaacctttctcagcctacttccctcctcagacggttgaagctaggagagtgttatatgtcagccactccacgcacacccttttggatggacggcagtttttcacgctgttactgatggtgatattgtgcctttgtgaagtagtgtccattgcggttcacctgagggctaatctaggggatggggacagctgactgatggctgactggtgtagcctggtctaactgagatcctggttgtaggggtggaatcgagcagaagatcgattggttagtgatgcattcatctagtctgaaggaaagtagagcagaacaaggcctcggtaacctctgcagtgaaaggttgctttgcaggttcctagagctggatcgtagcccagtgctgattcagtctccacactcattcaggcttcccctgcttgatatgccactccactgggatagcttagagcctggatttgtcttcggttctgtcatagcaagtggggcatgcatggaacttgactaacatgtcaaaccattctggggccccagaagcaaggtacaaggggccatcgtatcgtggggtgtctacatcagaggatattagacattttatccctgccttatacctggaactctgctgggggatggcgagaacgtgggtcctctcacctaggaacttccagctttacaggcgaaggagaagggagcaagtgaattacatgtacaccctgctgcaaagggagaacaaaaacacccattcccaggtgatgatcagagtaggagaggatcatgggagtggttttaaagggggaaattttaagcttgggttgagccatgacagatgagtagcaggccaggaggacaatgccagaccttacgtcatcaagcaggggaggaagcctgaatgagtttggagacttcgaaacagcattggcctatactgaaactccacgtggtgactgcatggttagggtgtaggaggcaagagagaataatcagggagtggccctggaggaactgacgtcttctcacagagtctggactttgctgaaggcttatgctggtgaacaacagaataaaatctgcactaggatagctctgtctgtcaaggatggacgtgaggaggtgggagtggcagagaagggatggacagacagacaggcaggcaggtagatgacagagcccgccggagagcgttctgtgcagcagtccctctgagaggagcacaccacagactgcaggagggtctaggtgtgtgagagaaaagcagagccctgctgcttaccagagctgaaggaaagatgtggggagataatgagtgtctatagggtaagaatggtctatattttatgtggtaggagctggttctaatctaggattagtgggggactgcaatttcaaagcgaagatgacagaatcctcacacttcacagacttgcttaacaaatgggtgtgcagccatcagctgtagctgtcagccatatgatagcaagtccatttggaataaatgatgcatccagttggtgtgctggtatttctctgtgtaagagcttggtatgatggagtggggggtggggctgtgtaaccttctttctgaaaggtggctggtaattccttcctaatgtcaactggcacctgcttgccgccgggctataacgccgccttttcctgagctgtgagatagtaatgttgccttgtaagattgtggtgggaactgagtaaggtccacgcacctgaaaatcagaagcgacagaaactgctagccaatgcctttaatatcttttgtgccctcaaaggacattgagaaacaaaccccttttcttcactgttgagccccaatggattgggaccgggagaccagtattctatggagttgtccaagcatttaagttctttgaggagcattcacatgtaattcttgggggaagggcattggttattcttgtctgactccccctctccctgaaccccccacttttgctgcaggatgtgagttgcaacgagatcacggccttgccccagcagataggccagctgaagtctctgcgggaactcaatgtccgaagaaattaccttaaggttttaccaccaggtaagaaaggagggcaaagtggagagagcgggagatagcacctgctgggtttacttttatgagaggtgatgggttagtgtgtgtgtgtaaattgactgttattaataattaatagttaacgattaacaattagtaattagtagttaatgatctcaccggcagatgccagaacagtgatggccaacttctagtttgaattgaggctagagcaacacaacctttagtggaacatacattagttttctagggctgctattaaaaggaccacagcgagggtagctcagatggatgacaagaaggtttctcttcaccattctgggttgtccattccaaggccttcctccttggctctcagatggtcattaatcctccccaccccacccccgacaacctccacctaccactatttgtgtttcgatcttttcttttactgttatatcagaggattaaagtctatcctaatgaccttcgtgttacttaattgcccatttaaagcctcatctccaaatcccattgaattctgatgtactggggttaggatttctatatctgagttttggggtgtgggacctagccagtctgtataacatggtggtgtgacatgtgatattctagaccatgaagctaacagtctggaggggacaagcttggtcctgcagatcctggctatcaggatttggggatctgggaacactggtagagagctcacagtgtctacactctgcctctgtgtgtgggtgatgctacagcggagtcctccctgcactgaggccaaggtcactagtaccagtgctgaccctaaagctttgcatggacacttgcacagtcagtcatagtatcccccacacagccctgccgtgggctctcgcagtatgtcactgttgtccagagcactagggtttaagcataaagacatttacttcgaagctggaagtgcttgaggggtctggaggaatagtttggtgtgtaaagtccttgcttcataagcatagacatatgtttgaatccctgacattcatataaaagccaggggtgagtgtggcagagtgtacctgtaaccctagcactgaggaggtgtggagataaataggtctctggagcaggccagccagtgagaggctggcctagttacctatcaacatgacatagcccagaatcacttgaaaaaggagttgtctttatcaggttgatttgtgggcatgaatgtgagagattgccttgattgctgattgctgtaggagagtccatcccactgtgggtggctccatccctacgcaggagggtcctggtctgtataagaaaggcagagaaaggcagagagcagagcagcaagcagtcttcctccatagtttgtgcttcagttcttaccgtcacctctcttaacagtggactgtgtgacctacaagataagtgcacactctcctccctgagttctcctctcagttgctttttgccagggttgttgttgttgttgttgttgtttttaaatcacaaaatagaagggagacttagagcagagatcctgtatcaaatattgaaacaaattagaacaaaagagagagcaatagagaaagaggcctgatggccaactgtgccttccacgtgtacatacatgtacatacatgtacatagataaaatgtgcgcacacatacacacggttcacttctgtatgataaaacgccctaataaaaagcagctcaggggacagggattatttttagctcatagttccagtcttacatgtgaggaagtcaaggtgggaggaacttgagggaactggtcacgcccacagccaatgcatcatgcctgtttgcttgtgtttctccactcgcacagggacgacctctatagtgaatggtgctgcccacagtgggcggcgtcttcccatattaactcacctaggaaagacaatcagagctaaccatcatcccccccccccccacacacacacacagtagatggggagcagagtgccaggtacttcttttaaaacatactctactttccagagattatgttgatttccaaaatatactttaaaaatttatattagttctttgagaatttcatataacatgagttgatcattttactcccctttccctaattctgactaaatccaaccctgcccccctgcccagccacctttgtgtgctattcatcatttttgtggttgtttaactcaagcccaatttgtgctacccaagtattttttggatgggtggccttccattagaagcatggccaggtcaccaggggctattcttttagagaaaattttttttttcaccccccccccccccgtcccctctcctcctctctctcccctagcagctaacagttgccagtaactccctggctgggagtaggctttcgtggacaatttccaccttcatgctgaggcttgcctttcatccatcccatgtgtactgtcacaactgctgcaggttcatacactgagccactctgctctatccagacgccactgtttccttagagttctctaccatctgggtcttctgctttttctcaccctctcttcctcagtgatccccaagccatgggatgagagggtagggtatatattttcccatttagcgtgagtctctcattctcttggccttggctgtttgcagttcatccattgcttctcagatgagggttgagagatgtactgaactgtggacataacaatgagttatttggagtcagtttaatacaatgtcaatttttaacagaatggtagtagattctaccttggggcctattacctaacgagccatctctaatggtgctaggtatagttttcatcttgtggggatgacttaaatccattcagaacgtgcttttttttacctgtatgatgattgagccaccatcacaccagtgggcatgccttgccaggccagtctgtgttgtatctcccagggttcagagctgggtatgactgatgatcactggcttgccctggaagctcacagagcactttcaagctctgtgaatgctagccagtgggctgacacttccaggtcgacggcaccagctcgatttcgctatgttccatgactcacatatgtggcatcttcagaagcagggtcttaactgtcaagttctggagagaaaccaagagcattggcaatgtttgagaactggtgggcccttactggccaacaattccagaagaagtaacccattcttggcattgggcttttgttttgttttgttattctctggtgtctagtataggaacattgttgccccattagaagttagaaggtaactaactcccttttaactctatgtatatgcctagacacttgtaggaagattctgcagttagcagatttccatatgagtcttttgaaaggcatctcagttcaaaagcacacacttggaagcagttggcacctagttcacttggcatttattagtggcagtttgaaagctgcctggtttttgccatcctgttactgcttgttccagacatggaaacagctcctaaacccatgcagaagagctttgtaaaatgcaccatgcggatggtagagggctcggttatccttccctgtttctcaccttactcacgctggcttacattcaaagaagaattagaaaatacctctgtgtgggagtcattgccttatttgaatgagctcataaaaggaggtttactttttccatttgtcactgcacagtctcatttcttttgagtgcataaaactattttccctaattataataaaaccaaataatactaaggataactacaaacaaaattttaattcacagtttatctgtacagcacaacctttcaggcattaagaagccccgctgcatttgagtgcctgcgataaccactgtggaaatgccataaatgattgaacccatttccaaagggaaaaccgattacattcttgtgtggtcacagtgtggcacaggggaggagggagcacctgcagggcctacttttctgtttttctcagtgcttctctctcaccttaaggacactcttttccctataaagatcagtaaactactctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattccccttcttcctgcttctgtgctgtttttcctcttcttttcctcttgtttctcttccttttcctttcctcttttcctgttcttcctcctcctgtttgactcctgcttcctgcttccctgcttctcctcctgcccttcttggcttgctttcctcgttacctgctctgtcccttgaccttttgtgggtcagccttgcgagtctgtcattccctccaaggcatcactactgtgagactgtagagtcttcccctacactacacgttggaaccaaagggcagggaagtggcgatcatcaaaagtttcctttacctgcttgcctgcaaattctctactcccccgaggagccggtctgctagtcataatttagagtcttcattttagttggtaaagagtttctgggaatacttgctatgtagtagctattgtttaaaaagcccccctttttgtagcaaaggaatcacacaagcccacaaaatacagggtctcatcctattttaacattgttgagacagccaagctttgaagtcatcctgccctgggaatccccatcctttttagctggtctgtaaactgtaacatgaaaatcctaaccataccgattaggttttgttgttgtttgtttgtttgtttgtcttgtcaagttgacacaagctagaccatctgggaagagagccagagtgagaaaatatgcctccacccgattaacttgtaggcaagtctgtgggggcattttcttgatgaatgttccattgtggggggctccagcctactgtgggtggtttcatccctgggcaggtagtcctaggtgctataagaaagcaagctgagcaagccacagggaacaaggcagtaagcagcactcttccatggtctctctatcagtttctgccccgacttacccttatgatggactctaagctgtaagctgaaataaaacctctcctcccgggttgattttggtcatggtgtttatcccagcaatagaaatacctccttttctttctgttcactttcataactttcccctccactatgtacaattgcccccccataattccaccctgtgcccacaacccgtatcaaaacaacctttaggagtaaggcgtgagactcatggctgcccccgttggggactcgaactgctccgtcaaagtagaaatagggattccttgacatctgttttgaaatacagttcctgaggctgacatgggctttactatatgagacctgggagttgagtgttgttcttccttctagaattttggtctcaaaattactctattctgtaagaccaagtaatctactgagaggtgaaagacggaaagcccctatcattcccagggccttgcgttctgagaagacggagcactcaccccaagggagtggtgctggctgggctaaaatagtactgcagagttgatcgaaagcctcagccatgtagataaggaaaagggactaactgctagtgcttcttaaaggctcccgtcctctccttcaagtcctctccctatctagtttctggctctcttccactttaggccagaagtatttgaagccactatattttggcctttaacagctgccatacccaaaatgcagagcactgttctgaagtgaccccactgtagtcaccacccagccagctcagagatctgccagcgtcaccctaggccctggcgtgcctcagcctggcttcactctatgggattatatttgacttcgtgcctagcagctgtcagcgttggttggaatgcttgaaattactgagtgtttattatgccactgggtgggaacctcaggctaaatgggacatcctctcctgtgagttgagctgtgggcagcttcgaaggcgatgggacgaagcccagccagatcggaattatgggtccttttgaaaaatcctaaattagataacactgagtatgtatcggagggtagcaatggggaccctttgacaaaatcgggagcatatttactgaaactcattctgggcctgtgccagctcatgaacattgactagataagggttttctgtatagcatagcatccctaatcagccagtgggtcgggaaaatgggatatagttagaacatgctccgagtggcatggcttgtgcaattcttttgctggaagaaaacacgctctttagatggtgtgagtggtaggtgtttccagtacagtttgtatgagtgagtgtccagggaaacggtcccccattcagggagattctttatatgcgcgcatgccatgagtctcatacgggtaacatggctcactgttgatgctgctagcctgcgtatctctagatacacagagagttgactattgagttgactacacagccacttgatcctgccattttctgagactttttttttaatgtccccccctttctctcttctttcagagctagtagatctccccttggtaaagtttgacttttcctgcaacaaggtgctggtgatccccgtctgcttcagggagatgaagcagctgcaggtgctcctgcttgagaacaaccctctgcagtcccctccggcgcaggtgaggatctgcctagagcaacggccagggctgcacagtagtggcacgagtgactctccacagagcccctgctctgattctctctgcataccggaggctgcgctaggcatgatgggatgcagtccgcaccccaccacccccctcaaaacacacagtgagactttcagtaaatctgactgataggttgcctgtggcactgtcacatctgttctcatatccctgtcatcgtgtctgaaccatccaaggacggagtttcaggtttgataaagtaccaaccactcagcgacacatgtgacgcttgtcataggctgtatagcctacaaagggggtcacacatgccttatttgaacattagctgggaaaacggaattcaaacgtcttaaaatatgattattgacttttttgagacacagatcaaactatgagaacgctacacagtacaaatgaaaatattgtacagtttcttttcttcttaaataacctaatgacttattaaatctatgatgatcttttaaactcttagttgctgtctgtgaacttgaagataattgcgttttcttccatattttagagttggacttattcccaatgctgtctgatttttttttaaaaataaattttaccctcttttcacttacatatgtttttgtcagaatttagtagtttgaaaagattaggtatttcttgagcaggattttctgcccaaagtggaatgtggaggaaagagtcctaagaactcttgtgtatttagtgaccattgttagggggctacttaccatgacagtctcaagattaaactgcgtggtcggggacctggaacttacatcttgttttgtcactgagaaataaatacgcattactgatttctccacagatttgcacgaaaggaaaagtacacatatttaagtatttgagcatacaagcatgccagattaagacaagtgactctctttacctccccaccatagagaggccccatttacaccaacacgtggaagacaggtgagttaatgccttccttcctgaaagaggctgtgtagaatgcccttcgccacagctgcccagataacctgacgtcagcatccgtacactttgttcccgtaattcacgtttatgacttggcgtttgagaaaataatggcatacaaaaaaaaaaaaaaaaatgatgctggggaatctctaatccctgtagtgtagcctctcctcgtcagaaatcagcgcttcctgaggacatgtgtggatgcttctaaataggatctgtactgactttatgcttagcacggctatagcaaactctattgtaaaaactattgtattttaaaaattgatcgcttcaagctaggtgtagcagtatgctcctgtgatcctggcacttaggagacagggttaagagggtcacggatttgaggccagcctaagctgtgtgtgtgtgtgtgtgtgtgtgtgtgtgttgtatgtctatgtgtgtgtgtgtgtgtgtgtgtgtgtgtgtgatatcgccatatatccagttgctatctcaaacttgctgttcttgattgaatacctgtatcaagttgaaacatgttaagagttataaattttctgtgtacctgtgtgctcttgtatcttaaggttaagatctgcaggcttcagtttttaaaatgtagaatgtataggtattaaccgcccccccccccccatttccagtttcatgtgtaagtgttagaatcctttcaagcatccttgggacatttgtggtgtaagacaggccttatgcatccagagactagagtagccacagtgacccacttaaagaaacacacatttttcttgagaattttacagggcagaggtcttttccttgaccttgagatttgctaaacaggatggcttggaatttcaaactatcctaatggcactttcaaaataactatacacacatatacatatatataaaattttatatttatattgcaaggtatacttaaatactggaaaggttttcaaattgactgaaaacaatgttttcaaccctaggacataaaataattaaatatcttactgcttctatatatgtgtcaataagataaaattagtaactgtttcaaagaaataagttgtccctcagaggaggaaaccctgagtagagaatttatgatgtccttggcagttacaagttttcattataggtgtgtgatcttaatacttcttagaactaggctgacagcctgttgccatatatcaataacttcaataatgatgatgtgttttatataatgaagtcataatcacattattaatcgatgtactttggtgtcaattttgtgatttttttccaatccttttctaaacaaactgaatgctgacgatgtccgctgcagtaagaaggactccgactcaggggttggaagtgacaatggagataagcggttatctgccaccgaggtaaatctgggggtcgcagagttaccttgcattcttcatccatctgtctgtgtccaccaaagtctttctataggaaaaagccactggtgcatttgaacgatgtgaattgacagttcaatcatgtgtgaaagcagcttgggacccctgaggggtgtgtgaatgctagctgctgtcgctcagtgttcctaagagcccctgtctttcccctatcccacttccacattgtctagcatagtcttcaattctaaatgaatattatgaaaggataatgtattagtatgaagcactttgatgaacatacctgtttttaatggtactttagggaagtgcggttagatacatccctaagtgctaaggaatcaaatgcacattgcgtgtgagtagcttattcactgaaatgtctgtaactagccgttaaaacatttaagctaatctgtgtgttcagaagcgtcacaacacatgtgtggtggtccgaaggcggcggcaggagtcggttctctccttccaccacgtggggtccagggattgaactcaggcatgtcatcaggcttggccccaagcacgttttcctgctgagccatctcgctggtccttacctatagttttagaaacaatatttgtatttctggtacttcagctgccttatgatcagaaaattaaatttgtgggtaagttcagtttcatcagtcgggcatgacagaacttccattagtgatagctgtaagggtaggaggtggggaagggaaaggaaaggggactgtagaaacgattataatttagtagaataaaacacatctttcctttgtctttcttattatcattttttggcctcatgtatgggctactagatcccatagggggtcccttgaggttgtaatgactaggccagttacttctcatacacacacacacacacacacacacacacacacacacacacacagagagagagagagagagagagagagagagagatcacatttttgttttgttttgttttttgagaaagggtagccctggctgtcctggaactcactttgtagaccaggctggcctcgaactcagaaatctgcctgcctctgcctcccgagtgctgggattaaaggcatgtgccactatgcctggctgagagatcacatttttatcaggtgtgacttcaggaaaaatcatttccagttctcccctggtcttgagctttagtaagcagataggtctatttcccacaagatgtgctataatgctgtatatttaaaaataaaataagttaaagtccgtggctggggagatgggttagtcttgtacaatgcttgtcacagaagcatgaggacccgagttcagcccagaacacctgtacaagccaggcccagaagagtgagcctgtgatcatgctgtgaggaagagagagacaagaggacacttgcagctgctggccagccttctcggttgaagcagtgggatccaggttcagtgaggggacctgtctcaagaagcatgtggagagccagcgggggagacgcccagccttgacctctggcttccacacgctacacggacagggacatgtgtcacgtgtgcacacacacacataaaacaaatttaagttcctcaggattttgtttttttgttaaagaatttatttatttatttatttatttaacattttgaagaagagtcagtgggaagcaaaaggcatcccgtatctgtgtgaggctgcgacccacgtgaaaccacactaacagttggctgtgggtcggcggcggggttggaatgctgaacgcatcactttcttatgttgcattctctttaaccccctggacttcatgaaagctcctaagtcccctcaaatgggcgattgtcgcagaaactgcccaccctgggattattttccattaaattaaaacaagctctcctttatctctcttggaagagtaattaagttcattaataaaacatcacggaaggaatttcattatccttctcttacttataagtaggatgctaatagcattctgaagagagcccaaggatttattctccccctttaattaaatgcatatctttggatttttgctagctgtaagggtaggaggtggagggagggaaaaggggactgtagaaaagattataatttagtagagtaaaacacatctttcctttgtctttcttacctcacatgctagcctcattgtctgagtgcatctctgtggtactaattattttttaaagtggtgaggttttgaattataccacatcgtgtgttacctttaaattttttggtcacattcactccctgtttaccctcactgttggggtcagtagtcacgcctgtcccctttctctgatggatgccacatctgattgacttaacattggtcctgaaaatactaaacccatggttttctcaagatacttaaacaagaacttgtggggatctgtgaatagttctttggtgagtgaaattcatgcttgctttctggtgtttctaagtggtctgtgcgtgtgtttaagggcaaaaattgcttcaggaaccggccacacacctgagggcgcatgtggaggtcctgcttcctgtggcttaggatgcttgtcacttgtccctaaatagcaacactaaaatggagagagggagaagtgaggaaatgtgtcttaacttgtgaggggattgtagatttctgaatatacgtcattggccagtgtggggaaggagagacatcagacagaattaactcccggtacttcatagaacctttgtcttagaagtcacacagaacaccctttccttatacctaatacctaataacactatcagctgcctggcgctgcttcctcaatgcaagtcaaggctggacactgacccttaatgtcttaaacaaaatacgtactcagttgcctgcctcctttgtgtgactacctccatgtagttttggtcagtcaaccctttgtcagacctgactgtacctctcctagtaagattataatttagcgctatagtttgtctccaagtgttcccttgttgtgttgggtattgcatggccctctggtgacctgatggtggctgtaagctcagaaaagggagaagtcacagagacatgcatctatgtggaggtgtgtgtgcagcgtaagcactgtaaatctgtactcacagccggcgcccattcacaaagcagagccacagcggctgccctcaaagtctcaggtgcatccctgccatcgcgtgaatagtcgctctccctttctgacatgggtatcggttgctatttctgagtttgtaagcaatatgctgtttgtcaggtcagggtgccgctttatgtgcatcgagaagccctctccccagaatgatatgattccctgtatctttgtagccctctgatgaggacacggttagcctcaatgcgcccatgtcaaacatcgtggaagaagaccagaccatcaaggaggatgcgtgccatcggctcaccccaactaaaggtctgagagcgacgtgtgcagagagagcttgctttgcaggtttagctagacttaaagcaaacacacacagagagaggtgcagatgatcagttactctttatgtcacacatcctgtgagccagctgtcatgcccacagggaatgatttcattcccagtctagatggctcttctggctgtagtgcaggatggggaaaccaaggctcagacatttgacgtgattacccgtggtttcacaagcgagctctgctccttaacagtcagtagtagagtccagaatcctcaggaatattggagattcttcaaattcatttgtgaaaagaaaatattgatatgattgatggataagacgtaggacagctctagcagctgtcgtaaaatctccgaatctcagggagaaggtgatagatgcagatagctggaagactgatgctccattactcaccattagcatggactccccaagccccacatccatgtgggttaagctagaggggtggagcatggagagtcttgggcttgtggggttgtggggttgtgggcagacctagaagtgcctatgacttagaagatggacttcatcccacggccataatctaacacactcgagggtaggaaacgcatttgaggtatgagcttgggaatctgttgtgactgtaaccacgtcagctggctgcttccatcccttgtaaagatggttagatcagatggcctccgagagcttccttgtaacttttgtcctttgactctttgatagtcgtattttaaagctattcagacacttccatgttttcttccacctcttagatttaggacacttgtatttcattttgtttgtttaaaacaaggtcttcctgtgtggctcagactggcttggaactgtctctcctcctgcctcagcctccccagtactgggtttgtaggagagcatcaccatctccgactcttagatttgggggaagcattaagcagagagactgtgatggaaaccaaaccccgaaatgtaaatgaattcttgcgagaaaaatgtagctactgctgaattgattcatataaactttataacaatatggagtattgggggtcgtatttaagacaagtcttccttttttaaagctttaaatgttgttatgtattctcgtctcatgtgttccatcccagagaggagtaacaaagctgtcccctcgacatcttgcagtgtcactttttaaaggaaactctccctgctttctcctgtttactcttcagtcagcagagccctctgtgctgtccccttttctgccttctgcctgctgggacagatgagttctgctccagcatgctctggcttctgcagggcctttcctgggcgatttctatggtaggcaggatctgggggtttttggctagacttgtctcatgtttccttaaggttaattggttgcttaagggcagaagcaatttaatccctataatgcatatgcagatacatatctaaatggcataatgatttccaggtaacagtggtccatacattttgttgaacatagaatgtgtaataattagccacacacttctaaaaacaccaaaatgcttttatgattttctcaattcttcaaaagcatgagaggacattccgtttctttcatggggagctaaagccctgaagaggccttgacttttaatactcagtttgtgggtcttctgtttactttctgtttcttcctctactcccatgtttaattctcccctttacattctgcagaggcaataaatcatgggttgctcaggggcctcagcagcgggtgacggggggcgggggtggggctggttgtgtgtttggggacccgtgggtgcttcatgcctctgtctttgaagtcacgcttccttgctttctctgtgttttcctgacaggagaatttcagccgaagccttccattttgggggacagcggcatctcaggacaagaaagagagcagcttgctggccgtgcagatgctcgacactcgggacttatgaactatattaaggcaaggttttgcagctcaacacattttcctctgcttgggaccttagaattcagatccacagatttcagatttcagccaaacatgtctgtccagcctactgttcactctcaaagcctccagcatctcctctctaagcttgaggcttttttttttttttttctctttgcccctgacattgagagctggctccaaccatgctcgtctctagactgtctgattataaatgagttttgttttctgatccaggttcagcctcttcttaagcctccgaaccttacaaattgacaggtttccccaaatgaccatgaccacttgcagaagttcctaaattgtttcattttccccatgttttacgtgagtgcctagatggtttctgtaaatgcttagcctgagagctcaggctgtgcatttttttttaatccaatatgtttaaaactagagatgtcctagattgctgggctttttggattttgaatgttcatataggcattacagcacaaggctccctaatctaaaaatctgagatcccaaatgctccaaaactagaagctcaaaagtttatacgactcgaaaagtttcagttccgtgggctgacaagatggctcctgcacggatgtcagagggcaactggtgggaatcagttctctccttccccggggattgaactcggatcatcaggcttggcagcaggcaccttgaactgctgagccattgtggcagcccttcacctgtgttttctgatgatttgtttgatgccttcagccatgctaaccagcattccagggactcacatcccaggtcactgggagtaaaacaagctgaatttgacttgtactgcttgaggctctaatgtactgtagccttcttcatgccctcgagactgaaatagtgaacttgacaatcccatcatgaacctgactcagtttgtgcaaagttaatagtctaaaatgattacagaaacacccagacagtaaaacatagaccacgtcgtctttacactactctagcttttcaacttcagtgcttcttctcttcatcttgtatctcgattaacatctctttggctgggttcatcgtgtctcgctgcgatggtcgcaggtgcccactccagctcctcagccaacacggcctccatacatacgtgtgtgctcctaagtgcacatattctatattctgccaccagctatttttctcagcacacagatgtgctcacatcactctcaggtcattcccataaggctctcccacacttgactcctgtctgtcagctttgtgggacaggtcagtcattagaacatggaaaaatgattctgtcttcatttcatcaagaatctctcttaagttgagaataaaaacagaacacttgaaatctcagattcataaagcacagtgtcccctggattcagagtcccgggatggcagcaccctggggggtggctgatgtggagggtggatcctgagggcgacactcaaggagccaaccatgtgttaggcttgacttctgttttgtgacctatgagtgcgccaggcttcctagcacactaacagtgtttttctataatcctgccttatgtactaaattggcatctagtgctttttttttttaattattatggcctgtttttttttctttctaatcactcataatagttgtaaatgtatgaaaccattatgcatgttacactgtccagtgcaaagctaatctactcagaggaaatacaaagttggatttctgagagccttgggtcacatttctgtcagccaatacaaagccttgtttcttgtgcatttctgtttagagacccctggctcagtgtccagtcagccatgctttaagggtagagatagggtctgggaaatgtgttgtaacagaattctgtcagtgtgtacttgcctgcctccgatggctgcagcatcaccagcggtgtaaccttagggtgaccgcatgtcattggtgcattagcactgaaatgttagaattcactaacacggtaatgcacacccgtgaacagcctacctaacacattgtttcttttgggggcactttggagttgtctcaggaagttgtcaaggaagattaatcagcatctcagcattgtatttcagccccacttagaaccatgaaataagtttttgaaggcacaaaactatgagaagtacgctaagtggaccagccccagtgcttgctcagtgtctactatgagaatcagagccagaggcggagtgtcccttatcctacctcacccgggtcctgcttgtgtttgttaatcactttgtgtgtttatgtgtgtgtgtgtgtgtgtgtgtgtctatgtgagtgtgtgcttatacatgtgtgagtgtgcatatatgagttgattgtgagtgtgtgtgtatgcatgtttatgcatgtgtatttgtgtgtatgtgtgtatgtgagttacatgtgagttatgtgtttatgtaagtgtatatatgtgagtgtgtgtgtgtgtttatgcatgtatgtgtgtatatgtgaatgtgtgtatgtgtgtgtgtatttatgcatgtgtgtgtgtatttatgcatgtgtgtatttatgcatgtgtgtgtgtgtgtgtgtgtgtgtgtgtgtgtgtgtgtgtgtgtgtatttatgcgtgtgtgttacttacaagtaccccaagcactgctttgggcactgcagatgactgtgccaattctcaaatgctgtgtaatttgcaaataaaaagcttagcaagctgatgccaacctgttctgtgttctagagaacaactgcatgttctgttgagttttcattctgaagctaaaaattagaagacaaccccccttgcctttgctagtggaagcctaaaagacctggggcaggtcgctttggacgtgtcacctggaagtctgatttcatggacttcaccgtcacttgcagagtgacacagtttatcttgctgtaccctgaaagtaccgtctaggcagtaaaggttggagtggcttttgcaacaccctcctcagggaagggtcatcctaaggagacaccagaatcaatggagacatgcccgatagcccacagtccgatgttctttccctaatagggacatgtacccactccagagtggctctctgttagtgtgagcccagccaggacattttccttgtctgaggagaaagttcaaggagatacatggaagacccacagtggacacagcccccaggatgcactcccagtgcagtgtctctggagagctttggtgtgggaggctcagtgaagacatgagtgttctctgactttgttcacacgaaactactggattcagtgcagggcatttccttttgttaaataccagtaagttgaattaaataaagaactcaggtggattttatgttgcttctgtctaatggaagttgtaatcctaagccagcttggtggagttattattattattttatgttttaattgtggcaaaatacatatgaattataaaaccttttgtctgtaaaattttttgaggcaaggtcttggtagatagcacaggctgtgccttgaactcatggtccatctgccttccttgaccttccagatgctgaagcgcaaatgcacactagccatacagcaccacaacccaacgttttagccacatttcagttgcactctgtagtttgtgttaactatgtattgttattctgttctgttaccactaaaacctttttcatctttctgaactgagactatttaccacttaaatcttcccatcgtgcctcctctctctgacaagtaaaccttcccccgtgcctcctctctctggcaatcatagatttgtgttccttctcaataagtttgactactataagtatctcatatgtgtagaatcatgcagtgtgtgtgtgtgtgtgtggtgtgttatttcatgctcaaggatttctgtatgtagtgtaataatgtcctccttgtaaagaagattcagttatatatccttagcatgcatgtcagtggccaactggcttgttttttccttttggctcttgtgaattacactgccatgaatagggactgggaccggttttaactcttcattgaaaagcccatgtgctctatcataggaccaggcagaagactgtgaagagctattgcggatagaagaggatgctcactggcacatggaggaactgtgagtgccagagctgggtcatgggccaccattcctcttcagatactctggcagtcatgtcctgatagattttgatctacttttctttgggcaagcctagaatcttccccagtcatgaagatacgaagttgccagttttcctatgactcttctttacagtcttgggtcatatagtcaatcttcatttgtgctactcacatagactgggtaacacattacagttgaagtttatttggcttgcaattattggtttagaagtccaaaatcaagaggctgtgtctagtgagagcttcttggtccgtcataacacagcagaagctgtcccatgggaagagaatatgagaggtggagacagagctgagcttctatacataaggagctacctcctgtaataatagtgtccattattgccttggggcttcctagattccctgatcaaggttctatgcctaacactgttctctttggcattgagttttctacacatgaagtttgggatgtacattcatactgcaggacaacggaaagttctacttcattgtccttgagttttacttgagtctgtcaataaaaagtgagaacatcttctcctttccttccgttttccttgaagaagccaatagccatacctaatatctagagagccagtcccttcaaccgtggttgcctggttcaaatctttgaaaagcatttctctacgtcctagttgccaatctaataactgtcatagctggcatatattaaattctgtattcctggcactgttttatttcctaggcagcagcccagttaatctttgtagcagtcctagaagctcggttgtctgccatattgcagatgatgaatttggggcctagattggtgatgcctttctgtccaaggccagagaaggtttgaccttgaggaatcttgtataagtgattttttttttttttttttttttttttttgctctgctgtatatcagtatttacttggcaagacctccagtggagcagatgagtgtctcgacagaaaaggaacctctttcatggagttggcttggaacctgtagcattgggtagatgtttggttcatagatttttgctgtctgtggtgtagagtgtatgtaggttttgatggccttccactattctttgtgggcattatcttttccttaaaaaggactggtcagactgttaagaatgttctctagtagtaggaattcattggcctgcatttgtgtagcaagaagagtagccaaaccgtgatcaaatttctcttcctgggaagtccctctgtatcactctatcttaccagctccttgttggatacacttctgagaggccaaggaggcctgactcagtgtagcatcagagaatcacgagggaggaaagtgaggccagataaagctttgcaaaccccgttatcagtttcacatctcttcccaaccctgactctaaagtcaggattatccgtggagctttctagagggcccgtctttacttgagattggatttgcttaggtgtgttgggggctagttcctttcataagctccacagttgattttcctgcattgataaagaatcaggcctgagagctgctgttccacactgagcccctcacatggaactagagttggaagcctaggaattgatacagctccactctggggagccaggctggtcttatgggaagacccagtgtccttgtctgttgcctgactggccatggagcaagtggaagcctggagatgaactgagttttccctgcccagggacttctcccacctccatagcacccacctacaggatacttatgtgtcttcattacagtactgagtttgtcaaaatccttattagaagattgacggggttttgtgaggctgcacttaagatgtcttgctaaacgttctgcactcacacttggttttatgttacagactaaattcatccaaagaccgggagctggatatagcgatgattgagcagctgagagaggcagagctgcttcaggatcccaacgggtatgcacgtctgttcctggcctggcccttgtgcgtaaatgagggctactaacttactgagcacattatgtcagttatatcaccgtctaacacatttagagcagagttggtctgtatgtaaccactaacaaagtgaagtcctttagttgcctattccccaagatccaaagtaaaagaatcaaagttctgtagcagttgagaccagtttcctggtcctaacctctcgtgacattcatatggaatggctggtttcatttatggaaaacagaaatatggtagaagcacagaataatttctactgatttataaacataggaggaaaaccctactaaaaaaatggaaatttaaaacttctacttatttctggtagtgccagatgtcacttctatttatgtctggtagtgtcaatatgtttataaaggcttgggtagtaggtttctctttaaatttgaattggacccttgtcaggaacatgcattgtacaagaacttcccaacagacttccaagtgatacttgactatcatgtcaacctgtcaaccgccatgttgaaatcattttatgttgggcacattccttttcactatgttgactacttcctatatttgttctttgttctttacttttaaagtaattaccataaatttgacaagtttaatttttttctggttatattcttgtggaccaaggaatggctaattttaaatatagcagtctaagtcagacagacatggcaatcgaaccttaatgccattagtggtgtagtgttaatacctgagcagtttggcttgctggatcatgacttcatcagacattatcatggtctttcacacataagttggagttcagtaaaaacaagcgctggtactccattgggagagccacttgcatttggaaactttttctcttaatcccaaagacaagctgtgcttgtcagttaagtgtttcacctgcacggagcccgtagagcgaatcagacgtttaatgggttcactcctgtcggttctccctcctctttagtctaagcgcagatatcatagagagaagtattttgaacctgttccccatggactcaggagaagcctcagaattccctgatccttcactcaagtacgttcaccttttataattcagtacattttctctttttaaaatgatgtgattgtgtttcaaaaatccactttgcctctcttttctgcccaccttcctacagtggccagttgcagctggagacgtctccagaccgtgaggtaaggacagagctcggtgttgccttgggggaggaaagtagttgccttgggggaggaaagtagtggcatttgttcatgaccgagtttgtaatctttcctgattctctaattttgttgactattgttccccccaccttccctcaaagatgagaggtggcttaatttttttttttttttttttttttttttttggttagattctctaagtttgtttgcccaaaacagactcactttgtcaggcagtggtcactgcagtgcataagaaagcagttctggcttggaaatggagggaggcccagttgatgcagactaaattcgagttgagaaagaagtctggctaaatgaagggcctgaaggacgtcatcaaaggaactgagaatgcttgggaagattaaaagaatatatagggagttgggggtggtggtgtagatggccattcaggcgtaaagacccgagttcagaccctcggcactgcagcctgggcctgtggtttcagtgctaccacgtgcacataggagcgccgctcagggtaactggttagccagcttagctgaattgaagagccccaggtacaactagagattctgactcaaaaaacaatgagtatatagtatacataggtccatacagaacacaaaagaatactatgagaagctggtgggaatatttggggagaagataaggataagttagatacagtcatgtggagtgaaatttgggggggttagtagagaaaacattctcaacataaaagtaggaatgatcctagagaaagcttatcccagctgtggaaagataagtttgggagagtagttaggaatcacacaatctgttaaagttacttttctattgcagtgacatgtgaccatcacgacagggctcatggcaaaaggcaggcaggctggcatgatgctagagtagtagctgaaagctcacatcttaatccataaacaggacacacacacacatacacacacacagacacacacacacacacacacacacacacacacacacacacacacacacatgcaggggtcagggggaaggtgagtgtaggttacctggaattgacatgggcttttgaaacctccaagcctggttctgttgacctgcctcctccaacaaggccacacctcttattcctggccaaatagttctgccacctggggaccaagcatttaaatctgtgagcctgtgaggggtgttctgattcaaaccatctgattttactcactggactctctaggcttgtggtcctataatgtaaaatgcattcagtccaccttcaagtctccatagtctcaacatggtttcagagtttctcttgagacttgagacagtctcttcattgtaacccctttaaaataaaaaagcaaattacatagttccaacatacaatggtacagagtatacattgctgttctgaaagggaagaatggtgtcatagttgaagaaagtggactggagcagggaagaataaaaccctcagcggggcaaactccagatcctgtaattccttgtctgatgtgaaagaacttagatggctctgccttttcaactttgttgtgtgtgacacacttgtagcttgggctggttccatttcctgtatgaagcgttctctggcagacatgtcatggctctgcggcggctctgtccattgtgctggggtctccaacatgatctaagcttcacttttcatggcctcataaatacagtggccgtttaaggcttccatgcaggaactcctctcccacatgcccgacctcagtagctctccttatccatggaggaagattccacaacccctttaaccctacatccttcatgattctaaagccaggacacatggctgatgctgccatatctagctgtcctctttggatggagcctgactccctccttgaattcgttttacactttgctttcttgctttttttaggaccaggaaatctctgagacattttccagactttgcagattagctggatagagtcttgcacaccaattcactttgctccatttggctttgagcatctctttatctctttcagcacaagcctgggctccaatgttaaattccctggcactctttcccttctcaaactgcacatgttgtatttctttttgtcctgcttgctgtttttcactgtagagtttcataagagttactactagtaactatacaacaggatgaatatgaagctatcttcagatattcttggccagtgaaattagccctaaacttttcagttagcctcaggcagcttcttaggataaaggcaaaatgcagccacagtctttgccaaagtatcaaaaaatggtctaaagtccagttgctgatattgttcttctctgaaaccaccagtacttggcttccatagtcccattgctctcctcactactgtcttccaagctcctgctaggataaccctcttaaggcatgcttacagcatccagctgctttcctcattcaaagtcccaaatcttccatgttcctctgagaaacagcatggtctggattgtcacagcaatagccccctccccagtaccaatttctggctatttttctattgctgtgaaaaaaaacaccatgaccaagccaaat

SEQ ID NO: 68 - DNA, 1096 bp, Mus musculus
gcaccggcggcaccggcttcaacctgcccttgaaccgtggtttggagcgcgcgctggaggaggcggccaactctgggggcttgaacctgagcgccaggaagctgaaggagtttcccaggactacggccccgggacatgacctctcggacacggttcgggcagatctatctaaaaacagactggtggaagtgccaatggagctgtgccaatttgtatcactggaaattcttaacctgtatcacaactgtatcagagtcattcctgaggccattgttaatttgcagatgttgacccacctaaacttgagtcgaaatcagctgtctgccctgcccgcctgcctgtgtggtctgcctctcaaagtcttaatcgcaagcaacaacaagctcggatcactgcctgaagagataggtcagctcaaacagttaatggagttggatgtgagttgcaacgagatcacggccttgccccagcagataggccagctgaagtctctgcgggaactcaatgtccgaagaaattaccttaaggttttaccaccagagctagtagatctccccttggtaaagtttgacttttcctgcaacaaggtgctggtgatccccgtctgcttcagggagatgaagcagctgcaggtgctcctgcttgagaacaaccctctgcagtcccctccggcgcagatttgcacgaaaggaaaagtacacatatttaagtatttgagcatacaagcatgccagattaagacaagtgactctctttacctccccaccatagagaggccccatttacaccaacacgtggaagacagtaagaaggactccgactcaggggttggaagtgacaatggagataagcggttatctgccaccgagccctctgatgaggacacggttagcctcaatgcgcccatgtcaaacatcgtggaagaagaccagaccatcaaggaggatgcgtgccatcggctcaccccaactaaaggagaatttcagccgaagccttccattttgggggacagcggcatctcaggacaagaaagagagcagcttgctggccgtgcagatgctcgacactcgggacttatgaactatattaaggcaag

SEQ ID NO: 69 - protein, 365 aa, Mus musculus
  VARIANT (1)...(365): Xaa = Any Amino Acid
TGGTGFNLPLNRGLERALEEAANSGGLNLSARKLKEFPRTTAPGHDLSDTVRADLSKNRLVEVPMELCQFVSLEILNLYHNCIRVIPEAIVNLQMLTHLNLSRNQLSALPACLCGLPLKVLIASNNKLGSLPEEIGQLKQLMELDVSCNEITALPQQIGQLKSLRELNVRRNYLKVLPPELVDLPLVKFDFSCNKVLVIPVCFREMKQLQVLLLENNPLQSPPAQICTKGKVHIFKYLSIQACQIKTSDSLYLPTIERPHLHQHVEDSKKDSDSGVGSDNGDKRLSATEPSDEDTVSLNAPMSNIVEEDQTIKEDACHRLTPTKGEFQPKPSILGDSGISGQEREQLAGRADARHSGLMNYIKAX

SEQ ID NO: 70 - DNA, 76410 bp, Mus musculus
  misc_feature (1)...(76410): n = A,T,C or G
tcatgagttccatagaaggatttgatttcctgcatttctaggactcacctgtgtggtatttgtgtgaggactcttttaaaataggatggaatggcaccttttgcttatttgtaacttagttaaggcaaagaaagctttcattgaaagcatttgattgttggctcttgtgactgagcaaaggcccccgtaattgggaaaagatggcatttcactgttctcttctcccatgtggaaatacattcggaaaggcagggcaatttactgactcagcgaggggctgagagtgactgaacacgatctctggacctcctaattctgtaattacttcctttgacgtttttgtctctgcagatgtgcttgtggagtttgtttctgtttttgttttaaacactggaagtgtttttctcaaacttgtgtgtgacttttctgggccaggagggatagagcaaccgcagttgggggtgatgctgctgaacacccggtgctctcagcccgtgccaccccacctcccccatcagacagctgtacagagaagcttggggaggtatctgcactgtgcacactcagcctttatagaggacaacttcattcctttttagcaagagtgatactgttcctcttcatcgggtggtatccattgagcactgtcctggtgaggacaggttgatagatcacctgaagccttttagatgagaccaggttagagggcagggatcaactgtgttgtgtacagcctggtctaaatgtggagcctgggggtgttcactggattggtcgatgatgagttcatcttatttgaatgaaagtgaaacagatttctgaaacgaggctctgctgccttctatggtgaaaggggagagcttttccaggttcaaaagtaaagcgggatatttaaggccttgatctcactggaatcatttgtatctttagttctgtgatgccaagtgggacctgcatgggatttggtatgtatgttggagcatcctgggtcctagggtcctggagacagaaggagccacagtattatggagtgtcactgtaagtggattttagaagtttgatccaacatttattgatcccttactttatacttggcactccacctggcagtgggaggatggaatgaataagacatggtccctcccacccaggagctcataggtttaaaggggaatgtaaacccatgagcaaatgacttacagtgacatgctatctaaaggaccacacaagaagaagtggtcagtctccctgggcattagatcagagtgggagaggtgggggaagcctcgtgaaagatttcacgaaagaggttgaggcttgaattaagtctttaaaaatgagtcagtgggacaagaggacaatattggggactggcatatcaggcagggaaggagcatgaacaagtttgggaattatgaaatactgaaaactgccagaagcagtaacatggctggagtgtaggttgtgaggagggacattcagagaaaaagtgctggagaaatggacagacctcatcatagatactggccttactgcccagtttggactttatagttgttgaggagcctctgcaagtgtttaagctggtgaacagcatgatggcatttgcactctggccgctctgtgaaggatgcatccaaggcggagactgatgtatggaaaccagtcaggagatcatgatagcacccagctaagagagagcactggtctacactgcaggagtagctgggggtgtgtgggggagtgaagagcccagcacggctcccagagccaagaggaagagtgggattcagggagatcctaaggatatagaagattataaatgtcaaggcctccatttctcatgtgtcaagaggggattccaatcaaggcttaattgagtatttgcttcctaaagcaaagaagacaagaattgcttgtgaagtgtatggcaaggtggtcagctgtaagatttctagcctgtggtgaagaactccattttaaataaatagtgcatccaaacattgcattaatattctagttcttcactgcaaaatgtgagagtttggtaaaataagatgcattgtagtcttgtttagaggcacgatgggatagtggctaaacggtgagctggtaattcatttctagtgttaactctggcacttgcatgctttgggcgactggctaaacttttctgagccccactttttgatttgtaaatattaggctagcaatattgcccaatgggtttgtggtgagaattcagtaaaatcgaagcatgtcaaagtggcaggccagaggctggtgaagcagctggcgaatgctactaatgtccaccctttctccatttttctctcctgtgagggagtttaaaatgttcagctttctcttctctgtgctgagtcttaatgctagggacctggagatgaatataaaagtgtacctgtgtagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaagagggtcgatctttgtgtgtgtgtgtgtgtgtgtgtgtgtgtgtgtgcctactacttaattaggatttgaatttcacatacagataacaaaaaagtgatgttcaggctgtgattctagtcaagggctacagcaacaaaatcattcccctaggtaatgctgtggggcacgggggtggacgtgggtgtgttagtttgctggggctactataacaaagaaccacaggatggggtgcttaaataacagaacttcatcttctcacaattttggaggctggatgcctgggatcaaggtgccagcagggttggttccctctgaggcctctcagcttggcttgtgggtggcatcttctcctccctgggtcttctcgtcatctcccctctgcacatgtctgtgtcctaatctcctcttcttacaaggacaccaaggattagagctgccctcatgacctcattttaattaacttaattacccttttaaagaccctatttccaaatacagtcacattctgaggtaatagaggttaggacttcaatatatgaattttggaaggactcaagccagcccgtcacaaggggtgacatgaattgttttgggtatgggtatgtgacgttttggaacgtgaaatttcggggacatactttgttctacagatcctgtctgtcaggatttctagccttggggatctgggagcactggttgggaactcccagtgtctagaatctgttctgaggtgagggtgctgcctctgctggagtgatacttggactaatgtctcactggtggtcttggtaagtttcaccagtggtgacagcagaacctcagcattgagacatggctcccaaccatccagcatgaatgccaagacctcagacagccctgctttgcagccatgggcttccatagcatgtctgtccagtagtgtgttgagttcaaggcagatatgtatatttattcagaaactgcataccatttagagcatgaaagcagcctcatagggggtagtggatctgcatttggtgtttgggtttggacctggatcaggaatgaacggatgagtcctggaaccctgaatgctttctccaaagcatactctggttttcagagattacattgatttccactgtttttgtttaaagtctctagacatagctgatttcaaacatatatttaaaaatatttctcaaagcaaaaccctgtagtacttggaaacagtcagcatttggttaatctgacattaatggaacaatttatggatgcctgattttaattatcctgtctctgcatcttgatctttggcttgaaatgcttcataataaggcaagaaaatggagctcatgaaagggaaagaactttgcaaaaggtaatgtgctttatagatgggaggttcaagtccgcttgccatctttcacctttctcatactgactagcattttagagaagcagagttagaaactcaacattttttacttcagtacttgagatgacttggttgaaaaatattgattgatttttcaatttgtccttgtacaatctcattttttggatatacaaaacttgtatttggtttaagcaagcacaaaaggaaagcttattaacagcaaatttatatgcatacaaccttttatgagttaaagaaaactttcatttaaacttaagctctcatgttaatcattgtgaaaatgtcctaaataattgaactctcattttcaaaaggaaaaattaatttgatcattttgcaattgcctgtcatagtctggaaacatgtggaaagtatattcacaaaatctagatttttgtctctctctggttcctcattttcttaccttaaaagcattcctttcccttaaaaagatcagttattccataattatgttttctcagttttgatattttaagaatatactcaaagctaaaacttcagtttactggaaatttcttaaaaaaataacttcctcaatatcaagttcctttttgcttccctctggagaactctattgacaaaagaccattgaaaatactttcagtcagtgactgtaaagactttccctatttacttatatgtttttcctctttggatacccctcctcgtatgctttcaatttgaggatgaaaaaagaaaacaccaaaattgtggtctgattactcatatcagttttgtggtggttttactacaacaactgcaataagaagaccatattttattctttctaggactagaatgaagaggggattaaaatagccattcattgcctctcttagcagtggggagagagagtgggatttgttcttctgcttcttttttttcttactccctttctctactccacttttttttttacctttcctgggctggtgttgcaaaattatcattttctccttcgttttattgttgtgaaactgtctggttcctgttttcctgaactatgatggcaattgtgtcccaaactggaactagaaaagaaatggtcattataaaaccttcacttattttatttacctgtaagttttctcctgctatgttttccatgaacttagccctctagtcttgctttgaagtcttcattttaagtggcaaagaattgctaaagatccagagtccagttaaatttttccagtgatttgctaagctaactttaattaaccatctcggagataggttgatattgctaggggaaacagctaggaggtgttcctcttatcatggaatcttcataattcttatcatcttacaaacaagctgtgaggtgaaaggggatcttgcttttcctattgtttcactttcatgattccagggtcctccaggattagtgtggcctgaggtcaatcccttatcctgccagaggggagacaagctgggttgagcaatgaactaactactcagggcaatttaaaaaacacagtcccttacattcccagagtgccttgaattctgagagaggtactggttactagaatcttttcctgctggaatttgacataacgtagctgagtaaagtgaagactgaagagcagtgtaggggtagaggagaaatagtgtgaatttttactccaggtcagtgtcttcagttactcttctttgtctaattcttgcccttcgtccactttagaattccttgagtgttttaaagcgcaatattccatcccttaacagatcccataacaaaagttccgaggcctcgttctggagtgaacccttcatagcccctcacacagagatctcagtggcttgcctgcatcaccctagatgtctggcgtggcccagcctctctgctctatggaatatatttgactttattcctagcagctgccagtgtcgttttgaatgcttgaaattacttagtgtctactgtgccactgggtggggattttaagctaaatgtaatgttctgtcttctgagtggagctacagaagactttttaaaagctgtagaataaagtctcatcataccagaattacagggcctgtcggaaaattctgaattggataacatttattttttaaaatgcagttgaaaaactcatgaatatatttagtgtagctagttctgggataatgccagcccagatacattgattagataagaatattctgtaattaacgtattactcatgggctagcgagtgctactgggaaacagtttgaagttaaaacataaacatgtcctgtgtgatgtggcttgcgtgattcttttgctgaaaaaaaaaagtatttttaaacaatagatattgtaaatgttaagtgtttccagtttttatcagaactaacaacaatttaaaactttggggcatgcaataaaagattttccctcttttggtaaaatgttatgtacacacaccatgtattcctaatgtacaacttgcctttgattatactcaattgtatttttcctgagaagcagaacattaatttttgaatgattagccatttaatcttattgatttctaaggttttttctttctttttttcttttttctattattttagaactagtagatcttcccttggtaaagtttgacttttcctgcaacaaagtgctcgtgattccaatttgttttagagagatgaagcagctgcaagtgttactacttgagaataaccctctgcagtctcctccagcacaggtgaggggtcttgcagcaaagccaatgccccatgggatgtgctgttataggagccaagggaaaatttccccttcaccctctgaaagtttgctgaaaatcactaatcactggcaagcggcagattaattggagaaaaggcatcaaaatttattaacatgtacgtggaagcctccagagtgaagacccaaagatacaggggaaattgtccatttttatgcttacaaagtatggacagccatgtagaaatatgattggacaaaaagagtatgatctcatgttaatagactgagtgaggaaacccagcagggcctgtttgtctggattcttcttgggctctctgaggatcattccttccttctgggcgtggggcaggaccctctttgcgatggggggtcttatggcctactgtcaaacaagagaagtcagatcatttctttatggccagtttttacacagaaaggccgagggaaagttccagtaatattttgaggttttaaaggggttttggtttctatgaccagctttggggaagagagattcaaatttgtaaggctcccttccttgggagaatgggaccgaggggcaggagggcaggagaggtcagagaaaaacttttgcttctgagaccttcattttggggtattgttttctgattcccaatgctatcaatcatgcttaagcaactctccaaaggccagttttctgattctctgctgaagagaataatactgaataaaacttgattataaacagtcacagtgaacccttgagtgaatgtgagaaacaataaattgtcttccattgcatcaaatccattcaccagcacttggctcactatgctaatcactccaactccagaattaaatgtcttattatttatcattttatttgaatttgtttcatggagtatattgatttttttttttttttttttttttttgagacagagtctcgctctgtcgcccaggctggagtgcagaggtgtgatcttggcttactgcagcctctgcctcccaggatcaagtgattctcctgcctcagcctcctgagtagctgggactacaggcgcctgccaccacacctggatagtttttgtatttttagtagagacgagatttcaccatgttggccaggctgctctctaattcctgacccccagggatctgcccgccttggcctcccaaaatactggtattacaggcgtgagccactgctcccaaccatatattccttatttgaatgttagctggaaaatggaatttaaacaccttaaaacatggttattgattatttagagacaagtctccagctcaaatgttaaactgcatgagagaaaaatgaagtgctatgctttcagatgcttaaccatgtaaatattttgaagtttattttctttttaaataatttaacagcttcttaaatctacaattatttttaggctctgaattgctttctatcagctcgaaaataattgtgcttttctcatcttttgtaactggaatttcaccaggctggtcatctgagtttatattttttatactatatatacttgaatacatttttgttagagttttatagtttaatgcaagaaaaaatgggaaattgcttaagcatgattttctattcaaagtagaatttggagggaatgattcccaaaattcttacatgttttggaaaggacggatttagtgtacattggtagggtgttacttaaaatgaaactgggaaaattgaaatatacagagtaaggatttgatacttacattttgttttgtcattgaaaaatgaatatgattgctattaatttctttgtagatttgcacaaagggcaaagttcacatatttaagtatctgagcatacaagcatgccagattaagacagctgactccctttatctccacaccatggagaggccacatttacaccagcacgtggaagatgggtgagtcatgccctcattcaaagccccagtttaaaatttgcctaggccaaggccctccaggtagctgacttcaaaatctgtttgttttaagtcaccatggtatctgcagaaaacaaagcaaaacagaacaatttggtttaatcacctaatttgtatttaaaacaagaagttgagaaactattgggatatgaaagaaaaaactgctgctattgagaatattttggtatatctcaaatatcatctgtctcctaatcaataatcagttcttcctgagtaaatatgtgcatacttataaataagatctagaatacaaatgtgaatattttttacttatcaaaataactatattgagcccagacatgcctttttagcaattattaatgttgaatatgcctccagaacaatgttaagaaaaaaatgaaggctttatttttggtcttttaaaaatgcagtatgtgtagttttgtcgccacttcctgtttcaaatggaaaagttagaaccctttcacacatcctagagcttcttgtggcataaatcaagccttgagcttccaaaaaacaacattctcacactgaacacagttatagaaatgcaggttctttttaagaagtcttcactgcagaaatcttttccttcactttttgctacataagtaaatttaaaattttggactactctaatgttacttttatataatgcttaaaatatgtacactgttttatgtacttaatccctggataaaaatttacagaattattgaaagtaaccacatttcataacataaggggtaaaagcagttatgtggtttattaattttttatatgctagatgcagtaaaataagaacattggtaactatttttaagaaacaccttgacatctaagagcaagccacttgattagagcataaatccatgaaaccccgaacacaaagaattttatcttatcctgtgtttagactgtgctactgtctgattttcattaggtccatgtcttaatattctttaatactagactgatttgttgccttatggtaataataaaaatttgcgtagcaaaattattattagaatataaattgatgtttcttggtgtgaactttgtgattttaatcttttttaaatgaattcaatattgatggcatctatctcagcaagaaggattctgattcgggagttggaagtgataatggagataagcgattatctgccaccgaggtaaagttagtgatcagattcttttccttctgtacttctagacatatctaccagtgttcattgaactcctttctgttaaagggcatcgattcatttgtatattcatgtgatattcgtaaaagtgatttgtatattcatgtgatttgaaatcctcgaagtgttatataaatattagctgttgttacttattctgcatctttaatatctttaatattttgtaaatgcctcaagagtggagtctgtatcttctcctctcctacacattatctaaaatattattgagtgctcaataaatattacaaaatggctaagtagtacgcaagtgcccgtgaagcacttttataaatacgcttatttttcagtaatagagtaatttagaaaaacattgttatacatatgcgtaaatgttaaggaatcaactgtacattttattttaatagttgatccacaggaaatgcatttatgagtagctatagtttttataacaatgtttgttttcctcagactcttagattgtgttctgttctgttctgttctgttcagttaattggatacaagtttggttacttgcaagctaacaggcctcacacattagaacttcctatagtggttataaatcatgctttgataactgatttattatctcacatgtagtctattagagtccccaaaatctaacactaatgtatcattaaatggagcttcttggcctcagggatctagaaaggagtggtaggaaaagtatcaggtgctcttctttttttgagggaagttactttctgtagttactaagttaacattataatactgtgaaattgcagttaataggccagtcaccccatcaaagaaactcacatttttttctatgtatgactccaggaaaaaaacctttctccaattctcctcaagtcgttgaattttaataggtagctaaggtatttgaatttatttttcacaaaatactctatatagcagtatattaaaaagtgggattctttatctttaaaaatccttctaatatagagcattttgaaaagaagaagagttagtaggcagagaaggccagtgtcaataaaagaaaataacccataggaaggcacatgaatagtttaccgtgcttcagtgggagagaggggatactaaacacattgctttagttgcattttaattcatcctcttcaactcctaagtcctcgcaaatggaccattgtttcagaaattactcaccctaagtatattttctgttaaattaaacagactctgctttatctctcttctaaggctaattaaactcattaataaaacattacataaagaacttcattatccttttgttgtcacttaagcataagtaggatgctaatatcattctaaaaggagcccaaggatttattctgtgccttttaattagatgcatatctttggaattttgctaaatttttaagatgagaggtgggtagaaagagaagggaatacagaaaagattatattcaacagaatgaaatgcacacatcttgcctttggcctttccttgtcttatattacagcctcctttcctaagtacacctccaagaaatttattttttagagtgataagtgttccgaattatcttacatagcttcctattttcacttggtttggcaaagattttaccatctatgatcaggtgatcttacttcccatttagatgacattgtggggttcagggatcacacctcattctttttctttggctgctgccattgattgatttagcatttgtcactgagagattaaaaacatctttttatcaagataaacaggaaagtgtggagctctatgaatatttgttgaatgaatgaaatgcatgcctaatttctgccagtttctaaacaatctgtgcatatgtccaaaagtaaacaaggacagactctgaaaaccatacctcaagaacttaggagcaagccacaatctcctgaaatgtgttttgtggaggttcctgatttttgagatttggaaagctatttcctaagtagcaacagtaaaatggagacataggaaaataaaccaggctccatatttcagaatcataggttttctgaataaacgtcatcagctactgtgggaaaggaagccctcagagagaactaatccaattattaaagccgaagctttcttccaaaaatcacacagagcagttctttttaactactacagttgtttagcatttttatatatgtgatgcagcttcctcagcctaaaacagagaaataaaacaggcacccgtattagttcattcttgtgttgctataaagaaatgcccgagggtcgataatttataaagaaaagaggtttagttggcttacagttctgcaggctgtacacaaagcatgtgaccagcaactgctactggcaagggcctcagggttgaaggtgaagggagtgcctcctgtcacatggtgacagccagagcaagaaagcaacgaggttgggggagagcaacggaggaggtgccatgcacttttttttgtttttttaagacggagtcttgttctcttgccaggctggagtgcagtggcgtgatcttggctcactgcaacctctgcctcccgggttcaagtgattctcctgcctcagcctcccttatagctaggactataggtgtgtgccaccacgcccagctaatttttgtatttttagtagagatggggtttcaccatgttggccaggatggtctcgatctcttgatcttgtgatccacctgcctcagcctcccaaagtgctgggattacaggtgtgagccaccacgcctggctggtgccatgtactttcaaacaaccagatctcacatgaacgcatagcaagaactgcatagacccttcttgaggtatccacccccaaaacccaaacactttccaccaggccccacctccagcattggggattacatttcaacatgagatttggaggggacatacatccaaactgtgtatcagtacctgacaagatttcagcttaaaacagagagaagaaaacacagagaagcccataagtgttagctccatgaattttcacaatgtgaacacacccgtataaccagcttccagttcaagaaacagaactttaccagcaccccagaaagccccaccccgaccccaagaataacctcttcctaattttaaataccatggattagttttgcattttttgaacttacataagtggaattgacctttgtatctggcaacttatattcaatatgatatttgtgagaatcacaggatgttgttttattacatagcattctccttatctacattgataacacttctcttgagttaaacagtgcactgtatctttttagccttctgacgaagacactgttagcctcaatgtgccaatgtcaaacatcatggaagaagaacagatcatcaaggaggactcgtgccatcgccttagccccgttaaaggtctgagaataaaaatgtggagaaagtgcttgtttttcagtttcaaatgttatgtttaaaataacctgtgcacagatagggcagtgataatctttctagagtatgtcctatgtaccaggtactgtgttcttctgggaagttgagctgatttaaaatttaaaagtcaaagatggatactctaatcatctccattttataggtgagaaaaccaaggctcagagagtttaagtaacttgccattggtcacatagctgatatgtgtgtagtactacttcctacggtacatagtagaactaatctcattctgaagacttagataaaattctttttttttttttttttttgacatggagtctcgctctgtctcccaggctggatggagtgcagtggcgtgatcttggctcaccgcaacctccgcctcctgggttcaaggggttctcctgcctcagcctcccgagtagctgggattacaggcacctgccaccatgcccggctaattctttaaatccattcttggaaagaaaatattgatatgatagatatattagttaggaaaactctagctgccgtaacatagattcccaaatctctgtggctcaacacaatccaaattaagttcaaatggagttagtgattggcagacaactcccctctgagtattgatttaaggacccaagctcctttcataccatgactccatcatctttaacacagggcttccaaaactttcatgtccatctgttttaagccagaagaagagcgtggaggtttgctcgtgggaggtttttatggactgggtctggaaggagtgcccatcactgataagctagacttcatcccatggccacatcgcactgcacatgagggtgggaaatgtagttgaggtgtgtgttcaagaagctacttgactttggcccagtcaggtgaccttgattccctcacctgtacatgagatgattagattaggtaataccaaaggtccagtgtagcttgaaaattctgtggctctttaataatcatcaaatgaccactaaacactgtcttgtgtgccttcaagatccttgtaatacgtttcatatcttggttggaagccctcattgggtaacattaaggcgattttttgattgcccctgtttccccatgacttttaaggaaaatacaagcatttagttttactcatttgtggcagagactgtttcacaatgtataaatagtgcagaactggattaatatacagatcttctcataaatagttggaatttgctcttattcatgataggagagctgtttaagttcactcaaaccttagtgttggctttcacttcttacacttcggtttttaagtttagcatttctgtttacctgagattatcatgggaaccatatgttgtctaaaaacatagctgtatgctttatatacaaatataactgccactttattaattcatataaagttagtaatattatacactgtaggaggtagtattttaggcaaatttttcaaataaaagaattatgtaatttgttactagtgggtgttccccctctcgtctagatgtgggtattgcattggctcagagtgtttaaagggtggcccagtatggttctttttcatcttcagaacagttggaagagttctgcagggtgttccttttgctcccccacctcccctggaacacattctaggtggaagtgccacatctgggcatgctgtcacctctgtgtggcccttcttgtagacacttcttttgctgttatgatttggggctcttgcctagttcccctcccacattcttccttgagattatttgctgtttaaggacaggagtcagatttggctgattttttaatccctaaaatgtttagcataatacctgccatttagtagctgctcaatatttgttggattttaaatatgaaatacatagtaacatattactgagggcaaaaaagcctcttttatactttcttttctccattccttaaaaaagtaagagaaaatctaatttttctcatagggaactgagcccagagaggccttgactttttaagctcagtttggggctttctggggttattttatttttatcttttcctccctgcagggaagagaaaacttgggtttttcatataccttcttcatagggaacacagaagacttgaagtgattagatcatatttgaagatcagctgtgttttgctcttctgttcatgaaatcatgctttccatctctctatattttcctaataggggaatttcatcaggaatttcaaccggagccttcccttttgggtgacagcaccaactcaggagaagaaagagaccagtttactgatagagcagatggtctccattcggaatttatgaactataaggcaagattttcaggatcaactacgtttttttacttatttccttctgtttggcaccgtacaatttaagttgaaggttgccaatccatccccttcaatgtccagcttgctgcaccctccctgaagcgttccaaacatctcagcgctcagcgtgtctatttgctgatgtgaggagctggtccctgccctgtgtgcctctccatttgtctgtttatggatctgattttctttccgctactcagtgcatcgtacaaattagcaaactcattagtgtgaccattgccacgcagtaaaagctgaaatagtttcacattcttttcaacatgttctaggtaaatccttttcttgggagtatatttatagtgtgaagacaaaagtggagacttttaaaattgataaatgaatgtctttcctttttggaaagatctctctgaggacacttattcctgaacttttgtaggtgccccgaggcattgaaaggacaggtgaagttgccgagttgtcaggaaaaccttcatcttggcagcaacaaagggaggaaagaaaaattagccctttactgaagcagatactgaaggttctacttcacaacccgattaggtgcttggtatgtttctgccagcccttttggttcaggttgtggtgcccaagaatcataaagattattgtttttgtaaaattcagattcactgtggcttcgaggtaacttctgagttattatgttgaagccaagaatgggatccctaagtactcatctttattttctgagcattgtgtcctgatggctggacccagcctaaattaacatctctgggcatcaccttcaaggaaatggagaggaaaacagctgaattttacactgtaggagaccttcgtgtgctcaggacatgtttatggcctccagataaaaataatgaacgtgacatatgtttatagattacagaagttgtgtagaaggataaaacacagtcttaactctttacttgctatatttaatgtcattaatccatacatccttgttttaaaataggtcacacccattgccttgtttctgtcccctgtctccattgacattgcttcatttgagcctcatagtttctcactttgattacttcaggcaccaccccgcccactccacttcttacccaatgctgcacccgcgtgcatgcatgcatgtgtgtacacacacacacacacacacacacacacacacacaactctttatattctgccaccaaacatttttctaaagtgcaaatctaatgacattcctctcaggccactggttctacaaggcttccccagattagaccctatctatcagctctgtgggacgattcttccatgaaaatgtgaaaattggagtatatcgagcattcatcttaagttaagaatctaaggtaaagatggaaaccctgaagaatgtgttaagaagatatcagtatttaagttctagaggaaacaaagcagttagtaagaataaagcgtattgtttcaggaaagcaaatttccctggattcagagatttcaaggacttcctggaaatggctgccctacagaatgggtcctgtagatggaaactagaggagcagataggcgtgtggaagtcaacttggcaaaggctttctggaagatacttctcttggaaaatcaaaagaaaaatgttaatgataaaatgaacatctacaacaagttaaggaaaaattgtgcttgaaaatcaggcccgtattaggcttgatatccatcaactttaagtctttcaacctgtgcttggcctggcggagtgaatcacacctgtaatcccccactttgggaggctgaggcaggaggatcacttgagcccaggagttcaagatcagcctgggcaacatactaagattccatctctacaaaaaaacaaaagctagctgggtgtggtggtgtgctccttgagtctcagctactcaggacactgaggagggaagatcacttgagcttgggagagtgagtcttcagtgagccatgactgcaccactgcactccagcctgggtgaaagagtgagaccctttctcagaaaaacagagttctatgctttacataatcctgttttctttactgaataagcatcttggacctttgcaaccacagtcaattttcattattcacagcagttatgttgtgtgacatcactgtgcatatcgaattatccaatactgagccctaactcactggggaaatagagggctgggttcctgcaccctctgctcacaacgtttttgtcaaccaatcagcacacaaccttggtgtgtgtgtatttctgtttaaagataccttatttaatatatattgttttgatgaacattacaaccataccttatttaacatatattgattgatgaacattacaaccaacagcactgtaactcatgcccgaaggaagcttgtctaacacacgtattgtcctctgtaaggcatatcacaacttccttgggcttctgaacacaaggcagcacttcagtactatgtctggggccattttaaagtgaaatcaccaacaaaaaacacaacagtgtgaaaacatggcactaactagactgtgaaaaaggacacttatttacaataagagagctgaaagaagaaagcagagtgtcaccttgttccacctcatctgggaacatacacatcctgggactcaaattttttaccactctgtagatgtctgcagatgacctccagagcaccacaaatactggttttgggactaaaaatacatgttggtgaataggcaaattcacaaatgcagaatccacagataatgaggatcaactgtaaaaccatttagcttagcaaaagcaacccagtacgcctgttttgcctaatgacattttatactattggctacttttagttgtgaaacaaaaaaataaaaagaaataccctttgcttctatcattgaaacccaacaaaacgaagtaagaacacgttgtcttggtcatttctggtagtatatttttacccatgaatttttctgtcatttggagtgtggagagtggcacagtcttttatacgttgactgtattgtacatgaaaagtataatcactacagaaaaagtccaagtgtgttcccagccagagtccagcattgggcagctagccatgtccttgggaaaagtcttgtcctaacaacacatctggaggactggctggtccccagttagctaatgatatgccagaaccttgacaccaaaaatggtccttttggctggtgttctctcctagctagggaaatgtggccctattcaggctggctttcattctagccatgagctgggttaaagcagcgtttctctgtgtcagagatgaacgtgcaaggaggcctgtggaaggctcatggtggtacatgactttccaaatagccagtgtcactacattgccgctttgggaaaaagtggggtgacagtgcagggagaacatttgagtgaattctggatgttgtacacgtgaaaactattagatgcaatcagaagcacttttctgttgttaagaatgttacactttctcttttccccactacacacatatgcgtgcacactcacacttaaacacacatccctgctctcacaaacactaggatgcatcttcacaggtgacccacaagcacaggagagggatctctcaatacaagaaggtgctaaaagggcaataggaaatccagtaaagctttaaatttctgatgataagttaacagatgctgtggtcttgggccacatttttttaaatttaaaaatgtttaattatgggaaaatacttacaaaatgtacaccttagccattttttaaatgtacatgtagttcagagtgttttaactacatttacgttgtgcagcctatctccagaactcttctcacttgcaaaactgaccctgtgtaccctttaaataacaactccctcgttccttcccggcagcccctggcagcaagcattctgctttctgtctggatgaatttgattactgtagacacctcatataagtgtaatcagtacagtatttgtatttttgtgactggcttattgcacgtagcataatgtcctccaggtttatctgtgtgtatggcatgcatgagaatttccccctttctaaggctgagtaatattctagtgcatgtacataccagatttgtttatctgtccctccatagatggctgtttggcttgtttccagcttttggctattgtgaataacgctgttataaacatgggctgggcaggttttggctcctgactactgagtagccaatggttttcaggaaccctgtgtgttttgtccacaggcaagggcagaagactgtgaagagctgttacggatagaagaggatgtgcactggcaaactgagggcatgtgagtgccgaggccttggttacaagccatcatcactcaaatccactttgcaagcagtctggcagttctgttgtgatagaattttgacctgcttttctgtgggcaagctgatattcttacagacaatattgataagaagttgccagtttttctctgtctgatgctttttgtcgtggtattgggcagtacaaacctcttacttggccttgagtcttatttgttttgaggttgcgggtagtaatgtgatttcagagaattagctagaatttctagattggaggttctaccatccatacaattgcctgaagaagccaacagctgggcctgaagtgatctgtagcgctgatctccttctttaccccaagtcatccccttcaagatctgagaacaccgtagacttctggtcccaagacttctaactgccagagctaccatttattcaacatcatgtgccaggcattgtcctaaatacttgacaggccataactcatttcatctttacaacactcctaacagataagttctgttcttgtcccgcatttcacagatgacgaaactgaggcacagagagattgattatcttgccgcaaggtcacagagggccagcatttgaacccaaggaatcttgtaccagacagataatccttctactctattgtgtataaatatttatttagcaagatttacaggggagggggtgtgtgatcccatcagacaatgaatcatgtccaggggaattgagtttggactgtgtgacatagagtatagtttttgttcccaggatttttatttctataatctgggaggcaggtgttgactctccatcataccttgcagggtttttcttcttagtgaggatttatcccattgttaaaacttttctccttacagaaagtcattggcttacattctatggtgggaagggcttgctgtgatcaattctctcttgccctttaaaaacgttggaaagttcctctctggtcacggtctgtattaccagctactcactggatatgctgctgagagccacggaggcctagcttgattaaacaatcagagaatcatagggaaagaggcacttgtttttaaactatataacgttttggaaactccattctcaatctcatacctagtgctttcaaccctggctgtaaaggattatctgtagagctttataaaatgctgaacccctagtcagacccacttggacatatagggcctggcatgttttttaagctccacagatgattttgctgcatctagagtttggactgagaaccactgtcccacactgaaaccctatatgcatgaaagtaataaaactggttgaacgggagttggaaggcccagaagtagtacagactcagccaggtgatcccctccatgcagccccctagaactcagtaaagcacaaccgtgaaagcctctcatctaggccattgcctgactgtgcacaggggcagttaggggtgcacaggcatgaaaatcttatgtgagctgctttacagcagagctgggcttcccctactcgggctcttcccaccgtgctctgccatcccaccccacaaggtacaaacacattttcaccataacactgaatctgtcgaaatcattttcatatgttagatggatttttgtaagtttgctttttaagaaattagatgatattcatgttgtattgatcgttttcattcttatgcttggtttcacgttacagaataagttcatccaaagatcaggacatggatatagcaatgatcgagcagctgagagaagcagtagatttgctgcaagatcccaatgggtgtgtatgtctccttggtccaggtttcatgtgtaaataatgcatactaatgtatggagtacattgtctaaattcctaaaatacctacacagacgattttggcccagtccagctactaacaaagaaaagtcatgtttattgcctgttttcccaagatgcaaaagtaaaagagtcaaacttctggagggagtgagatcaatttcccctttcaccaccctttattgagttcattcacccctcatgaagttcatatgggagtttttggtaaaattcttagaaaacaaaaatatggtaaaagtgcatgttttatattgcttaaagtttaaacccctgatttataaaaaatataaagaaaatgttttccaaaaaggaaagaattggtatatcaagtagtactgtatttatatggggtagtgccaaatatatgttaactgaagaatatatttctaaagatttgggatacaggataattttaaaatctgaatttgccttgatcgataataggcactacattcagtggatatgtggataatatttttcgatttcttaactaatggtaatggaattcccatggacaaaatatttttcagctaaacaatagcaggtatcatgtatcgggtaataactacatgatctctagagaactagaggacttggtaaactgatgtggtcttataatatgatgaacacgggaatcacacgcagcaatcctagctgggttctgcaaatttatgaaaagcgtagttagtgtatcccagaatgctgatgagaatataccacctatgatgtctggccctgaaagaatagtggcggatcagtttagtacagctggaagtcttttgcaattgatttgaaaaacatttcaattctgcagacattaattgagtgcttggagtatgggaagatctgcagtgtgcaccttgggggatgtaaagatggacaagacacagctcttgctttctgagaatttagaatagatagagattgccttgagaagttataagtgtaactgggccaggcgcggtggctcacacctgtgatcccagcactttggaaggccaaggcaggcagatcacttgaggccaggagttcgagaccagcctggccaacatggtgaaaccctgtctgtactaataatacaaaaattagctgggcatagtgccatgcgcctgtaatcccagctactcaggaggctgaggcaggagaatcgcttgagcccaggagacagaggttgcagcgagccgagatcgtgccaccacactccagcctgggtgacagagtgaaactgtgtctcaaaaaaataataataaaacaaataaataaataaataactgtaattgattcaagtgcttcaagtggaggtaaaaaggatagactcgagcaagtgcccaaccccaggaaaaggggagatgggtggactggtcttcctgaaggataggataatggcctggacctttaatgactgccaatttcaagaaaaagagaaattctggattgaatgaaaggcttaggtaaaggcatgaaggtcagaatgaatggagccaggttgggaaaatctcaggcagaacagaggctctccatcctagtgtgcttcagtatcacttgtagaactttttcagaacagataccaggcacttcctttggggactggagtcagccagtgcttctgatgtgcagccaggactgcgaatcaccagagacagtgtagaatgatgcaggcgatggctttggatgttgttaaggagctgagattttaatttatatttagagggaggcaatgatggtgtttaaacatgattattcatgttgttaattctcccttatgtttggctcgtggcataggcacctaatcaaggtatgttcaaagagttgaattctacatcccaagccggggcagttagtgaaagggcaggaaacaggacaggagagcctgtatgtgtgtttacgtgtatccatgcatgtgtatggttgttcatacatgtatgttagtacatgtaggcatgtgcacccgtgtacatgtattcattataacgaatcaggaagtagtgtggcttgtagaaagaacagactttgaattagctagaaactttttaaacatagctgcaccatcagttaacttgggtaagttgtatgacttctctgcatcccatttcttcatctataagagggggtgacaagtacctaccttttagggttatgaggatttgaaataatacataaactgccggtggagaagtaaattggcaaaaccattctagaagtaacttagtatgtaaccaagtctagaaacatataaaacttcggagtgaaatctaagaacttatcctaagagacaagaagacgtgaacaatttggggaatttggggtagagaatgaggggtaggtatttttaatagcaaatatttggaaaaagaaattatctaacaatttggggatactttaagtatattatactctttgataagacagaatgtgatgtggccaatataatgttttttaaagtttctagtgatatcacagaatgcttttatacttttaaaaaagtatataacttttttaaagtatgtaaaaacgcacaatgtttggtcccaattatatagatagaattaggtaccaattgtgcaggaaatttagaaaaactggaaggaaatatattaagatggattttaagaaggaaatatattaaaatggaaggaaatatattaaaatggaaggaaatatattaagatagtggaagaaaacattcccaattaaccttccaagtgacacttgatttgcatctttatggagcactattttaaaatactatgttgtaaaattttatatggattctttcattttctttctaaaataatccactactttggctgctttagatcattgttatttatcctgaaataactattataatatgacatctaattttataatagttctgtgagccagtttaatagtcatgaaaagccctggttttgttttggatatagagaggacacttgaagatgtcatttatttctaactactttggggctgaatattagtaataaaaaagtttacatacacattttgttttttcttttatctcacatttcatagatccaggaatttttttcttttttagttaagccattgattgtgggattaaatttttcaagtttaccttttatgcatcagaaaatttagttggctattgctgttctgtctttatcttgatttcttctcttaaggccttctgattgttagtttgacagcattttcataggcctctataatataaatgcatccctgtttaagatgactttgtaaattttatataacttacagaaattcctggctttataggtctttaagaacaaaaaatcttcatctcttaaaatagcagaaatttagaaactgtttgagactatttcagaagtaaaaatgcatatcaaattgcttatgatttttttaagtgagagatataatgtatatctccctattaaaaccaaatgccattggtacatatactataatgtaatactctcagcaacttgacttgcttctgtaaattcataaagttctaaaataaaatttagtatatgctatactacctatgaaaattttgattttattagaaattactattatattacaaacaagttggattgtattaccaatagcagatggaatattatattttggcatgcagtgggaaaataccatgcactttgaaatttctgtcataaacttttcctcacttaatcctaaagataaacataactttttagtaaattaaaaatttaaactgaataagaccaatagaatttattaaaaataaaagtttaatacgtttactaatatctttttttcctactctttagattaagcacagatattacagagagaagtgttttaaacctatatcctatgggatcagcagaagccttagaattacaagattctgcactgaagtatgcttgccttttataacaaattatgttttctcttttcataatacattgacatttctatgctttaaatttcactttgtatcttttttttttctttccttgttctcacagtggtcaaatacagctggagacatctccggtgtgtgaggtaaggctgctggtagattcaccagaactctgtgcaatattttgccatggaatactggccaccacattctgtaaagatttgtcagggagtgaaacatctttattaatgaggccaatattcagatttgttcaggacacatttttcaacttgtttatacgtttgcctctttagttctgcttttctgctatacctcaccctctgttgaagatgagagttggctatttctattagattctgtagattttttttacctcagatcatcttgctgagtcaagcgatggcaactaaaatacatagggaatctgcctgtgtgtcagaacctggaggaggaccattcaatgtagattttagagccaagaaaaggtctgggaattggccagatggaaattagctagaaaacacctgaaagacaagaacaaattatttgggaatgtcgaggaggattgagagaatatcatgaagagaaactggtggtgatatttgaagacagggtaaggatgggttcagtagagttacatggagtgaaatttggatggctgtaaagaaagcagttttgacataacactagagatgaccttagaatgtcctaaagccagaatgttaccccaggattagagagagaagttcgagctggtgatttgggaatgaaacataggctacaacccatttcctgaatggatttaggatggctaatttaggcaccaagattgtgtacaaacaccttatgccccactgaggtgtttgcacatgtactatagtaaagcggtttcacgctcttaactttgtctctatgttaaagaaataaggaaaagggaagtattaatgtaaaagggaaagccatgttgctagagagtgtggtttcattgttaagcgcagcgacttggaattatattaggtatcagtcccatctcaaagactggctaactgtggggaacttaacctctctaaacattcattactgtaattgggatcataatactacctattgtaaagatcgaattaggaattctgattcagaaaatgtcacataatatagggtacctaaatgttagctattagcttacttctctattattgttattggtgtggcctttaaacagaattactgtaccacctcttccctgggtggaggcctcattgaattacccaatagtgggacattggaagtcttttatttgcagtctcccctggaccaatttcatcaagctcttcctttgagattgattttggttctgtgcagacttaacctcttttttagcttcttatttggaaataatttttttaatttaattttattttttgagagatgagatctcgctttgttgcccaggttagtctcaaactgctggcttcaagcgatacttcctccttaacttctcaaagtgctgagattacaggtggctcacacctgtaataataattttaaacatgaaaataattttaaacttataaaagttgtaaaaaaatttgcagtgttctacaaaagcttgcaaaaatgataatcttgtaaaattagatttactagtaacattttatcacatttgttatatttgttctctttctctctctctctccatacacacagttctttttctgaaacacacacaattcttttgctgaaagtaagtttcacacatcatagtcctttatccctaatcattttagtgtgtgttttctaagaatatggatttttatcttacacaatcaatttcagttatcatcttcataaattcatggtgataacatattttcatctaatctatcacccatcctccaaatttgtgagttaatctaatgatgctcatcagagcatttttttcctttcagtgtaagatccagtttagttgcagatactgcatttgattgtcaggtatctataaccttcttttatctggaacatttccatgacctttctttgatttttatgaccttgaaattttgaggaacacaaacctcctcctttttaatagaatgttcctcattttgtgtctgtctaatgtttccttatcagtttgaacttctgcattctgatttcgaatactgcacaggtgatgttgtgaccatctcagggcatcacatttggggccacacactatgtccatctttccctctttggtgatgttaatttatcacccaatcaagatataagtccatttctccaccgtgtaattgctgttttattttttcgttgcaactaacaagcagtctgtgacaagatagttcaagaccatcttagcatccagctgcagacccacttttgactctagtaaaatagatggccacctgtttgcatgatttcaggagcacaagaaagacacaaagcttctggaataaagatatatcccctccatttttaatacacaattggatggtcattccaataattttgtcttctaagatgtatatattcctgaattttttttaaaaaggaagtattgttacatgccagatcatgtgctttgtatattacataagttatcgttatttcatttcttcaataaatattcgttgattgcctcccatgtgtcaagcaccactctggacactgagaaagtagcattaaagacacagaggtcctacacttacgagtttacattctaggtaaaggtataagtgaaaagtgcatcctgagtgatgatgcaggatttgaagctcaaggtcaagtgactggccagttcagttacatgtaaaaggcgtggccctgctttcccactgtggtatattgcctcttcatgctgtagactagtggcagcactaagtcttgtcatgcttacaaaccttagtgatgcctgattgcatcaaaccttttcttcagagcagatcttggcagaagaagagcggccattatacttatgtgtgcatgaacaatgcttccagtaatgtgaatgggtatggaaggaataagggatgggtatatactaaatatagactgagcccagttcatagttttgtctaggtctagttttcatcccatcttttttttttttttttttgaggcagagtctcgctcttgtcgcccaggttgaagtgcacaatctcggctcactgcaacctccacctcgtgggttcaagcaattctcctgcctcagcttcctgagtagctgggattacaggtgcccgctaccatgcctggctaatttttgtacttttagtagagacagggttttgccacgttggccaagctggtctcaaacttctgagctcaggtgacctgctcacctcagcctcccaaagtgctgggatttcaggcatgagccactgcacccagcctgatcccatcttttaatctaatagcaatacatgcgctgatttactaactacccaattccaatggttattagaaattgctattgttattcaacattttggtggtttgggaaggaatgtttaaatgtcacatttccttaatatcagcccaagactgttttatttggagcttcctcccattttcccatcagcaaaggtgaactctatctttgcagtcagttctagattttcaaaatggattcgtacttattgatctcctctttatttctcctgttgtttgtctttctcattgcatagcacaaacacttagcattctcacttgaagtgggacccgactcagtacctaactactacacagtgagtagttcgtgaggattcctggaagggagggaagaagagagggagagagataggaaattagatgatgaggattaggctttggtaagcaaatttcagtgtactgcttatttgatgtacagatctctgggtcttaactgatagctgcaaacactccatcatttaggtaaagtgtatattatgtccctttaaattcatttccttgtgtttgtctaaattgaaaatcatctgacacttttccacatgctcataaagcttcatgggtttttcctgaagtttaaccatgcttgctaccattatattatgtggaaaagcctaatatcctcctaaagtaggaaacttgacttccaagtcatatatcaatcattcagtcagttggcccagcccagctttccctctaatgatgagtctgtttgttccatcagccaaggccattaagcctgtaggtgttgagctgcagctctgcacaggtcctgtgctcagtgctgtgagggcctccctgccagctactgcacccttgcctccagagtgaattttctgctctaattgggcagattgtattactcctctgtactcacagaatgtaccaggtccaaccttccttagcacctttattttagcatgctacttaaaatgtctttgagctttcactctcatagagttttaaaaacgcatatatacctgtgcccatgatttcgggagtccctagaagacagaaaacctcaagaaaaaaaaaagatacttttattctatccccaacttacaatgttttgtgttattttaacataaggttgatttttttttcttttttggctgaaggaggagtatttggtataaggaattctcactccttgttttccttctgtagggcaattatctgtccttggcagatacatctctatgattttaaaaaaggaggggaatagctggccctgatggaaaaaggaagtcacaaggaaaagaaaagagagtagtgaattcacagggccagtgataaggattatggagagctaaaatatgatccttacttatgatttggttatttttatattctttcttctgtctcattcaagcagaaagtaacatctttcagcatagccctatattaattcaccagtatttgttgagtgcctgtgctagattcagccttgtttttgtgtaaaggactggaagatgaaggctatgaagttgccctcactttagtgaatttttttttaattgtgggggtaagatttagatgttgaaaaatttgcagaagaaataagatggtctgcagtcctgagcttgttttaggtgctcagggacactggggaaggggtagagtttaaggagaggaaagtaaacttagactttgggcatttttgggtttggccctgtagccaggaggctatgttgagcaagacaccgtggctgtgggggatcagctctgtgtgagccacacggaaaggggaggccaggattatgaagcggtttgtaattggtggcacatcacgtgatctgactttaaacatactttaggtgactgtccacatcaagtgtggatggcactggcatccatgcaggaagaattgcaaattgcatggctcatacataaatatcgaacggggaagggtctgcgagacgataggacaaactagaggaaagaattgcttatagaaagaatcaaacctgaagttacttgttagcagctctaacaaagccatttgattgaatagggatatttgtgacattttattctaaaaatatggtttcctcttggatttgtgtcaaaggtgggaagatttttaaatagcactcctcaacaatgaataggaacaggcatcttaaatgtacaataatttggtggcatatatgaaggtgtttttatatgagctaacgcccaattttttattagggaggatcagggggttcttgactaccttataaagaaggcagatctgggtaagaaactagagtgtgtcccttgtgggctccttgtttctgcgtgtccctttcatgctggttttacaagattttgctctcagccactgtccctcaatttcttcactgtctctgtggaccatctggccactctcatggactcaggcaccccataaataataataacttcgaaacctgtagctcatgcctcaggttcccctctgtaccccagtattcagattttatctccatgccccacaaatttctctttctctacatagctaaactgatactatcaacttcttcttaaactgctcctgtgttctccgtggtattcagtgatgctaccatctacccagtcattcctgctggaaatcgggatgtcatcttgacttttctccatgaccagttataaatcctgcacattttatgacagaaaaaattcataattttttctcttaaccagtagttgccaaagtaatctgatgttgaactgacaacatgagatttgcccagttaatttggggtccagacgtgtatttattgaatgctcccaatgtgattctgcatatttaggaagtactaccttgaaccatttctaaaaatcataattaaaatgaggatgggaaccagcaggcagcttggtcacctagcaaggtaagctgacatccacagatattttggagtgaactccttgctctgggaaattctttatcttagtttgtataatactttaaacgtatttttctatgaatacagctgcatgttttcagaacgtatgagtatggtctacttagttactgaacacactaactaattaattcaacagatattcattgtgcacctatggaccggggacatgatggcagtaagaaagatgaatttcttgcctcaacagtttcacagtctaatggaacataccatgctttgttcttcttttttaaggtgcaaagtgatctaacattacagagtaacgggagccagtattctccaaatgaggtaagtttcttgaagattaatggaaggtgaggtgtttcttgatggctggattggaatatcttttacagaaatatataatctaagacttgtgattaattaattaattgagtctttgggggaatccgtctaactctcattagctatcatagctttatctggtcctattcgtaattaaagattaatttttatgagatatatttttaaaaaccgaatgtaggaacatctttacaagaaaacagaatgaagatcacttaaataggaaacatttagaatgtcttgttctccataaatgattcagtgtgtgattcagtattactgagttcagtattatctgtttcctcatcagatgtgccctcttttggatataaatggatatagtgtgtgtgtgtgcatgcacccatgcacacagctgtgcaagaggagtgccagtgtcacgtaattgtaaaatgttcttaaaatggacaaaacaaattgagtgggtcactctaaaacaaacattctgttggttatgccatttaacatctttacaaagtgattttttttggccaggacttcatcacacagcagcgaatgcaaaaagggagtagttttgttacaatccttgaacatagaaaaccatacatagttcttctgttttccttttatttttttcctaatttcctttccttccaacaccacagattagagagaactcccctgcagtctctcctaccacaaacagcacagctccatttggcctgaagcctcgatcaggtaaatgaaaacctcagcccattcttacactaaataactcattgctttctcttgagccttttaagtgtatgcattatcaatgtgcacatccttgtcagttctgctgagccgaaatcctggcatctacagctaggggaggccagagtttgtagctttgttttcagtgaatcagctaagtccgtgttatcagtagtggatattctatcttcgtttgaatccgagcaaagaaaaaacaggtggtgggagcatgtaagcggggaagaaatattctattgatttttttttacctaaggaagataaaatagctttggccccagtggttcctgctgctcggctgagttaaggggcagcctgcctctggaaaagtgactcctttctgagacatcctcatttgatttctgagtctggtaggttctgtgtgtttactcacataacagagtggtcatttcaaggcttgcatgagtggtcaggagttacttttttaaaaagtcttttgagaaagcattctgcttatattaccaattttaatttgttattagtttattcacaaaagtaaattatagcaatgtacaaaataatggttgcttttgaaaagaaagtactctgtatagaaaaatttgattcttctgatttctccatttatttgaagttctgttgctaatcttccttcttttaggtctttctttgttttaatatttttgactctttggtatttagtctacacttactactgatgcttttaagcaagtgctaataaagaattcagacgcttttaaataagaactggtagagaactcagatgttcttgagttctccagtaaagcattttgacaacagtagaggttatacatgtgtatattttgcaaaaaggcacccataggaaaaacaaagatgattctttaataaaggaaatgtttttcattcttggggcaggttgattgatgggtaacaagtggccaggtgtaatggtttcctggcagtttgaatgggccatagaagaaaagccatttgagaaagtgcttgagtgtgacaagggttagtgagtgttttatggagagccaaattttacatgaaataaaactcaaatggctggtcttctcatgtttggagctaagcaaatgtgatcagttccgggctgaggcccttggctgggttttcctttccacggtctcaggtgtgtcctgggaggaatggaggtgagtccaggcacacctcatctgtgccttcagtgacaacccaccaggagacttattttacacgctgaggacctcatgttgagctgcagactgtctcctaatcctcacagtcagttttacacagtttaaaagcatggcataattgagcaaatcaaaagttgaatggatcttcagagaataatattcttttgaatgtataacttgcaattgtagaattattttggtgacttttttattctttttatagagtccaaactcaacttattacagttagggtttacattgtactggggctgttaaaccatttcacattctttgtagcagtgaaaaataaatggagcttttattttgaatagcagaaaacaaagttaatttcctttccaagcttccagcctttctataatgctgactaaccaatgtggaaattgttcttgttgttgaaagctctatggagtttggttgctgtaaataatgctgtttaccttcaggatcatcaagtgacatgttggaactttaaaaacttgcattatgtatggaaatttatttcattttatttaataattttaaaatagtatatatgcttaagtgtatttttcacattttctggaaagtaatatatacagtaatcttaactggaaagcatatagttttaaaagaaaccacttttgatcgagtagctttagaatgcttaaagccaattaatttttattttgaaagtatgtggatttatgtgatttctgtgttataaataaaaacagactgcttaaattagcaagttcaaataagaacttagattcttaaagtaggctggcagtttctttcatttctttctgtgttttcctcccgaacaaagacaactgcacacacccaaatatttatatctagaactatatccatttattttaccggccctgccttatgattgaataaaaaataatatagatatttcctaaatatgaaattgccatatggatatttagtgcaaaaataagagttgttatcatttcataagtgaccaactcagaagttcttgaaattgattgatctctgttgattaattggatttgttgttaaatagactgtactagtctccaacattttttgttttttgttttttaactgagcaatattgaaaacagtatttagaggtatgtccaggattgagaaaagaattagctagattcagctatctataaagcatgccaatagacctacaggtgtctttaaaaagaaatttgacattgctttggagaaaaaaaatcactaatggtaaatgatgattctataatagttttatttctaaataatagatatatttacgcatattaagttttattctatgtcaccaatttttttgtgtgtgaatcatattttgttagttttttagaaagtctttgaggaacgtatctggcaggtcttttgctttttatctacctaacctatgggtactctttctttcctctgacctgattcattagtactctaagtctgtgggcttgcagaactgttaagattaacaaatatgaactgcatgcaaagtgtatgattgatgggtactaacactcagtttttatcattctttttattccatgcaccatctttcattcttctcctatattgtgcatttgaaattaaaccccatataaatgaaatccactcttcatttccatgcaaaccctatgccatttgtgaaatgctgctgcccctttggtttttcctggtccttgtgcaactgtacgcggactggctctctggctcccctgcagacccagccctcattcttcctcctatctccttcaacacacttacacaggcacagacatgggacagctctagctacagtgttccatctgaaggagacagtgacaatggtaggtggctttgtacctattctccaatgttctcattaataagccaatgcgtatactgaacattcatctctgtgcagctgaagatagagtatattcacctgcatgcttggtatgagaaataatgtgtaagcctggaaagtgaagtccagaaaagtgcacgtggattgttctctagcagtttgtcaaactccagtttaattaacttgactattctggatttggggaaggcattataatactttcttttctccccttttctgcttgggttttttggtttgtttgcttgtttacaaatatttggggtttgcacatttggatttatctccgcttgttcctgcatctgaactaaatggttttagagtttgatattttactatttatgcttactgtgtgagatttctaaggtaattaaaatgtaccatggctgatcctagagtattgcattgaaaataatgttaacgtggagaaatttctgaaaatgaagataaatcatttgccttcttttttccaaattattggcatattttgacttttgatgccttcttgagtataggttcatctttttgacattcaaggatagtaacttggcctgagaatcaaatgtgtaaataaaaaatcgaggacactcagctagagttcatgtgggtatcttttaattttgaatcttatatagcctaagagattacaataaaacataattatttagatctgcacaccacctatatcgtaatctccattctagtctaatttcatcctagtctctgaaatattcaaattttaaacattttacttcagaatacaaagtgattgcagtcgagttaagtgaaacagagaatgtgatttatagggaagagtagtgaggtacagggtatagccacaatgcaaacacaatggaaagatacgttttctgataatatttatcttttcatctaagtatgttacatgtaatacctggaaaatatatgtttaagacacttgctgtgatttctggttaaaattcaaccaaaaatgcttctacaatttccttatggagaaagacaatgtatactttggcagagtagttataaaaagaatttttaatatttcatagatttctaaatttttaaacggaaaataaataggattaaaaaacaacagttattaaacaaatggccctccttataccatccagttgtaaattttggaagttgaagagggctaaatggaaactttcttgataaacattttctttacttaagtttttttttttctaatggaggggaggcatttttgtttttcagaaagtatagctatttatgggcctaatgttgtttaaaggaaataaagcctagaatgaaagatttatgtgtggtttggtatttccttaggaatgatatctgaaaccaaaggcctttttttttttaaaactgggaaacaattagtcttcttatgtagcagtagaattactatctttatagacgaacagactaaaaccagaaaggtgaggtgagctgcctgggtcacactgtggggttgaggtggaggtgaagctgcaccagggttcctaactctggaatcatctctgccgcatctacattcaggctgctttcatttgattaaaaatccttaaatttccacagaaaataatcattgtggaaatctttctaaaaataaaataaccttgcaatagttattttttctatgagtaaaaattccaagaattcacatgcagctgttatgctgtaccacaataataataaagccatcgttttcaatactcacggttcagtcgatcatgtcagatgtttggaggttgtcattttttcctatttgcaatttgtctctactatgccctgggcaacagaaaaatttctgtaccgaaatagtctttacaaatatttgtttaggttcccagatctgacttttatgtttatcttcattctctttgttcttaactttgacctgtgattggaatacattttctaatgtaatgctatctttgtaaataacctttataaataaacattatcttattaccagctcaacctaacataatgtaacttgacttttatttatacatttagttattatttttggtaaggttgtcctttttttaccttgctcactgtcttgctttatataaaattatcctttttttaaaattctttcaaatatcttattcccattctatctcattttaaattccccatttctctaaaacttattcttcaaacagattttttaaaattggcaacctgggtagaaggtccttgggagtttgagttctcaaagtccccaaagttctgccccataaggtggatgaaggaggatgtggacgtttgtctgtaggtttctctgggcccacccctggagctggatgggacagctttaacctccgtttttaacctgatagtttaacttctgcttttccccctgctcttgtgtcctcttactgaatctttcctcttcccttcactttgaagttaaaaaccatttctatcttctttggggtcatttttgctctttcatttgcagtgaatttgtaggtgctaatttatacttattgaaaattaatctttaagttatcaccagagaatggatgaatggaccagtttacattagtctctgaaataaccatgtatcttgtaccagtttacagatattttccttaattttttacagtaatcttgcactataggtattatttttcccattagagaaatgaagaaactgaggatataagaggctttttagtggctcttaactctggttttatattagaatcacctgggcgttttgtaaaactatagtcacttaggccccatagtcagaaatgctaatttatttggtgtagcattgagtctaagcactggtcatttgttttacttctttttatgggatgttatgtggtgttcaagtaaggttgacagtcactgggttaagtaaattgtctaagaccatagagaagaaatgtgagcattttgaggacaccgaatgtgtccagttcaattttaggcaccagaagggaatgaatgaatcagctagtgagagttctgattcacagtagcctggatctaaagctcgtgatattttttcaaagccaagatactgctgcctttgagtttgtatatcttaaacatcatgtccagttcaggttcttaacttccaaggagaagttgagagctacattttaaaacttcatgtttccacagagaagaaatctcctctcattcagttaaatttaggtataaatatttttcatatgaagatgcatttcatgcaataattaaatgagaaagtgcatttgggcaatttttagagcaaagggctttctttctttgcttgactcaaagatgttctcacaacaagtacataaatggtttcttgtacacatccttaaatatctgctgagtgcctattaagatgttctcacaacaagtacataaatggtttcttgtacacatccttaaatatctgctgagtgcctattatgtgctacacatgatgctcattactatggatgcagctctgaaagagacagccaaaatctctttgctttcatataacatttatttcagagtctaatgcattcacacctagaaactaagtttaggagattattcataagaggaaaaactcaggcgactgatcatcagaatagaataatctttgcaatgacgttctccaaacagactgagctttaagtgagggagtgtttgaaacgtttgtttcatttactcgttcaacaaactcattctgccccactcactgctttgtggggcaggaatagagggtacaagttggaaacagacataaacatttacagatccataatggagcgaaatatcactctactgtaagatagaaagtggtgagtgccatgggagagacacagataaaagaattttgtatgctcacagaagacagagattactcccagctcagagatgaggatggggtaaagagtgaaagaaaaggcagaaaatgatggaaagatcagtggaatttgacctatatctgcaagtatgaatttgatattctacgtaagcatttcattataccctgcagggtccatgcttatctcttctgctaagtaaattgcgtatatgtgcaaatctttttcattctttaaatgttatttatgctgggtgcagtagctcacgcctgaattcccaggactttgggaggctgaggcaggtggatcgcttgaggtcaggagttcaagaccagcctggtcaacatggtgaaaccctgtctctactaaaaatacaaaatttagccaggcgtggtggcaggcacctgtaatcccagctatctggggggcttaggcaggagaatctcttgaacctgggaggcggagtttgcagtgagccgagatcgtgccactgcactccagcctgggcgacagactgagactccatctcaaaacaaaataaaaataaatgttatttatacaacatacagtaattaaactataggcttaatttaagcagaacttattttttttccttcatcttaaattgcctaccttggccaggcacggtggctcacgcctgtaatcccagcactttgggagtctgaggcaggtagatcacttgagtccagaagttccagaccagcctgggcaatatggcgaaaccccacctctactaaaaatataaaacttagccaggcatggtggtgcaggcctgtggtcccagctactcaggaggctgagatgggagaatcgcgtgagcccaggtggttgaggttgcagcgagccgagatcgcaccattgcactccagcctgggcaacagagtgagactgtgtctctccacccgccccccaaaaccaatcaccgcctcttcacctctttcaacacactcataacacacactctgctctctcacccatcttttttcttatgtacacttcaacagtcacaggagcatttgacttgaaaaatacatgctcacagtgggggctgcttcttaatattgtctcatggcctcaagttaaattttattcctctggattaagtaagggagctcttgaaatttagtgatatgaaattaaggaaaagcagaataattcttttgtagatcaatttcctgaagcctggacccagaccgttcactggatttattatttaaataggaattaaaagaaaagaaaaaactgtaggtaatttaatcagaggtactttaatggtcccggtgaagttattctgttgtaacaaacccagcaaaataagcaagcacttttgtacttggtagatttattatgagcctaaagagattgccttaagttctcttatatgtcatagtaatgaatacattcagaaaactaatagtgatatagtcattatttctgatcattttatgtatttctgataattttaagtgttcattttaaaaaatacagttcaattggtttttaaaacacttttggttgcctaacattcatagagcaaatgcccacacatgcatgttatatttttaagatacaaaggaatgcaaaattaaaaaatgatgccaggaaagtaaaacccagacaccatttcgttatcctgatatctcacatagggctctaataaggcaatgtggtgttgaacaaaagctcatggttcatttaacttcctgatagtttcatattcagattgaaatctgccaataaaaacatattgaaaatattattagataagattacccccagaaaaaaggcaaaggaaagtaacagctccaaagaaaacattcgatgtgtttaaacggtgttgaggcgccccttgctggcatatgtgtgtattatccaactctatctgcatttcttgacctttttttggtaaatttggtggtgcaaattagttctatattttatatttttatatatgtctcttttttggtgttgcttgaaatggtgtaaaatgtgattcattctccagtttcttccatgcgtcttaatttgtcagagttttcctcagttcccttttctctgtgaacttttcatctttccctgcctggtcactctgtccttttactgaccttggctttactttttaaacaattggttctacgtcctgtgaggtttgggttttgtgggacttggtgacagccctcctgtgactgcctttggtgttctttgcctgtgacttccctcagtggcttccagcagaggccccaggccacaagctgactcctctctgagattccagaaggcgacaggccttgcgtaccttaaatcatcctctttctccattaactctcaagtcgacgatttaagatatgtcaattttctcaacttccatagagcatcagaatgtgaattcaagaatcttagaactaatttagaaagaaaatactgagatgtgagaaggagaatgcatgttcaaaggcacaaattgaaattaaaatattgtagttaggcgagcacaggacttttgattacaccgagcggactcaagtctttgtatccaaagtattctatttgtaaatcatatttaatttctagaaatctgaaatattgaaatagcttctaaagaggtccataggaaatgtatgtcagggtagaataaaaattacacattctttcttattcagcattgtttaaatcatcatgattgaaacttctgtaacttcagtacaccatgcagccttctatgtggtatggatttctaacattggagttctctgcccaaaattttctgagggactttccctccctacctcaatctgaaagtctgtgggatgggggagccaaggctctgaacagctctttcatccatcttatgtgcaaggataaaaatctctaggaagaaaaaaaaaatcaagtttaagtctgccctgggctttgtatcattaaaaagttaattaaaactcttgctgtagtcattctccgatgcatagaacattatttaccttcttgattggtgtctaaaagatgttttccttcatagggaagggcatgtgttttctcagctcatttcagaggatgccccgctgttagttactattcttggaagtcgtaacttcaagaacctgaagccagccatgagcccttcagctacttccaatcttgccagccttcctaaaaggtgtccttgctcatctccaaagggctaactttttagatagtctgccagtgacagtctagaaggcagaatgtttccaccacaccctcaaatatgtaatcatcacttagttcttaactcaggcttacaaaaaactttatgccaacaaaaacattaacttgtgcttatttttaatacatacaacaattctagagccttatttgaaataaattatctgaatttaatgaaagggttgagtgtaaataaaaacttagaatgaagacagtgggaagatgagtgaagtaggacatctgtcaggcaagtggcttggaatggtcccagtgacccagaccttgccctgggttcagtttattatcactgaaaaatacagcttgttagtccacacaaactagtgcaatttaaaatattgtctcttttaaaatacttgagccaggcttttcttgtggatttggaatttctttgtttctttgagtggtaaatgaattattttggacaaattaaaatactgtttgattttaatatgaatagccctatgtgacaaggcactatataaaggctttttttcccctttgtattatagtgtttctaagacctcagagaaatttggaatctatagacccgcagtttacaatccggaggaaaatggagcagatgagagaagagaaagagctggtggaacaacttcgtgaggtacccaagaaatattatgtaactaaaggagaatttaagcaacattctacatttttgagaaacagactttgaaacattgcaagcagtcctaatttcaaatctagccaggtcacttagtgactgctggatgttgggcaagccacttaacaaccctgagtctgtttctttgtatactaaaaaaatgttttggccaggcatagtttctcatgcctgtaatcgcagaactttaggaggtagaggcaggctgatcacttaagtccaggagtttgagaccagtatggccaacatggtgagccctgtctctactaaaaatacaaaaattagctgggcgtggtggcgtatgcctgtaatcccagctactcgggaggctgaggtgggaggatcagttgagcccaggaatgcgaggctgcagtgatttatgattgtaccacttcacttcagcctgggtgacaacagtgagaacttgtctctttaaaaaaaaaaaatggttccaattgaccttagtggagttttgtgaggaatatatgagatagtagtaaataaaaaataatatatacatataaatgctggcactatttcaatttcaattcaggtatagtttaatgccctgtcatttatttacttaataatattaaattaattttcattttttatttttatttatttatgtgtttttgagacaaagtctcactctgtcacccaggctggagtgcagtcgcatgatctcggctcactgcagcctgtgccttctgggctaaagtgatcctcccacctcagcctcctgagtaattgagattacaggtgtgcaccaccacactcagctaattttttgtatttttactagaaaaacgttgggattacaggtatgagccaccgcacccagctgaatttttaatttttaagagactctctctgttgcccagactagagtgcaatggtatgatcatagctgactgcagccttgaacttttgggctgaagtgatcctctggcctcagcctcccaagtaggtaggcataaattatcactacatgccactgtgcctggcaatattacattaatttaacaatgtttatagttatcctcactttgtaccccaaaccgaccagagattttaaatcaattatctaataggcaaaccatttgagtttctaccaaagaggaagtcttgtgctgggtgtcattgaagcttaaacttggagctggcagggaccatggctgtcttatttcttgtcgtatttcttagttcccaatgggcactctgtaggtatttgtctacctgcatggtctttttgtcaggttaggaagatcatacataaatgtatggaaggttaattaacagtataggaatcaatcaccaaggaagaaaacattggtattagctactaaagacagcacgttatgaattgctgcatgagtttttaatgttcagaaagaagtgtcataactgtgaactaaaagagtctaagaaagcttcttgactaataacagaacaaccattcaaccctgtaatcccattactgggtatatacccagagaaaaataaattgttctaccaaaaagaaacctgcactcatatgtctatcacagcactattcacagaaacaaagacttgggatcaacccaggctcgcatcaacaatggattggataaagaaaatgtggtacataaacaccatggaatactacacagccataaaaaagaatgaaatcatgtcctttgcagcaacatggatgctactggaggccactatcctaagcaaattaatacagaaatggaaaaccaaataccacgttctcacttataagggaaagtgaaacactgggtatacacggacacaaagatggaaacaataaactctgggaattccaaaaggggagagatagggggtgagggttgaaaaactacctattgggtactatgttcactgcttaggtgacaggatcattagaagcctaaacctcagtatcacacaacatacccatgtaacaaacctgtacatgtacccctgaatctaaaataaattttttcaataaagaaagaaaggttcttggaggagatagattcgatgttaaatcttctttcatcagcacatgtgtattgactgtcactctctaccaggctgtattctaggtaatggatgtaggagagaacaaaaaggtctctgctgttctgaagcttatagtctattggggagagatagtaaataagacggaaacaaataaatacacagtttcagagagcaatgagttctacaaatgagcagtgagccctataaacaaaatttagattaaattaaattaggataggtcagcctctttgttatagcagatgatactttttatatggtttagcaaagagtcaggaggaagtaattttaaaaagaaaacaaaaaaacctcttaccaccactttaagccactgtggtgattgagcaaacacaaagggaaagtcaaacctctgtcatttgcctggactatctggatgtgatgtaaactgggaaggtgaactttatgaaatctatgcaactaagatcagaagctgagctatgcccctcaaggagtgatatcttacaattttatcttaaacatgggtcatattgatcatttatgtcttaatttagtgatataaaattagagcctgaaagagtacctaaaaacaattgtccacacacaggacagttctgaaagaaatttatataacactattatatgcagtgtttttcaagttttcatttattaaaatcaccaaattaagtcatcctttcatacgctgtgattcagttaaaaggggcttttgttgcagaagctctagttaaggtttgaaaatcgatttctctacttctgcttccaagaggatggagtaggcatactttgccctattcttcccactaagtacacctaaaatccctagacatacataaaacaaatgtaagaacattctggaaggtaaagagaagaagacggactgattagggtccttgagacttgaggggcgccatagtgatgagctccaggggactttctttttgcctcatgtatccagacttggagccgaagtcgctgggaacccagaaacagtaatcggcacagactttagaaaaacaacaataaaagctgactttctctaaccaaataaccaggaaagggacagcccagcaagacacaaaagttttagaccataaatgtgctactgcagctgaacaccacaggaaacactgtggtcccccctcacccacaccagcaagggctgagtcaagtgagacttctccccttgctggggtggtgtcagagaagaccaagccaggagccagaaatttcatccccactggtcagtaaggaagctcgtctgctcccagagtttcagtggagaccacgtgggaattctggattctcacccccactcagcagtaaggaggcacctacccctcccccactccctggccagttgacacccagtagaaaacccagatgcctgcattcacctggcggtaacaagatggtggcagccaccttcccctgctagagcagtgtcaaaaaaaaaaaaaaaaaaaaaaagccaactaaaacagagatttaaataggatccagagtctcataacataattcaaaaatgtccaggtttccactgcaaatccttcatcattccaaggacgaggaagatcccaaactgtaggcaaaaaagacaatctgcagatgacatcactgatatagcagagatgttagaattatttgacagatatttttaaaccagccatgatgaaaatgcttcggtgaacaacgatgtacatggtcgaaggaaaggaaaagaataccccagcagagaactagaaaattttggcaaagaaatagaagacacgaagaaaaaccaaatggaaattgggagctgaaaaatacgttattcataacaaaaagcccagtggatgggctccacagcagaatggagatgataaaggaaagaactggaatgaaactagaagagagaacaatagaaatcatctaatctgaacaacagagagaaaacagattgaaaaatcagtggacacagagcctcgggacctgtgggagtgtaacaaatgatccaacattcgtgtcttgggaggcccagaaggaaaggagaatgggagcaaggcagaagaggaacttgggggtgggaaggaaggggatgtctctataattttttttctttttttgagacggagtctcgctttatcatccaggctggagagcagtggcgcaatctcggctcactgaaacctctgcctcctgagttcaagtgattctcctgcctcagcctcctgagtagctgggagggcgtgtcaataaaaggtcaacatgggggatccttgtgctggtgggaatgttgtgcatcttgactttgtcaatgtcaatatcctggttgttttgaaagttgttaccattgaaggaaattgggcaaagggtacgtggaacctctgtgtattagttcttacaattgcatatgaatctagaattatctcaaaaatcaaaagtttaatttttaaaagaaggacaaagattgatttctcagctaaaaatagtctaagagaaaaactttctttctttctttctttctttctttttttttttttgagatgggatctcactctgtcaaccaggttggagtgcaatggcatgatctcaacccactgcaacctccatctcctgagttcaagacatcctcccacctcagtcccccaagtagctgggaccgcaggtacacgtcaccacgcccagctaattttttgtatttttggtagagacagggtttcaccatgctgcccaggctggtctcaaactcctgagctcaggcatctccccacctcggcctctcaaagtgttggggttacaggtgtgagccaccactcctggcctaagaggaaagcatttcctttttttttctttttctgtcacccaggctggagtgcagtagcactacctcatctcactgcaacctccgcctcctgggttcaagtgattctcctgcctcagcttcccaagtagctgggattacaggcacctgccaccgtgcctgggaaatttttgtatttttagtagagacagggtttcaccatgttggccaggctggccttgaactcctgacctcaggtgagccacccacctcggcctcccaaagtgctgggattacaggcgtgagccactgtgcccgaccagagaaaagcatttcttaatccctcttctgccccatgcagactgcctgaaccagtcagatttggtttttatttatcacgctcaaagagtgattccattattccattcattctattaaataaaaattttacactcacctaaatttgtttttataaagagagattttgatactgtttggaaagagttaaataatgtcagtgttttctaggcattgttatccttatttcctatgatgaaattagtgcctcagttcataaatacccataaatgtattttactcacagttacctcagtgttcatattaactggcttccttctgatttccccaacagagcattgagatgagattgaaggtcagtctacacgaagacctgggggcagccctcatggatggtgtcgtcctctgccatctggtcaaccacatccgcccacggtcggttgcaagcatccatgtcccatcaccagcggttgtaagtaacaccaaagggaaactaactgacataaaacagacctttagggggcactgttgttggtttaggatgtcaatggtgtcagtaggagcttgctcaaatcttttccattgggccccaaaccattataaggcagaaaaggaatgaaagaatggccttgaatgaagcaacattttcccggtaaaatgagagactattttaaaataaatatataaatgacagaaacataattttatttcaatatcaagcagatcactttaaataacttactgggcgggcacggtggctcacacctgtaaacccagcactttgggaggccaaggtgggtggatcacttgcgctcaggagttgtattttttgtagagacggggttctaaaatagaaaactacacaatacaaaaatatgaaaaatacaaaatttagctggctatggtggcacgcacctgtggtcccagcaactcaggagctgaggtgggaggattgcttgagcccaggagttcaaggctgtagtgagccatgattgtgccactgcactccagcctggagacagagtgagaccctgtctcaaaaaaaaaaaaaaaaagaaaaagaaaaaagaaattactgattgactgatgatcaaggtgctaactttaagactataggaacataaaaatttctttttcccaagagttatttaaacagtgacaagtctttcagaaagctgcttttggttggtaacttcccttctaaattgaatctttttcctctattcatcatggaggattttagggatagccctgaaaagatgtgagttctatgaaaaatactatgaataacctgtcaaggggttggttagcagtcatgacttcaacaattgcttgatcagtcactgcactcaaggactcattggtgatgctggggacgtagtggggaggagaacatgaatgagactccttaatgcgcccccagatcctcatctctgctgtagaggagatagagcctgcactcagggctctcttcctaggtatcacagcatgttgtgaactagaagagagccaaagagtcagttttatggttgttcagatgaaagtggaggaatcacagataaacttgtccttgaaacctacacaggatttatacaaatagagaaaaaagtatcactgctcaccctttttgctgtttgttaggagaggcagaagaatttaggggttaagaatgtaaggtttggattaaaattctaaaagctatacaactttgggcaatcctctcttgaacttgatttgctcttctctataatggaaatgttcttgcaagtatgaagtaagatacttcatgtaatttacacatatatgtaagccattataatcattagtgtttatatggcaagttttggaaatttggagccccataaaagtgcaatgttcataaaatctcagagcccagtgtgttggactgaagctcacgtgaagctcctccgccctctcccatccccaggagagcctcacagtggcatgatttgtcctactttcttttctcttgacagcaggaaaaattagccaatgaccttatttcatcttagtttcttatctatcatattgaacatatttttctttcaaaggttcaaccacttttttagcctcagaaacatagtggggacaaaaagaccaatttgtcttcttttacaaatctacctctagcagccttaatgtgggacagtaaattctgttccatgatccaatatgaaacactccagtatcttttacaaatgaggtccaaactgccgtaaagtcatctgagtctcgtgccagattctcagtaatttttcccaaattatgagagagacacaacagacacctcagccttcaatttcaatgtacaatgatcattttacaagacgtaagaggacatcatgaattgtgtacccatttacctttatcttcaggaaaaatgctacattgttttagaaatcttttggttttcaccattttgctttttttaaataaaaattttaaaattaaacaaataataggaaacaatgagtgactggtgaaaaaaagaaaataaaggaaagcaaaagaaaacaaatcattctttattctcctcctacccaaaaccaatcactgttgcttttaccattatgtcttctttactataagcttttttttttttttttttggtaaaattaagttgttttttaattgtgagcttctcatatagactagtaattttttaaatgtattattgaaacctaaatatttccccatgtcattaaaattctcttttttttctggagatggagtctcctctgtcgcccaggcaggagtgcagtggcacgatcttggcttactgcaccctctgcccccagggttcaagcgtggctcagcctcctgaatagctgggattacaggtgcccaccaccacgcctggctaatttttgtatttttactagagacggggtttcaccatgttggccaggctggtctcgaactcctgatctcaagtgatctgcccgcctcagcctcccaaagtgctaggattacaggtgtgagccacctcgcccagcctaaaattcttcataaatgcctaatttactgactataacatattttagcctgttttattatattatagttttcctttttagaaatgcagtttgtttctaaatatccacttctacatgtccaattatcaaaaattcttcaccaagcatcttgatgaccttttggaccaggcccagccacgctgtagccgtagaacctgctttccttctttcttctctgccgttgctctttgccccaggctcagcacaggcagctccctctgcctagaaagccatgcccccacctgccccccaaatctccttggttcttcagcgtcactagctccctttccttctctatttcagcattcagaaaacaaaccattctcaacgccttaggacagggtttcttcctttgttcattttccgtcacacctaccccatgacaactaagaactatcctgtattatactgtaccttcctttaggttgctaatatttccagctgctttagaggtaagtgagcctggggattttgtctttggctccacagttgtatctttagcatcaagtttagtatctgacccatagtaaagcaataaatgcagttgtatctgccagcagcagtggatgagagcatcttttctaccagtattatcaccagcaaaagcattctaattcttcattcatgaaactaatattgtccattttgtttttgccaaactgagggaatatagtagtgaacaaaatcactatcattgtcagtatccttagagactattccttagaaaaatgaattttttcagcctctgacaatttgataagcaaaacattggcatttcaattggtataattggtataatgttttattattggaccagtggtgaggttgaagctttaaccattgcgtttgtcacaagtacttttctacctgaagttaggcaacaatctttgaagacgccctccctcactcccaaagagggagaattatttttctgtagcttgaaacacactctccattaacttctttggggctgacctaagtatttggaatgatgttgggcgtctttggagtttcagaagagactcacctaaggacatctttggagtttcagaaaagactcacctaaatcataagtaaatgaaggaagataatgggcccaaacgatcagagagaaacgctagggtcttggcgtgatgaaatgcctcttggtacctcatctgccaggtccatgaccctctgttatcttcagtcatgttcctcaggtctgcttctgtttgcacaaggcttcatgcagtggccttgtcctgagacatgccaggggttgggcaaaaccaccgaagcagctgctggcgacatctctttagggcccacgtgagggacgtgacttcctccctaatcaagatggagaatatttatttagctttcaacttaaattgtttcacagggcaacagactctgtttttggcagggcttttctttttgtatttaataaatgctgtacaaattagattttgatgatagttgctttgtgcctctataagacggaatgaattccgtcattctcacatgagcaggataaggccagtctttatcacagttgctcctccacctacaatattggaatcagtcatgcgtcttgctttctttcctaaggaaaatagtggaggaatattacaatttagcagcaaagtgttcaaaacgtaccatgtaaaaaagtatagtatattatatatgaaatgtgcctgttacccatcccacacctcagaggccatctataaccaaggttaattcaattgtgagaagcttttggttaagtcctgaacatccaccattttcagtgctgtttaccatgatattgcctctatatccctggctttggtgggaaggaggttaattggcctggtgaatttagaccctttatataggaatatatttgttgatggggaagttgatgtttatggtgtactttaggcaaactaaaacaggttacacaacagtatgatcccgtaaaaactatatatacgtgtgtgtgtgcatatatataaacaatataaacatacgtgtgtatacatatatacatatgtatgcagaaaattttgcatacatatacatcagtgtatatacatgatatacaaacatctatatatatatacataggcatatatgtatatctatgtaggcatatatgaacacagtgtctggaagaatagaatctaaaatattaacagtttttaatctaagatggatgtttctgagtgatattttgttttcttctatttgcttatgtgttattttcttttgctccaataaacatgtattgcttgtgccatttgggaagtttaaaatttaacatgttattaaaatggtttctcttttaaataatatattatttccgtatatttgcatttatagcccaaacttagcatggccaaatgcagaagaaatgtggaaaactttttggaagcgtgccgaaaattaggagtaccagaggtaacatcaaacttacttcatataactgtgttctagtaaaaattttatttaatatatgagtttgaaccattgaatcgatgcaaagctttgtacatgcttttttgtctcaacctttcttgagaaataatattgaataaattatataaactttaacttgctctattgcagtgaaagtaaaatgactatgcaatatgttcaattctgaggaaaaagggaaataatttaagattttgaagtaagtgtgaaatttcagacttgaaaaaaaattttaatccgcttgattctccaagagcagaaattgctgaggctgtaagtgaatcttctcttaggcttcatagagtagaattttggagctgatggttttcttatcccaggctctgaagaaaagacctgctgattattgattatcattctctgtagctgtattttccatatgtggataaaaaaatcaacattggaaatactatagttattgttatcactaatcgttatcattaataatagcagcgtttgtgtgttgctttacagtttgttaactatttgcatttcatttttgccttcagtttgctttgagcccaataggcaattcaattacatatagtttgctattttttctctctccaacctcggacccagcctcagcctcaggcagatggctgggggcttttaaagactttgcttttaggaacataaactgatttcttaggcagacaggaggccatccactcagaatatggagtagccatataaattgaggagtttatcctcactgtgataaacagaaattgatagaagtttatttcttatgatttcttctttcttaatgccccagggataaggtaattttaaaaatacatgcgatactgttttgagtatatgaagagttatatttcagtataattctactcagtgataggaattagttactgagattgacaaagacttttttccctttccttttctctctccatccttccttccttttttttcctttcttcctttctttccctcttttttcagcttggtgggattcagaggtgggggatagcggtagacttctcatcttatttgaggaaaaggagagcattatttaaaacatctttaagtcagagctatatcaatacaaggaagcttacaaatttattttttaaagagtgtaaattttatatgatggactgtctttgtgatctattctgctttcagcaatgttataatctgtctattgtgtgtgtacattttaatattgcatatacatttcttggctttgaatatatatgtgaacgcacttacataccttttctaatgatttgattctgtcatgggctagtaagatttcccatgtgtgaatcaaaactctcatggcaagcttcagatgataaattatttgtgtctgtgctagaaagcacttcatcagtgctttaggtcattaggttatgacctaactccctgtggtttttaaaactcatcaatgtgtttttggcttacagtgatataaaataaaatggaaatgcccttaaccaattattgtgagtaaagattggtaattaagatttccttttaaagtggagaaaaggaaactaaattaccataaaaatccagagcaaaatttatcataatttctcaagatgcccctggcagtaatgtacaatttataattcccgagaaggttcaaatacaggcagtgaatgatctttatctggcagtgtcccatttaactatgtttagtatcacttagcgtatttctggaattatgtttaaggcttgaggtgattttcctttttttctttttcttttcttttttttttttttttcgagatggagtcccactctgtcacctggccagactggagtgcagtggcacgatctcagctcactgcaacctccacttcccgggttcaagcgattctcttgcctcagcctcgcaggtagctgggattacaggtgtgcactaccacgcccagctaagttttgtatttttagtagacacggggttttaccatgttggccaggctggtcgcgaactcctgacctcaggtgatccgcctgcctcagcctcccaaagtgctaggattataggcatgggccactgtgcctggccaaggtgattttcaaatttgctctgtgtgtgtgtgtgtgtgtgtgtgtgtgtgtgtgtgtgtgtacacatatatatcctaatgaataatccaatagcattttactggtgactagagtttaaatttacttctactagacaaaaagtgtgttaacagttgaacttctttaatgataatgttaaagtaagtaaagaatatttagtgacaaatcagaaattcctattgcaaggcaactggcattttcctgtatactcaaaacaacatgttttcatctcacagagtacaggaaatgtttttaccttaggaatatgacactaaattgagggaccagatgacttccccaccccaccttagatatttatacttccttccctacctaggagggttgatgacttgagtgtatgtgtggcacagtacaattgatgatttacactgaaaaggtaattatatcacaagacttcttgcagaaattctccatctataattagacattttaaaagacatttttaaagacctaaaaaaagaggacctatatcattactttttcttgttgcatcaagcttaatatttgagtaataaaatattcagtgatttcctagtagtcagtgtagttacttccctctaatttgcaagctttttctacttctccatctataacttatctacacacacacacaagccacagagatcttaagttctgcattttataagctaaatatctaactgacaatgataaatcatcctgtagatattgaaaagtcacagctgtgttcttaagcctaaaattttttgtcctatgtaatagaatcacagtttgaaactataaaccatagtcagggtcagcagtttgtataattttttcacattcatatagatggaatacagtagctaagcagatttagttaaattattacatgtaaagtaagaaaatgggatggaaataataataaatgattttctttagaagtccccataaacgcagtcccaggcatttgctccagggtgggtcatggttcatgacacacttctctttgcttctgcagctggaaccactgtgtggtttctctaatatccaggaaacatgtctatgcaggttgtggcagtatactacctaaattcactgaataaatagtaaaggttagtgggtgagactatccctccacgacatttaaaaaaatttgttatgattttttaagacagggtctcactgtgttactcaagctggtctcgaactcctaggctcaagacaccctcctgcctttgcctccgaaaatgttgggattacggacatgagccactgtgcccaacccttggtggtattttaagcccactttttacagtagtgtagaagacagtagttctgttgtggctgattcataaatgcagcattttcacattggctacattcagaattataagcagcattaggtaccatcccacatccctttgtgctgttgatgcttagtggtcagactttgtagctgtcttcgacctctagtgcaagcatcaacttggtcttgaagacaggccttagtgggcttccaaattctttgggatatattttctgcgtcacctaagaatctgactccaattaggccttgaccccatgaggcttttaatggacacattggggcttcctttgacttttctgagtgctcttggagattcctgacctctaacctctatgtagcagattggctacatgttcctggtaggtacagttcatggttgactattggaggttttcaaatggatccaaatttagggatattttagggctcttattagtattctctcaggttgagagaaatctaatttatgaagcatcaaaaaattaggaaatagatatttatttggttcaccagggaaatttttctacttaattttaaataggtaactttgatctcaaacttctgtaaggcatgagatccttagtttaacagacttgccttctttagatgaggggagttagaatagaaatgtactctgttgtctaaatgttcagtccttcatcttccttactgtttccagagaaaagatagagaagaagattaaaggcagcaactcagctgacagtggtagcctcctttcagcttagggctccttcctgcctatctgggcagctcagagtgctggaggaaggagaaagttttcattccacatgcaaaagggcaggtcacttggcatccttgagcttctgcatcagccaaagggagttacaaataaaaccctaaagtacattcagatgctaatgatgattgtgtcaatgtaagtggaattatggctgagttttccttatcttttgtaattttcatattcgcattttttgtgttaaaggttttatatatgaaagtcataatagcgttcccactttacacctcttgtgagggtttaggaaattacacataccactgattgaagtttttgtttttgaaagacaatctataaattgaagctactgtttttttgttttaatcttaagaataagagaaatgggtcccttatcttctctgagccttatacctatttttcttccccaagtcaatgactttagtgttaatttaaatcataactaacactttgtggaaggatgagattcttattacaagatttattttaattttccatttatattggttaattctaagggtgaaagacaggttcattgttttactaacatcaattttaaaattcataatttattgaaaacagccaatctatctcttttctagctataaagaatgcaactaatttccaagctattcctagctttctctaagttcataaaattggcaattagttgtcatatatttggagaagactggaaatccttccccacctctctcctctccctgccaaattatacctcatcgctgaattatggctttaaatattgcagaatgaccatgaacattcttatattatgatattttagattaaaaaatactttgtaagcatattgactttttatattaagattatatttaagtaaagtaaatatattccaaagttttaaataaaacttctgcctagatatgtttagctcttagaatttagactgtagtacaccctgaactgctggatctgtctacttttctctttgtatccatagtatttggggaacctggtccagtagtaatctcggtcacacactctggttgtgtgcaacctaagtgaatttcttaacctctggcgattgtgatttttgttcactataatgggcattagcatccgcacttgcctctggggactcttagtgaattaactgtgttttacaaatggcttgcagtgattacaaatgctttgtaaatacatggtgaaattttgcctctttaaatttccttactttttagcattttccaattttaattttcataaagaaataaagtataatctctacgtccctctcagtaaggctaaattttggaaagcacaaagggcagaacctcccaggtcagaaattaggaattttagccctggtttgcttcatggccccatttcaagggctgaaatgactgttggctatgtgacatagggttgaatcagagagcagttctcagatggccacagcagctcacactccacacaatcatcatggtgcttcacatttttgcctactagacagtcttagatccattcctttttctttagagattatgatttaatttaaattaaccactataggctgtgactctaggtctcacccactttaattaagcccagagtctgtggcatcgtgaaattgtttcctggatgagaagaatggtctgtgttgcctgcccccatgaggagtgtactactgaaaactgccaagttgatctgactctagttctctgatggtgctgccagagagcagaccagacatgttccttagggttctgcgaaatgtattgaaatacttggtgaagatagaatcatctgcttttaacatgaaaatactagttttgtgaaaatcacatttcagtttgcatatcagccttctgtcttatgactgctttgctcggatttccctggtcaagcacaacattgcaatagaaaattcttattgcaatagaaaacttttcttagatgtttcctcatctattaatccatgagcagcatcagtctcccagtgaaatccaatttatgtgtagctgttttaattcttgggagaaccctaacagtggtagcttgatttctccagatccactgagaaaagatacaacatctgaatacatataacatgatttattcatcttaaaaatattttgttaagagtatctctaacttcattaataaaataaaattagaatgtttttaatcttattcaaccaacctaattttgtagtattcctacttaactgagggtatcgagctaacttcagaggacacaagtgaggcaaaacttctaacttagaaacatctttcagtcactccatgatgtgcagctgcttagcagtgaggccaaaataaaggacaaaattgtagcaaagtatgtaaaatatacataacatatatcttaaatgcctcacctaatttgtaaataaaactgcatttatgaaatagatcacacgtattttcaatctttgtttaatttggaaacagaaccacagcttttatttcttgctaatatatcaattataattcctgttaattttaaactgtggtcatttccggttcaggaattcagcatgtgagacaattgtttgctttctgacagcaataggctgctgaaagtcaacgcagaaaactgagcctcttagtttgcagttagctgagaaataggtgttctgcttccttacatggtgactgttgagtagataaaacacagaggtctaccccccctgccccaatatacctgtttagtagtgaagcaatttacatagtaactccatgtgggggtgtacttttactctctactctcactacacatccaagaagcctcccctagacttttggttaatgtgttgttgcaaaaatatgaaatgtaatgtactttctgacacatgtagggacatacttagaactagcattgcccagagtttatcaagcgtaaaatgaaaaaaaaaattaaatgtgtgtgttaactttcagagagaactactttatatccaagtctacatagaccagggtaaaaaatgcactaagagaatggagagtggggatagggattccattttaaactttatagtttttcatttagtaaggttaagttgaaatgtcccacgtgaaaatcttatttttatgccactgatgagcacatgataccttgaatattaaaactgtgtgaaaggcagaatgatgtgtaaattgcagaacatgccgttcctccatggcgagattgtgagtgaaggatttctttgacccattggcacaaaataggtattctattctactattatgatggattaaaaaatctttgatgatgaaagggtcttacctgcttgaaataaggggttactcctgccatttgctagtaaccaaaaatgtgtgcttctttctagctgttcctccgtgtatttttaattgtatgcactgtctctttctgttctaatggctgccctcggaataggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataacgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctccagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgattattccaagtttttatcagcccattgatacatgtattcatgagctctcagcattcccatccagctctgcagtgcattgaggcttctctttaatggtcaccactgtggtggtttttcccttctttctggggagaaaatgggaaaaaaaaaagaaaacttactgggttcccaccttaaaataatatcaataaaaactgagtaggacactcatgtaagagtagatttaattttcagtgttgatatagttcaattaaaacatgttaaagacaaattaaaagacatttatattttaattctggcatccaaagtattctttggacgcactttgattttttttgtgtcattaatttgtctgtactctgctgcgctgcacttcttgggatttattggatgatgttttttcattagtagtatggtaactagcagaacacaattaatttagtcctttaggcaaaaatttgaatgaactgttctgtccattgccaacccattaatttctaatcagaatattaagcttctctgtggtttttctccaaggtacccgtgcaccagcccatatgctaactggatgcctgcggatgcctgcccttgcagcttgactggggatacctggctgacctccttagagtctgagaagtagtcagggatgtcactgagtggtttattgtgctgaccaaatctcctcctcacaagaaagaccgttttttcagtactcccttccaatgttagataaaaggagccaagtatctatttacattttattttgaaatagccatttgtattctctttctccagtttctccaactggtggcaactctccactcagtgtcaggaattccaaaatttgtgacacctaatttctaatcatctttcctatttatggatttctggtttgttatttttagggagagacacttatgaaatggggctggtggaaaggggccccgcagaactacaatgtatgataatcgagtataaatttcatcaatgagagtagataaataaaggcacttgatagcctgctgctatttgtttgtaagaaattaaaactagcgcgtggtgagctgggttatctctcgaaaactcatgtagatgcctgattgagtcataaggacaaaagggtgttttgcctttgcctgtggggaaaaagtagggatgatattttaaaattttaagaaactgaaagttgttttggattaggtgaaaaatactttaatatgattttatttcaggagacttgatttttaaaaattaggcttcgtatttcaaaattagttctcaataaacaatcaatttggtatatagaatgtgccctttttttcttctttaagatggtcagagtctagttgcctggcttttcactgtgactttgttcatttttgtgttcattccttcattccataaatattgaatgagcaatctctgcaaggccctggggataaaaaagtcactgggacacatggcctggtcctcaaaaagcttacagtctatagcaggagtctgcaagcttgtttcataaagggcctaaaggaaacattttaggcttcttgggccatgcagattctgttgggattacccagttctgcttgtgtaccataaatgcagccttagacaatacatcaaacataggtgtggctgtgtgccaataaaactttatttacaaaaactggctgcgggctggattagcctgtaggccatagtttgccacccttgatctagtaggtccttagacaagtaaagaggaattcaagtgataaggacctgtggtggaacgggtacaggattctggaaaagagacctgaccctgatggggaataggggaccgtgaacgcatcctgggatggtggtgtttccactgagacttagcaaacgttcaggaatagccaggtggagtggggaggggagagggactagggttgaggcatatgtgtgtgtagagaatgaagtgttctagggagaggatggactagaaggtagcatggttgcaaagtaaataatccagggaggagcaacaagaaatctctgtaagatgttgaatggtctccatttcacattgaagaaactgatgcaggaacttaaagctctcgtacatcaaaataacacacagatagttttaaagctcaaacagtgtagtgccaggactttatatataagaagcagcctgaacaaaatgaaatatgctggtgggatgatgccattttaggctagtggctggcttagaagtgtgggtctctttgggagcataagaaactgtagaaggaggagagtcaggcagtgacggctcatcctgttcccagcaggtgtttcctgccaggacaagatgagctgagtggcagagctaaccctgacactgagttgagggttcgctggtcccatctgacattgaaattgatgggactagccatcaaaaaactccaggggccacgggacctcttcctatatcatgaccgcagacctaacatatttaaccattaagtaagagatttatgggaggaggcatagtattgtggaaagagccctggctctaagacacatgtagttcaaaccctggttccaggacttaccagctgtttagtgtcacaaagttacttgaactctctctctatattagttttctcatctgtgaaatggagatattaatgtctgtcttgcagggttatcataaagaaatcaccaatacaaacctgtagtgttggtgccaggcacataggaggtagcccagaagtttttcaaagctagcatttagtctttatggcttgccgtcttttccaatgtcgtttgctgtggctcagaagggtggatgaggggatatgggtgaacctaacagattctaccattggagaagtaacttgaagcatgagttcttcaaaggcggtcagaagcattatttttatgcaggagactacttcatgactccgctccgtactttaaaaagaaacacaacaaaaaaagcccatgggcaaactaagagtctactgtcacgttctcaacaaaaatctccgggatcctataacagtgcaacttaaattcatttcaagtcaatataaaggtacagctgtctctgctgtaagtccattatgaacaaggggcctgctggaagggccactttacctgcctgatccttagagggcccttctcttctgagtcattcctcatccagctgtaaacctaccatgattcattcctaagtccagcttctgtgcacacttcaaggatccccccactctgtgggagatgcagtgtcctgactggtgtgatggcaaatggccctgaccccttcttgggacgcctcctggttggaagcctccccttggccatccttccaaccagcacctcaaggtgtaattcccaccagagtcttcattccaatcctgtgatagaataaccagaatggccatgcttgtataaggtttctgttttcctgtgtgagtcttcttacatccctccaacctcagcaaagtaatctgagggcacctctgggcttcctcagggggtctgaaaagaggcaggaagaatttgaggggtatctttttatgtcttctgtttactcctcatcactagccatacaagcaggagggaggatctcggactctgcacctggcttggaatgtggagaccaggaaggcgaggaatgctgcttgaaaaaacaagggcctgggaaagagggtgcccttcacctaactcagtctgtgaagtgtccaaatgtcctgttggcaggaggctgaggcctcgataccttcccatccccgtttctgtgaagcccccagcctttccctcgcatgcccttcagcttagaaccctgcaggccactggagccactgctcatcaggccctggggtcagtccttcattggaggacacatgccactctcctttcaggacacaggataggacaccttgctccatataagctgtgtcgttcacagagattaggctctatgggaatactcgtgctagaattcaggcacattctagactacacataactaaacactgaggttgaaaagcaaaatgtcgtgctgcattgccttaggcaaatccctcattcaaaaattgctgttcacattccttgcccagtgttctgttgatttgttagtgtttttcctactgatttgttgagcttatgtgtcatataaaatgctttgtaattttttttttttttgagatggggtatggctctattgcccaggctagagtgcagtggcacaatcatagctcactacagcctcaaattcctgggctcaaatgatcctcccacctcagcctcccaagtagctgggaccacaggtgcacaccaccatgtccagctaattttctttaatttttttggagaaatgggggtctcactatgttgaccaggttagtctcgaactcttggcctcaagtgatcttccagcctcagcctcccaaagtgcttggattacaggcatgagccaccatacacattgttccctttgtaatttgatgcaaatacttttttttaaagtgttacttatcttcttattaatcgggcttgtttttttaacacatggatgctttaaatatttaggtaatcagttgctttgctcttttcctttgtgactttttcataatgcttttttagcttaggaaatcctttcccatccatttatcagaaaaaagtactaaatattcacctttatgttattgggaggggtgttgtagatttttttttttttaatgttcaactctttatttgatttcaaattgattttaacatatggtatgaagtaaagaattgttttccccaagtaatatctggcaccaggaacttaactgtacttaacagccatttacaatttcctgcaaagccagatgtcgacttgggtgctgtcagagccaatagaatgaggaagacatatctttgcccttatagaacctgccttaacagtgaaatgccagattcaagtgatttcacaagcccgtggcagatggtgccggggaggctggacactgtcatcaggccacagatatccctcaccatgccgcaaaaggaggcaccattgttaacagcctggctcacagctcacaactcagacagaactcccccatcctttctcaggttgatacttggctaataaattgtcaggcagcatgaacttccatgctcacctgatacgccattgacaagataatcctactttgatacacagcaatgacatgaaaccatggttaaaattgttctttaaagaatcgactgtcttctgttgacagggggccatctcttaaggcctaggttaaagtctgatgttctctgaatttgccacaaggtagggaagggtgaaaagcagatacggtaagatggtgagagagtaagacccactgacatttgagacagtggaacaagttattggagatgtcatgtcatgtcctttgaaagtcttttaagcacagagtgcctgtgtctccggtaatttttggagagttctgcattgaggcagcaagaagatctggttcctcaagcaagtgtcacgtggaaggaagcccttccttgcagagcacaccaattggcttcctgctgaacagtgactccatcacctagggctggatgcagatcccacttaaactctccttcaaaacagcgctactcagccttaaaaagaaggaaatcctgtcatttgcaacaacatggatgaacctagacgatattatgctaagtaaaataagccaggcactgacagacaaatactgcgtgacctcactaatacgtggaatctaaaaacgttgaattcacaaaagcagagagtagaatggtggttaccaggggctgggtggggaggtggggataggaagatattggtcaaaggatacaaaatggtgactatagttcatcataatgtattttatacttgaaaattgataaaagactctattttaagtgttcttaccaaaaaataagtatctgagataatggatatgataattagcttgacttagccattccacaatgtatacttttatcaaaatatcacgctggacaccataaataaatacaattttttttttcctgtcaaagaaaagaaaaaagaaaaagtaaacattgggctgtggaaaacacactgtcatcaagtagataaaagaatatttgccgtggtgtctttttccagccaaggagacacaccctggaagaagattctcttgaatgatatcagaccagggtgaaataacaaaggtggaaaattatttcattgtgttattctgtaaactggtttgtggagcatgaaaggttctgcacacaaggagggactcacgcttactgtttttcttaaatagtatgtcctggacatttcccaagagcaaaaatgcagcatgagagagtagcaggacatatgtgtctttgacagttttatgaaagagtcttgaaagggaggctattgagggctgtagttataattaccaatttataaagactgttcataaaccatgaagaaaggctgccagtccacccacttgcctgcgttccagaggtcacaggaagtaaaatgaactcaatgaagttctatggtcagtataacaatgtgtggtcggtacaaatgaatatttgagtgcctttaaaatgtgtcaggggctatttgcagttttgctttataaaaatagaagctattatattcttggtgtatgctctctgactgactctgtagctcagttatttagtgtaaaactttcttaaatatttagatctgcagacttcatggtgattaggagcctttttgaaacaaactgcatgtgtgaaaaatcattattttctctgcaaacatagaaaaggtctttgcagtaggttgaaagcaaaggaaggagcttggtgtaggtgatcaaacaggcatactagagtattcaacctaactttgatgtcatcaacgatgtagcaggattttacaatgagagtacaatcatctaaaaattgatgttttattctttttccttttaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcgttatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttcta

SEQ ID NO: 71 - DNA, 1533 bp, Mus musculus
actagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggtggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataacgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtct

SEQ ID NO: 72 - protein, 381 aa, Mus musculus
LVDLPLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEARAEDCEELLRIEEDVHWQTEGIISSSKDQDMDIAMIEQLREAVDLLQDPNGGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPELDFRHIRKTVDTLLALGEKAPPPTSALRSRDLIGFCLVHILFIVLVYITYHWNALSA

SEQ ID NO: 73 - DNA, 109586 bp, Mus musculus
  misc_feature (1)...(109586): n = A,T,C or G
taaagggatttgcagtcattgctgtggcggagagtaagcatgtcatactggccttagttcaagataggaatgattgtacgctacagtgtaggctgcttaattaatgagttgaaggtatcctggtctgcgtggaagagacttcattttgattgacaaccccatccttcccagaagccaaagaccaagggtgtttagcggctctgattcccgtctcggttcctaaaggatttcagggctgtttttccagagtgggttgggtgttagagtagaagcaaagaccccttaagaaaaactcatggtcaggagaacagattctgcacccggtagagtcctgacattccagttggtgtggtcactcactctgtaaagggtctgctgtagggaggtggtctcaccttaggccatgctgaagagactggcagagaaatttgtcctttaaggagatgatgaactttttcttcttagaatccctgcctcaggcacagtcgctccctgggctaaagcggttcggctttgtatgtctacgggagttgggagactgcaacttctccttactattcttgtctaagcatgctttccttgtcactgtgggcctccttgtcagttcgagcttagtttttctctcaagctcctttccctgcctcgtgtccgcctgcctgtctgctatgtgtctaatggccatgtcctttctaaatggcatagctttttttattcttatcccttggcagctgccaaggttcacaccttgcttgtccttgcagcttttccttttaaactctaataaaattttcctctagatcttcaaaaaagacttctttgtgaggaaggaaggctataagatgttcctagttttaaaattaaatctctgagccgatactctccaattccctaaaatcacataaaccaggggtggtgatgcccacctgtaacctcggtctttggatgctgaggaagaagactcttgcattctaagtcagcctagaacacatagcaagtcctggtctctcacaacaacaacagaaaaaaaaaaaaaaaaaaaacaattgcaaaaggacaaaacccatatcccaccagttgaagaagattgtaaacatatagttgtaaaaacactataaacccacattgtcctagttagctctaagggccaactttacctagtcaacagtcatctaatgggagggcttcagctaaggatgtgttcagaccagattggcccatgggcattctggtgggggactttcattttcccttgagactggttttctttgtgtagccttgaactcacagagctccatcttcctttgactccttcctgctgggttaaaggctagcatcactcccctctgtccatgggagactatcttgattgttaattggtgtaggaggtcccagcccactgtgagcaacaccatttgctgggttgtataaggagcctgtgagcaatgcacagagctaaccaccaagcagtattaccatagtttctgcttcaggttcctgtgttgacttccctcagtgatagactttgacttgagagtattagatgaaataaacctttcttttcctaagctgcttttggtcagagtgttttatcataaaaagaaaatggaaaccagaacacataggtgtgtgtgtgtgtgtgtgtgtgtgtgtgtgtgtgtgtgtgcaggtgtgggtagttatgtatatacacataaaatctataggtagaggaaaaatataaaaagaagccctgttatattttcttaccccaatatatattgcatgggaaattatttgtttgtgctaaagttattagatcattaaaataataatagcagctacatttagcatggtggtacatgccttcgatcctgcagcccttgggaggtagagacagcatgatcagaaattcaaggtcatctacagctactcggagtctgattttaaaactgactttgcaacagtgaccttagtgtttgcagtgtatctttaattttgttttcgtcgctttaaaaaaatgtatgaaacaacaaaatatgttgagaattagttctaatgctttgtcttaattcggctcccaaaagatatgcttccagacattgaaaggtccctgcctccagatggctttgattggtaataaagaattactgtacagccattggctgggcaaggagacagacagagctaggactcttagattgcgcgggcaagggaccgagggggtagaagaacagagaaccaccatgacagggagcagagagatcagaattaaaggcctgtcaacatgtaagaatccaggggaagtggccctaggggccactctcctgcttgggtctggggaaccaaatggctgcgggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagatttagaaaatgttaattcaggaataccagaggggagtgagcgttatccatggggagatttagaagtgtccagccattgagctggttaggcatattaaaaaatgaagctgacatgcatgtgtctttcatgtgtgaatccagagctcttgggagggtacagagcgcgagcactctcgtgaccggctgggagcactgagcagctttttaactattcaccactatacagatagagttttaaagatccataggtatctctcttagggtttctattgctgtgatgcaagaacataacccataaacggttattttgcttatgcttccacatccctgttcatcatcaaaggaagtcgggacaagaactcaagtcgaagtggaacctggaggcaggagctgatgcagaggccatggaggggtgctgcttactgccttgctcaccccagcttgcccagcctactttcttatagaacccaggaccaccatcctagggatggccatacccacaatggacaggactctccttcatcaatcactaattaagaaaatgcccttagtcttgcctgcagtccatcttctggaggcactttctcaattgagacttcctcttctctgatgactctaacttgtatcaagttggtataaaaacaggacaggatctgaaatgcctggaggaaccaggaaaactcatctatgtccctaacttgagtttctaggtggctagttaaacaatcttgcagccctcggcacccagcatagggtgcattctctcttaccagtactggctgtgtttgtctcttgtgtgggacttcagcagagaagttcttaacaaaccaaacctacagcctctggacaggacagaagaaacaagaacccaaaggcactgggaagaaatcagaacagaagagagtggagaggacctcacacttggaagaagtgcataccacgagtgagtctcttctctgagttcaggccagcggtggtttgcaccctatacagaggtcaacactcagaaagctacagccacactagtccaggggtcagaggacaaaggtttcatgactattgagtctggaatatacaggagtggggtggaatctcggaaaagagaggtatagaatagaagtcttggtgaagtatgggggggaggtctgcccaaatcccagggaactctgggttctgttcctctgggatacatggaagactcagcccagatacatagttaaggtgaaaagaactcataagagatttcagagatggacagtggtggcacacacctttaatcccagcacttgggaggcagaggcaggtggatttctgagttcaaggccagcttggtctacagagtgagtttcaggacagccagaactgcagagagaaaccctgtcttgaaaaagagatttcagaaatgcccactgtgcacacaaagaagataagtctctgccaaagtgagacaacactactgtattagtcagggttctctagagtcacagaacttaaggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagactcccttcttccaatgtccttatattgtctccagcaaaaggtgtagcccagattaaaggtgtgttccaccacacctttaatcccagatgaaaggcatagcccagattaaaggtgtgttccttaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaattacccagggcaaatatgatttatctataacataccattgtaacacctaaccagaccttaaattattaactgggtgtggtgacgcacacctttaatgggttctcttgggaggcagaggcaggtggatgtctttgagttccaggctagccctgaactgggcttcaggattgttcttccatctacctcctacctcagagtaggcttgctgggattgtaggtatgtgacaatgattcccactttttgtgttgacatgggtcccaggggtacaaatggggatcaccaagcttgaaaagcaagtgttttacctgccgagacatctcctttgccctagggtattgaaggttggttgccctgtggaatctggaatcaaacagtattctcctatatttgatcttcaagtctgttaaggtctattgttctatattgcatttggagtggatatttatgtgtgctattgtcaggtccaaaggaaattccatttctccaaattcaaagagacagaagacacaaaaggctgtggcgccctactagcataccaaagtgcatgctgggtatcacaagtccctgttgcacattgcagagtctttgctagctagcgcagtacccttctcacctcccccataccataagctcccttcagttcctgaggttccccttcccagctcctcggtctccctataaccttgccatttcagatatgctctctcggccttcctcttcctgtcccgagtctccctcttcccctgctccctgctctctgggggatattctccctctttctattccttccacccccctactcctgctcctgctcctctcgtggccaggtcaactctgctggccatgttcagtctactactttctctttctgctctggactcttcaagatgcctgcaatgttctcggtctctcggtctctctctgtctctttgtctctgtctctgtcagtctctgtgtgtctctgtctgtctgtctgtctgtctctcatctacagtggaaaccttccctttaaccaaaccacggaatggtcaggtcatcagtttatacagttgtctcatgtgcttttatttgacacatggtctcaagtagcacaggctggccctgaactcactgtgcagttggggatgatcttgaactctggagcatcctgcctctccctcccaagtgctgggaagacaggcgtgtactaccacaagcccagggtttgcttttgcagtgctctgtgaacacctttctaattgagctaagacatccccagcctttgtgcccctttctaaccttgagatgtgggtccacaccaccaagtaatgttttaaaagtacacagtaagccacagggagcttttcctaccctcccccatgatttctggatagcagatgaaaaataaaaccatcgaatggggtctcttctcaatacaaaactctgtttaacttgagcatttttttttttttaatgacaaagggtctcaccaagtatctccagctaacctgtaactcccttagcacaccaatctggatgcaacctcatagaaatctgcctacctctgcctccagagtactgagcttaaagtcatgggtcactactcctggcggcatgagtgcttttaacaacaggcaggcatggggatatggtgagtacaaataaaaataacaagaccattctcggagagaggaaacatcagcttgtaagggacgatgacctgacctcagggagcctgcccctcccctgcagggggacgatggaatcatggggcttcatcctgactttgatgcagctctggtaggctcaacagaagtgcaccatgatttttcttgctgcgatgttcatgggcaaatgctttattcagtgagatagttatggacctgacacaggagtagcaaagtagcaaaagaacggtacttcaaagccctgcagtacattctatctgctgcggctgggggtggaggtgggggtgatttctggattgtcatgaaccacagagagagactgaccgaactgtcatctgctgctctattatggacctcctaaaagcagtggcttagctattggaaatgggttcttatgtagcccaggctggatttaaactcactgtatagctcaggatggcctactgagtttactgagtgttgagattgaaggtataccatgcctggtaagtggggtctaatctgagagaaagggaagccactaaaaacaatctagatggatgtgcacatctaagtagttccagtaaaggtgtggtcccgcccacagtatctgggctccagaagcagcaaggaaagtagtcaaatgagttgtaggactgggtgaaatctctttccaggattaggtgtcttctctctctggcaccttttccttctccctggggacccctggggagaaatccccatgtctttggggcccattgtttcaataatctcaaggtcaaatggagagacacaaatgtctgtttagaacatcctcattcctgccaggccagctctacacctggactacagccttctcggcagaggaagaaacaccagggacaggcgaatacagtggagaagtcatgtggggacaaaatgagaaggtgaccatctgccagcccggaagataagcctcagaagaaactgaccttgccagcactgtgactttgtattcccacctccacgtctatgaggaaatcaaatctgttgtttaagccacctgatttgtggcagccagagaagactggataccctgtcctgtcccccttcgcaccacaggaggacagaagagctagaggacatttacacaattctacctactggacaagggcttaaaggacaagaaagaatgaattccagaggtataacaggataggaaccaaactatagatttctggttctctagcaacagagaagggaattctatacctcttaggagaagcaggagggtatactctcaggctcagaacgtgagagaaatagagagctttgtggcaattctcacccttatttgttggggtaagttggggggatggccatattgttatcaacggatccaggtgctccttgcttctcggcaaatcccacctcaatagacacatcagaagctaaaaatatcctgcatcaaaatgtgcttaatacttcccaggtgctaaatatgccagcttagcgaagtgggactctgcccagtgtcccttgggttgtcatgatcctgggctgagcaggagatgctgctgccagcctttgaaaggatgcaaattcacaatagatttttttcatttgtgtgtgcatgtatgaatgtctaagtgtgcacacatgcatatgtgtgtgtgactgtccaagtgtgcacacatgcatgtgtatgtgaatgtctaagtgtgcacaatgtgtgtgaaggcccgaggacctccacaccctgaagtggtgtaccacttcgcctggctgttcatttgtgccctttgagattttctttgtaatgagcccgccgtggacataaaaggcttacatcacttctgtgaggtactctgagaaaagaatgaccccgaggaaagggtggtgggagctggtgcagagctggttggtcagaaatatgggaggcctcggatctctagttggtggctaacctaggcagtgttgggtggcctcatataaaaagccaattggccaaataaacaaactggggaaaacccaaagccttcccagtgcaatgaagtcttataatttgatgttgtctctgcatctgtcttggacatgaactcacctctcttaccgctgaggtggggcccagtcaccctgatgcagttggttttcagttctctgcctccctggttcttaatttgctcaattcggatgtctgtcttgccttcactgggagagcctgaagcactgtcctcactgattgtcacaccctatgttgactgccagggaggcagggaggcagggatgcagggaggcaggtatgcagggatgcagggaggcagggatgcagggaggcagggatgcagggaggcagggaggcagggatgcagggaggcagggaggcagggatgcagggaggcagggaggcagggaagcagggaggcagggaagcagggaggcagggaagcagggaggcagggatgcagggatgaccctctcaccatagccggactccaggggcttgctctaaacccaccaattagaagccaccatgctggctggctttcatccttaatcaagtgctctctctccctactccctcttcctcttgctcctttctcctcccttctccccccacccctatctctcccactagttggcctcccttttaccccgacacctcctatctgcctagaaatttcaaaactaagttggagaaacagtaacagtaacaatctcaacgcttagcgaaaggaacattgtgattagaaaaaaagacacaatgtaactttcaagagcaacaacctccccagcgagcagacactcaggattccactggctctcttccgtttggaccaaagccagcaggcagaacactgaagggacatgtgcttcggacgttgaaggtaattatacagaatctctttttctttctttttaaaatagtgatttctttttctgggctttagtggtctgcctgcttgtttgcgtgagggtgccagatcctctggaacttgatttacagacaactctgtgctgccatgcaggtgtggggaattgaacttgggggtcctccggaagagcagcaagtgctcttaaccactgagccatctctctagtccttataccggaatttatatggccagagtgtaatttgcttgtctggaaggacagggaatactctaaggagacattctatctcttcctttagattcagactaggaaggctcgctcctcagggaactggaaaacctccactcccaacacccccccccccccttctcacagtggagaaggaaaagcttaaatttctcacagatagtgctgggtcaaagatgaaagggaccacacattaacctgggcctggctatgcatgattttggctctctacttcaacttgtgtgaggcttctgtctaaagataagttcctcctctgactggtcctaaacttccccatcttcacctgggattcagggaagagaggagggagtccccactgttttttttttttttttttgttttgtttttttctttttgagacagggtttctctgtctctgtcagaccaggctggcctctgcctcccaagtgctgggactaaaggtgtgtgccaccaccgccaggtgggagtccccactgttaaagaccttgtggatttcaacaatctgatgatacacaggggaggggaacaagggtctgtctttcgagtatcttccttccttccgggatggtcagtcacaagcctactatggaccaagtgcatggaggcaagaccctcttgtcctcttcatttaagcgtttccacactttaaagatgcctctccttttctgagctggcaaaagattaaagctacccaggcgacctaggcaaagagtgcctgggcggggccagacaacgaggggcggggccaaagcgaccgacgcctgtcgtgtgcgtgcgcggctccaagcggggggcggagcctggccgcgggcgcccgctgtaaacatacaacatggcggcggcggctccaggcgctctgggcgccttgagaacgggtcgcgtccgcctggtggccgcgtgctgcgcgcggctcggccccgcggcctgggctaggggtaccgccccgaggaggggctacagctcagaggtgaagacggaggatgagttgcgcgtgcggcacctggaggaggagaaccgaggtgagctgcgggcaagcgcgggcgaggccgtggaggtctgccccggctgtcactgcgtccccgagggtacggtggccttccgggttcagcctgcacagtgatgatgctcgcgcctggggtctctccagccaaggtcaatgcggagcgtgtagtacagggccagggttgcttcttgctgtgtaatagctccctgctaccccaggcgtcaatgcgagagttgtaggagctgcagcggggatgcctttttattattcgagagaagcttaaattagaagcatccttttgcacatattatctcagagagttagttttggggggctgttgcacttcacttaaagaattttgaacgctttttaaattttttgccttgctgagctccgtggggggtaaataatgaggctattcatcttgcccttgggctgattacggtgggaggagacagatattattagtgcatggcaaagggtggaaagctatgaaaaggtaagatgcagaggaatattgagtttcctttagttgcagtgtcggcttaactatagtgattgagaaggtggaagaacgtattgcccaagaaggaagagaggaccactgaatgcattttgacatccatttattggatgctggaatctgttaagaagtggaaaataagtcagtatggctgtctttttagaagctctcctgtgtattgaaggtcagatgacgcttgcttcaaggcttgttgagaaccccgaaatgcctgcagggtttatctctcactgttataacctaggctgccctggaagttaagatccccagatttaagagtgctgggatcacagggctgaaccacagtgtctacttcaaggcattctgtaggcaacacgagactgacagttctgatgcaaagttccctgtgctccacccatcgaatatatcaagcagaatgataggcactccatgaggtggttgtggagatgggaaggataccgtgtattgagggttgagcagcctctgcagggtgctcagaagtatgcggagtcattttgtttcttgcacgttcaagccttctgagacagcggaatggtcaaaatgatggagatatttatttgggaaatgacagaagacaagtatggtgtgacagagttgtaggaagctaagctggggccttagaggcctggaatcattaaagccttggatgccagtctttttgggtaagcttagttttgctggcgtttcagttatgttatatgctccgggggtgtgttacttatgaaggggttgggagcgttgttagctgtatgtatatgctttagtgggtgttcgtgtgtgtttgtacgcacgttcacacagaacttcctggaagtctttaagttgggatgcgattggactgcaggggaagatacagcccttggaagattatttaatatttcgataaactgtaatgtttatcttgaaggcagatatcagtaattaggacatcctggcctaacgactgacccagcatccttttgaggattggcagaagtgacggtgcaggctttgctttctttttatgtctgagccaacttataagtagtgcagaggaagatgcgggagccagggtactgcagatggagtctctgaaaggtgggtggtacagggacactgaatcagattgtcactggtttagttactagtggcttgccatggacagacagacagacagacagacagcaaacagcatggcagggactcaggagagttcaagccttggttccagagacagacaacattgagggagatctgaagagtggaatcaggccttatgaagcaggagttgtggtcttttacagatgtttgaggacggataggtgtagtttctcagcaggatcgtctgtgtgtgtgtgtgtgtgtgtgtgtgcgcgcgcgcgcgcgcgcgcgcgtccatcagtatctcctttgacgtaaactcacttctggtgagaaatctgttctcagcagggcgcgtgatggtctgtgagagggaaggggctgctgtgggtatcgtggcctgagtgggagtggattttgacattacactatcaatagtctcctggtgcttctgtcagagcgatgagtccacaatgtgacgctctcagcctttcaggacggtgagaaccctctgggggcaaagaagcaccaggcttccttggtgaggtttaggctggttactggggtaggctcaaagcttgcagctattgtcagggctgtgtttgtgatttgcagcccagatccttgcagagagccacgttttgggcttgcagaggcctctcttagcccttccccctggtctcctggctgcaaccaccctgttcccacgtgactcttcaccttggtgagctgggagtcctttgcttgcaggtcttctccacccctgccacacaccccgcagcttcacctaaggttgttcctctgcagtcctttctgtttgggtttctgcacgcacttcccagactggtatctccctaccccgaggaacttgggctgtaatgtaacccattttaaagatgtctttgtgaaactgttgcgggtagtttctggcagacagaacaaagaagcaagtgaccagagcagtggctcttaaagcatggccttcatccttcacgatgcaaagatccgtcgagagatttcactgaaacctttcatggcctttacttatgccagcttcattcaaatgaggctggtagacatggccggcatctgctagcacacctttctctatgtactagaaagatctatttccatgcaattttatgaatatgtgaactacctaataataaagttatagtgtctgggttcaagccgctgatgtcggtgctgggaaccgaactcaggtcctgagaacggcaggtgctcttgaccactgaaccatctctccagcttcagtttggaacattaaaaaaaaaaaaaatcaaactcaaatcctttagtcttcaatgggacacttcatattccccctcccaagacacaccagaatcattttgtttccataagtttgtgtgcactgactgacatttctgcttcttctcttgtcaggaagggaattattttgctaatttcattttccagctactccttacaggtgtgtaggaatccacaggagttttgtctgtaggcattgtattgtgtgcttggatagcctctttgctttgtatacttcccatatatggcatgtcatttgcacattgagtggctttgcttctttctgaaggtcttcattccttttttcttgctaagttacacggctggagcctcgtctggctgctcttgatctgtggaggaaagctttgtcagactttgcccactcagtctgatgctagtggtacctacgtttgttttgccctttatcagttgagtgaggaatttatagagtgaatttttagctcatttttttatcttgttgaattttgctaaatactttttctgggatgatcttggcttttcttgcttttagtttgttagtgtgatgaattattttaaatgcctttcagtaatgacccccacctctatctctggaagtaaattccaaccggttgggatagtttttatgtattgttggagttgatatgcttctattttatttgcatctatatttacgagaagtactggtgtttagttttccgttcctgtaatctttgtccagttcagtgctaaccctgtagacttgggtaggacatggtgcttctgtttctgattttcatagagacttgagaagtgctctttgatagaggcttttcaaattattcatcttatagcaaaacaaaataaaacaaaacaccattttgggggactgggagatatagcttagggtgtgaagtgcttactgtgtgcatgtaaagcctgggtccggaccgtcagaagctatccaaatgcccgctggcattagtggctgtaggttttgtaatctcatcgcgttaagaggcggagagagggaatcttagagctgagctagccaaagctggctgactcttggtttagatgagagacgtcagccttggttccacagacagacacacatatgttggtgtattcgttttattattttgttgggttcttctacatcttccttccttccaacttttagtccaccataatccctcccaacccccaacactaggtgggaaagaaagcttagaggggaagggggcatagatctctttcagctaacaaaatctactacttcttgctgattaaaggcgttgggttccttgaggcaagtccagttttcatcgtcaggatatccagcagcccagcaatagcaaatgcaggggtagcagcacccaccttctttggagcactggcgcccctcttgggactctggtatttattctctttccagaatcctcagagttagactgcctgcagcaggcaaaaatcatggcccttttagagtacaagacaatcatagttggcagctgtggacagactgaagcagcacatatcccccacctgggattaaaccaaaacaatagaactgggctcactcattcactcactaactaatgcgcacgcatacatgcacgcacatgtttttgtttcgttgaactttctgtgctgatttttggttcccagtgttgtggattctggtgccttttgcctctctgttcctttgcatttagtttgctctccttgttcttttaagatagttttgctggcctggaattaaggtcttgtttcagcctccagagtgcccgggctacaggagtgcactactacgtgtattaaggtcttttcacctccagtgtgtctgtcctactgatgttcccttgagcttgagaaagctccgctgtgactgggtggagcttctgcagtcagtgagctgcggctgggcccgtctgctggtagaagtgagtttctggctgcagtgctgtgaggcatgggtttgtctcttctctacatagctccgttggttcttcttcgggtgcaagggcattggagatgatgatgtcttagaggagtgggatccctgcactatggaaggctttcttttgggaggccgtgtcttgctctgaattcagctccagctccctgccagcatgatttatcttaaacaaatgtgtctttagagctagacaccaagtcttgcttatcacctactctgatcatcgtatctatctacctgtccatctatcaattcatccatccatccatctgtctgttattggtgctggaccaaagttcataaactcagggaggctaagttcacataggtcaagtgttccacctgctgagccatatctccaacctggatctctaggtccttcaagcctgaagttacttctgagatcattggttattttgtatcacgtttgtgccttctgttgtcttgttaaccggtttcttcaccctcaacccttggtcttctgtatttaggtgtaagtctgtatcattttggcctcagataaaacagaaacaaattaaatcaaacgatacataaaagaactacttaccacaaccatgtgggagttactctggggatgcaggtgtgggtctttattgaaatgcatttaaagtaattcaccacaggggcagactaagcaagaaaaaccagttatcccaacacactcagaaaaagcatctgacaaaatccaccacgggaaaaactcattctagaaactgaagaaagagtccgccacctatacagggcaaaacgtggacaccagcagcatcagacttgagtgagtagggccgtgtagaaaggcaggcttcaggaaccacagagcggctgctcatgaggttgcattattgtctagcatgtttgtacattctgttgccgtgttcagggctccttcagcttcaccctctcggtgttcgtgtgtgtcctttgcttttcccatgaggtggcacctagctatcctagcactttggctccctctgccccacctacttaaggctgctgcattctggaggaacccccccaggtcttgtcttttgctgtcccgttgaaggttgcacgttgatactgctttgatgaccagagtggtttttgtctgtgcctcgcacgcctagagcctaactgctgtttcactgtcatggcttggctccttcctcctcagcccttgttctggttttggtcttttcttggtttttgctgccttgctacttttcaggtgggtttagcagcgctgtgttcagaatcagggtgtgttgagtggatgtgagggaactgtgtacgagctttggcttactgtgtaaggacaagtttaatttgttcaggtctacttttcggttttcagaattgtaagaagtgtctgccagtgtgaattgcccaaatcttgctaaaagtcagtcatttagttattcttctggcctctcctttttagctgtttcagaaatgtgatgtcttcccctaaaagcttttaggagtgtctcctttctgctcccttcctaatgggctattttttatggtatgtttattctgtctttttggctgggtggtgttggcataatgcctttagtcctagcacttagaaggcagtggcaggtggatctcagagagttgaaggccagcctggtctacagagtgagttccaggacagccaaggctacacagagaaaccctgtctccaaaatcaaacaaaaccaaaccaacaaagaatgttttttatggtagtggtgctttttgtgtgtttgttgttttggctttaattgtttctcttttaaggaattgttaagttctaagatgcctgttagaaaagcagctacagggctggagaggtggctcagaggtgaagagcctttattgctgcagtgaggacccaggttctgtcctcagcatccacacagcggctcacaacctccagttccagggcatctgataccctttttttgtggcatccaagacaacaggtacccatgtgcacacatgcccagtttctttagtgttcacaccttaggaatgggtgataatttctaatgctggaagcagagaggatggagttcctgttctgtggtttgatgttgttaccagtggagttattttctaaaattatctttagatgattcactgttaatgtatcaaatgaaaatgttgctgaattcattaattagctctgtaggtttttcatgggctctctgggatttccttcacaggggaccctgtcccctgtcagtggacataatcttacttctctctttcccatcttgaagtcaccgtgctctttgtctctctcctgccacgatgccttcccgaggctctcagcaccgtgctgagtagcagtggggccttatcttgttgttcatctttgcttgaagactgtcttcctggagtttgatgtcagctcgggtttgccccggtgtcctttgtcacattgagctaaagtcttacaggttgtgtctgttgctttctaatcagagggccctgtgcctgtcaggatcttctcttcagtagtagagatggtcataggatttcgagcacttgctagtgttgcttctgtcaatgtggctcatcgccttgattggtgggcgttgcctttggcttgtgtgtaaggtacgtataaacctagttggtctttgtacttttagatcttgatatttgttaaatgattctgtctgtcttagggcttctattgcagtgaagagacaccatgaccaaggcaactcttaaaaggcaaacatttatttggggctggcttatacttttagaggttcagtctattatcaacatgtccggaagcatggcatcctgcaggcaggcaaggtgctggagagttttacatcttttgcactgggcagagcttgagcataggccctcaaaacccacctccacagtgacacacacttcctccaacaaggtcacacccactccaacaaggccacacccactcatggtgccacttctcatgagccaaggctattcacactaacacactgtcagagtttttggaaaactgtgtgaaggtacattttaaggtctttgtcccaccagaagtgtctcttacactgctagttgctaaagccagaaacccagtagatactgctagccctgccttccagggtaaccagccctcaatcaggtttgcattcccacatctcgaataagtcttgaatcttttcagttcccttggtttgtactggtgtcagcctccagatgggcagccctgccccgggatcacatgagtatgtgcattgtgtagaaccagtttctgttagctgctactccttgttcttaggctaaagagaactttgatcttggcctgcagccgttttttgacctgtgctgacttctttacttggttgaccgcttgctcttctcacccctcccatcatgcactctccgtggctgctttgtgcttccttctgtgtgtcctctgccccgaattcagtctctctattattcatttttcatgtatgtcaaaatatctgtattgtacagagataatgtaaataaggaaggagttgtttttgggctagtggcttcagaaggttcattccttggtggtttgagcccaccatgcatttcggcagaacaccttactggtaggaatgtaccgtggaggaagctgtttctcctcctggaggactgtgagctgagggaaggaagataggaaggggccagggaagatataaccccacactcagtgacccatttcctccagccaggcccccccccccccccgtctttgctactttctcataatgccatcacactaagactctatcgggggtgccttcattcccgtcagtaattcataaacaggcaggggtggtcacagccacccctagaggtgtccttcagtagttctgggcatatcttaatccagtcgagcctctttccaatggtttcctctttcctacctgctcttccttctggctcctctcagcagtgcctggaggaacctttccttgaccatcttcctttgccccaggccatgccaacctgaccagaatcaccaggtgattggtgggtatttcaggtgccactgagcactgtcgtgtgggctcagcacatctggcccgagctgctaacttttcttgacatggaaaccgaagcttggatgtagtgcagccacttaggtgtggagtcagagagccacctacacgataacggcaaatccttaacctctgcagcctacctggggccgaatgctggctacctgtcaggttgctatgggatcagtgagctagcatacccaaggctgtaggccctgttggaccacagccctcagtcactgcagaaggccttcaaacggtcacagcctcaggccctgcaagcttgtctccaccccgaggggcatctggactctggacgtgtgcatcttgctttgatttaagtcaggaacagataaggcccacacccagtgctggagagggcatttctgactcccagtggacgtgtgtgcttagggggaaggtcgagtgcaggtggatagacccgcagagctaagagttaaggccactgaatttgggtattttgcaaataagggattttacataagtggtgaatcctgtgctcggacctgctgcagctggggtggccagcttggtttagatgagtgttcaacaagacagggagtgagcagggagagcccgggtctcaggggaaagaaaatgaatttcattttatttgggccgagtcctcattgcctgtagatctgactagaagtgttgatgggcagaggtcaggaggaagcctggcatagaagtactaagactggttcatcagcaaggagcaaggagctacctgcagctgcaacagcgccagaaagcaggacagaggcctgcatgcacccaggccctgctgagctgagccaggagccaggggcaggtgggagagtggctgtcaccagaaggacaatggtgaatgaaggcggatctgcccggctctcctgcgggctccctggtcttctcagagattcaaacctggaaaacattgcagaggcctttgaactgaaggacccatgacgctggcattctccccttaaagtgcagcgagaatattaagcaccagtttaacctgataagtccttagctaccatattaaagaaatagaagtactagctttgaaaaggaagctataactgaaaataaagtcccgtctttgccttggctaggagggcagatcagctaggtgccatgtccgtcattcatccccactctgcagtctgccttctgagcgccccactaacccaagcctgtgtccttcttctccctccctaaccaggcattgtggtgctcgggattaacagagcttatgggaaaaatgcactcagtaaaaatctcctcaagatggtgagtggaagactacgctgtttgcttctaatattaacacatattgttggtatgattttaaaaatgatttttccccttttttcttccctctcccccctatcttggtttagttatcaaaagcggtggatgcattaaagtcagataagaaagttcggaccattatcatcagaagtgaagtccctgggatattctgtgctggtaggtaaaataatctcctgttgtcttaagatttactttcttcacgtgtgtgtgtgtgtgtgtgtgtgtgtgtgtgtgtatgtgtgtgtgtgtatgtgtgtgtctgcgtgccgtacgcgtgggtacctgtgccggtgaggtgagcagggatgactgtatcgcttggggatggagccacaggcatttgatggaagctgaactcaggtcctttggaagagctgcaggagagctttcttcctgtcaccctgtgagctggtcccatgcttcctttgcagtgccccattctcccttcagatcttctgtggttccatccctctttgtttcctcttcacagtttcataagaaaggaatattcttaatctgttagcattggaaagacacttacagcgtgtggattgtttcagaaaacaaaatgcttgggaccgttaagataattatttgaggtaaatgaacaggacctggtgaaactctagcggggggagaaaccaggtctcaggccactgtgttccctgtgcctttgattgcttagcaccatctgcctcatcatggactcttaggtgcaggcctgagctctgaaggatggtgtgtgagtgcctctcacaccctgtgagtgtgcccataagtgtgcagtgagtgtgcccgtgggccgcagtggttttcacactagtggcatgttttcccagcattaaagattgttctcttgggattgacttgttaggactcctgagccacggaggggaaggaatctgtttcccccggtaaacaacctaggcgatcgatcactactgatacgcgggtaatgaaacggattcccctaatcattcaagggaaccccctctagtgttttcatgatggcacaggtgtctctttactaacaagggtctgctctgcctgggccagcctgagaccacgggtgttgacagttcttttggaggcatagtgaccatggctcctgcccctcatgttccccatccttacaagcctggcttcaccccaaaccccagtagaagtttatgggatttaggcacattcagtgcagatgagttacattttggctctggtaaggttttactgcttccgtaaaatgtagcatacctaaaaaggtaacattttactgggtgtgtaattgaagaaggtggctactgccctggcatgtggggggtggtattcccagtacagacttctgttctctgtctgcccaggcaggttgaagggatggtttaacaaagcacaaccctgggtttggcccttggttctaggatctttccctgtgattccccccttccccagaactccagtctgtgtgggtgctgaccgttgtcttacacagctgcatagtgtttgcatccaattctctcatcttcccaggtactttaggtggtctctggatcacttgcattgcctggtaacaatgttaatggctgtgaaaaccatggctgcatggcatttaggcagtgtatacgtgaattgccacaggtatttctgttttcttgctcacttgaatcgaggttttgaaattgtgaatgcaggaggcttacagtgctcagaacgctgtagctccctggtttctaagaactcacacccaaaatgttaggatcctttgtgactttcaggaccagctacagacagtctgggatggagggctatcagggactgcctctgagaacggtgggggtgggggtgggggtgggggtggggagctgttttatcagagatttcgatgttcctgaggcagagcacttcaggtgagcgggccatccatcggtactgtctgccagtcctggctggcctcctgactagccaaccttgtcctttgtcctgcatctctgtgtgtgatgctgttgggatgagacttgagtgttttggtacagtctgctgtttctgttacaggctatgcaagcctagtgccatgtgctagttgttacactcaagtcagcctggttagcacaagttagtctagtatctgctctgtgtgcgtgaacacttttgcatagccagggtatttgttcacattttaattcataagcggtttttgctttgtttttccttttgtattctgtcaagtactcagtgtttgtactatagacagtttggggggcagtttgtttattgtcctaatccacagcctttctccaaagggcatctttttcataaatgtatttgagataggccagaagctctgctagtgtttgtgtgaaatacagttctgtgtcataaaggaaactcaattaagagggtacgtaagctaatcacagcctgtaatgtaaagtcttaatttcggccaggctgtggttgttagttatgcaacactttgtgttctggagtactggaggcggcagagcctcacagctcggctcccatctgcaaatccttggggggttctctgtgccccagaggcactgtcttccctccatgttccccaaaggttgtctttgtacatccgtgttctactgatagcttgttcatttctgataacttgaagcctctggggtgggcttgcctcaggtctctggagcaggggaagctgtctttgaaaaatcctgttttgtggtctcagaacacaaatcgcaatgggactcagcgtgtgtatttgccccagctggacagtgcattcgttcatagtgtgttcttaggggctgttggcttggatgactctgagcatctcagaccatgctcctgtttaccgacagtgtttctagctgtagtcatctgtttattttcccttccttttctcctaaaatatcatgaaaacaggcagttactacctgggtcaggaaaaggattcattcctacatagcattggagcttagaccgggaggcctgacttcccatttaaatctcacggtagaattgaaactctattttacttacattttaaatcaaaatgtaaacaatagattctggatcaaaatattggaaaaagtgtacaaagagaaggctttcctcaccctacattcctctaataaagacactttatcacgtctaattactaaatactattgtatcactctaccaagcacacagacgtgcaagaggattgacgcgtcaattagaatgttaagtgggcacttagggtgaaggcggcgctgagacgtggggtgctagcagcagagagggggtgcacgttgatgtccctcctagcatcactccagccctgtggactgtttacaagtcagaccttgggttgggcatacagtttatcctgaaacttctgaaatggtgatctcctttgcagaagctaactggatagtgcatagggtgcctaagtgtactttctgaagtgatagctatggtggtgactcagctcctgggttagtctaaaaccactgaaggaaaaggctaagaccaaaacacggacttacagagtccgttatgtagaggcctgtgcggcgaagtgctcctgtgctgcagatgcagcccaggccctttcccatgttcagcaggggccgtaccccatgtaccccagtgttgtaatgtcaaaccctcaggcttttgttttgttttgttttttaaccttgacttttatcctaagatctcaaaggagcaacctccctttccccacccccaccccccaactgtgtgcttattgcctcagtggctttgcagaccaggatgcatagtgcgtggttccttgtaggttaaagcttctggactcacggttggcccctttggaatattgcaggggacattgtgtgcgtgcgtgtgtgtgtgtgtgtgtgtgtgtgtgtgtgtgtgtgtgtatgtgtggggggcgttatcagccctacatagctttgtcccctatgcttgataggaattgtgtatttgatttaaggttcacctctttacatatgtattcgtcctctaaaatctgttatttcccgatgcttaggatctgtttagttttagtaatgtcaccttcgatggaatgatggaaaagccctttaggtcaggctgctcggcgtgtagaagctgccagcagctggtccctgtggtcagctgttatctttgcgtctctgttctaacaccacgcagtaaatacgtggtggtgtttttaccgtaacgttctaaaatgaaaacttaaccaagcctcgcttttgcctcattgcagtttctggacaaatgacacccagttcttagcagccgttgctctgcgcagagtctaaattgagtgtttcactgaattatgccagtgtgggttttttcccccaaaaagtaaaggtcgtttcgcttctgcttttgaattctagtaaattgtgttatgactaaggcctcctcactaaaaccgtcagcacgcgttgttaaatggtgtgtgttcagatgtcatgacgggaattgagtgtgggagcctctgactaatgaagaaatctatttaagagattgcttcagagcctcggggtttcgctctgatgtgttatacaagtcagttctgtaggagtgaaggggcacagggctattttgctcttttgtgttgcatgcattggtttacataaaacactgctaactatttcattgaggatatgaactacttggaatgacatttaccacttttaagtgcataattgatgttttaacagatgtttaagccttggtatacagactgtccatttgtataaatcttttttttttcttacagtgaagaacccttaaaaccaaaaaaaaaaaaaaaaaaaaaaaaaaaggctactttgtctcctcagacaaaggtgtttggaaccttgcaggatagattgtaggtcttttgtgtctggcctgtttgatctaccataatgctttgctgtttggccgtgaatttccgtggttccattttcctgtggagctgctggttttctgctgagcacgtgatagtttggttttgtgcggaccacacttgcatcagcaccgttcagtcactgtaaggaaacaactgaggtgatggactctgaccgaggaaaggctaattcatctgggttcagaggtgtggaggctccagttctatgtttggtggccccttggtcaggactatggtggctaagtgcatcagggctgggatgacttgggacatcttagagggaaggttcaccctgaaactatggtggtttctgagacgttcacagacaagtctttgtgggcgtgtgtttttattctcttgggtgggtgagtgctcaggagtggagttactaggtcttctacaaccgagccagccacacacaagttcttagttagatgccgcaagacctccaaactaagaggccaagagagagaatgtgtgtttgtgtgtgtgtctatgtgtgcatagagagtgtgagtgtgtttatgtgtgcatgagagtgtatgtgtgtttatgtatgcatagagagtgtgtgtgtttacatgtgtatgagagtgtgtgtgtgtgtgtatgagagtatgtgtgtttatgtgtgcatgagagaatgtgggggtgtgggggtgagagagagagtgagtgcgtgagagagagcgagagcgagagagcacagagagaggagtgtgccctggtgctgtgatgcatcctgccgctcatggcattatgactctagtctgcatttctctaatgagtctaaacgtcttgtcctgtgcccgtttgtcacagtgtctatgtagatatattgtctccatttatgtcctgccctgttccagccccccaccccccactgccacctcttccccctttcattcatggtctcctcctgtcccgctttctttgcctgttctcattcaccctctcaggcatggtttctctgtgtagctcaggctaaccttgaacttgtgattcccttgcctcagcttctcagagtgcttggattgtaggtgtgtgtcaccatccttggcttccatatttttattgagtgtccccttactgagtagaggtccctgtctctgtttgaaacagtgctctgctcttctctggcatgctctgccactcagccacgtaactgttctttttttgttgcagtttcttttcagctgaaggctgacatccagctttgtttccaatttgcacctttttggtggccgctccagagtcacagctcacagaagccagaagtgactcctgactcccggtgctctcctcagatctgggcctagggtggatccgcagttaagttgtgtgtatctagtgacgtagggttgaattgttaggggacaataaaacacacacagtctctgcttcggttcccagtgtggcgctcatgagcacatggacgccgtgcctcacgtttgcctgagaggtgacctccataggtctctgaatggattagagggcctgactggtaccctagtctgcatctcatagcaagtggataggggccagaggctgagtttaaccattaaactattaaagggccctcaagagatttcttcccttggggcccagacatgctgtcagggtagtgatggatctgtgtgtgtccgtcccccctccccctctgtggcctctgctggcacgtttctgaggcttgcctccacagtggtagaactgcacattgcctgagttccttgagttgtttttagtgagtgagtttgggcagggctttgagggaaaccccacatttatatcatggttggtcagaagtatgaattgttcttaggatttgtcttatgattgacttttttgtttgtttgtgttttttttttttttttttttttgagacagggtttctctgtgtagtcctgactgtcctggaactcactctgtagaccaggctggcctcaaactcagaaatccgcctgcctctgcctcccaagtgctgggattaaaggtgtgcgccaattgatttttgaggggaggacagtctctgctagacagcctgtgtgacttcaggagctccccctgacagagttcaattgagtttttggatactggcctggccagcgagctagagaactggtgtgggtccctctgagacagccgtgctgacagtccacgtgatagatagggtgtagagcccacggaagggcaggcctgtgaggggcaatcttgtttggttaaattgaggtgtgaaggcccaccctaaaggagcggtcagcgccagccatcattctctgcttccagctgtccgaagcttcccccaggacttccctgccttacagagtgtgccctcaaatgaatcacaccaacctttcttcctcgaggcattttatcatggctacaggaaacaaagccaagttgccccctgcatctgctgtaggatttagaagctagaaagtcacttaccatggaaaagtgaggttgcttagggcagggcaggtgggagtgtgactgagggtgcagagcctcccctgacttctttgggcctgtcactgtcctgagaatggccaggggttcttatcagagagtcctggtgcttagaggagcccatggaggtcttcctgtgtagtgttgggggttaagtccttgcccattggggattgagcacccattctccgaccatcatccctgcccacccagtggagtagggtggggctgaaagttcttaccttctaatcctagctttactccctagtgaccagtccagtgctgaagccgcgccctgacccaggagagtcacgtgacccacataacctctagcttgtttgggaagggctgctttgaataacaaaaggtactccagagttcaaagcttgggactcagtaccagaaacctggagtctaagccaggcacagctttcactatgccataggctgttatttctctttatttgacttatttgttgcatatgcatattgaatttttctagcagccatttgttgaaatgactttcctcccatcgagttattgagggactttactaaaatcattagatgctatgtattgagtcattctctttgctccattaatgaacattggttaatacagcactatactgtctcagttactgtgttagattgggaacactgtattagtttattctgttgctataacaaaacacctgagtttgtaccctttatttagttttgaaagctgaaagtctgggacctggctacaccatcaggtgtgatctctgatgaaggctcctgcttgcatcacctgctagtgatatcgtagtggcccaagcacacagcagtgacaggaaaccagagagctggtaaaagccaccaagcttgccagtgcatgccagctactctccctgaaacttacctgctccatgagaattgtttgctttttagcactcctgcacccccagtgctctgtacctcctaggctcttctcacaaatgtccagcatccccaagtactaccactcggggacccatcaccaccaagacatgagccccggggagcggttaaaactccaaaaacacagcagttatttagctggatttattttcaagcatccagtggttcttgtggatttctgatttttattcctagcacaaggcagtccatacagctggtttccttgatgccctcacattttaggaagcacctcagatcatgtacttcagatagtcgcagtatctgcgagggagctgtgtttcccagcatctttgccttcctgtttccagcatcatgctcacttcatgcatgcagcaaatcgagtcaacagtggcaagacctgtcctggtcctttctcacctccacagaagtcaccgcaccagcaccagccggctctcagctgacaatgttaaagagagttctctagacctccatttcctagagattaaaataaaagcaaaaccacaaaaccctcatcagcatgagttgaatttgcaaacttgttacaacagttatgtgtatatcctttctgccggttaacgtgctaggttacagattgtcagatattaaagaactattcccggaccaaatctcttggtcacagtgcattctttctgcatatgagcagcctgtcagtctctgatttgctaaaatgaggcaatctccagttagctccaccaggacagttgctctcttgagtgtttgggtcatgctgggctcataagaactcttgacttctggcttcctggaaatgtgtatagaatttttattaattcttagcggcttggtaaacttactgtggaagccagctggcctctgggcttccttagtgggaaggttttaactatgagtgtaatgtcgttagcagatgcagcggcagggcatttatctgtttcttttgggacaattttgttaatttgtgattttttttttttttatttttaaaagggaaatcaagtttattagcatcaagctgctccctcccccacctccaccccctctgcttttcgtgtgtgtggagtcagcagttaggagtgtccgcattcggacagttttgtgttgtgtttgctttgagtgtgcagtgctggctggtctatgtctcaggaccgtcatgtgccctcttctctagcacccacctgcagcctcagctctgagctcagcctttgtcctctctctgttggtttcccacatggggtcttcaccagcctttaacttttcatcctcctgcctcagcttcccaagcgctgagatcacagatgtgtgtcacatgcccagctttttaaaattctttataacttttgtcttttttttctctgtctctcttaaaatacaaaataatcgtttcactcgtcctttcaaaagctagctcttcctttcgccgagttgtctttccctttctgtctcagtgtgcttgggactcagtcttctgtttctcttaggcagaaagaagctcagatcttacatttgatcttcttctccagagtgaccttttcacggttatgcgcctgcgctctcttccgtcgatcctgctaggattcccatcggttccaaggaagtaattgattggctgtcattaacttctaactctgtttccgcctcagcagaccagccggaatactgtcctagattttgtacatacccttttcttagcacatcggagatacccattagtaatgacgctgctggctcatcttgcctttggcctggccactcagcactttccgcacacaacccaagtgattgatctcagagcactgcgcctgcccagcatcaccgctgtctggaaggctagctgagggcccagacctgccgggctagcgacctgctgcactgatatgcacaggaggcttgccagatggaagccacagatctcatggtgtggatggagattttcctgctctgttaattgggcctgtggacgatatagtgtcccctgttaggtggaggaaggggtctttgacaacaacaaatgatgctgggagccagaaatcagtcatgcaagtagtggcctcaagccacttggagagacatgggcacttagcctaccctggtgcctccagaatcacaggcctgcctagagagactgggtgtgacccactgtgatggtttgaatatgcttggtccaaggaataacattattaggaggtgtggccttgttagaatagatgtgtcactgtggacgtgggcttcaagaccctcatcctagctgcctagaagccaatcttctgccagcagccttcagatcagatgaagatgtagaactctccgctcttccatccctgtgtctgcctggatgctgccgtgctcccaccttgatgataatgggctgaacctgtaagccaggcacaattaagtgttgtttttatgagttgccttggtcatggtgtctgttcacagcagtcaaaccctaagacactcatctagagataatgacagacacgtctgtagttgctttcctagcaacagcagggcagctgacaccaagcacgttaggtttcatctgccctggccacaacctcttctgccctgtgccctgcctttgccctcttctgtcacctctgacagacagcccttattctctggcagacaaagctcattctcttcccagactcagtacacctattgcttggagccaacttgcctcagatcttccagcctctgtaactttaatttttttcaaatcttatttttaatgatggcttttaaaaacactttaacctccctatagcccgcctccaacaagtggtagtggaaaagaaaggatgggggtgggggaagtggacctgtttagaaagcaactccagtctgtgttgtctggaaatctggaaatcggcagttcagttcacaggttagcaggcagtggcagcatggtccacttgcaaacacctcacggatacaccagcaatcgagttcggaagtcaggttagcaacagcagtgacacgacctagcagagatagccaggtctcagccttggctcgagtcagcaggagggaccttgcgggtgggggggaaaccaagagaagttctcagcctctctcagggaagcgaagatatgagagccacaaacatcacgcagctagctggaccagcaagccaagctctgtctccatcgttccgtggagtcctatttataccctcccaacatcgcatgtttaccacgtgccttgcctcggcaagctcatcctatcagcccgagtcctcggaagctgcaacaaactacagcacaccaccggaagtttttttgtgcgtttctctctatggagtcccgacaaatgcagctcaactacacagtgtaaggtggaccaatacacgcatgtcattagcaaagaatccttatcacgtgtcctttcacgagcttgcttcagcagagcatcccctctcctgtgtctgcttcagcgaaacattcctccttcaccaggctgccttagcctttcacctgtgaccactttgacggaaggttccttcacgtgtctgccccagctaaacaccatccaaccgactttccaaagaacccttaagtttccactttggtcctcagaggtggtccccattcacctaactatccattttacttctgtaaaagtccaccgatgctggagagctggctcagaagttaagaacacttactgcaggttgcagaggacccgagtttggttcccagcactcacggcagcctgtagttcttggaagcacacatttacctcacgtgtacctaccatagttgacaataataaaaaccagtccatctttctgtttgaggctgctctctcactgaagctggagcgtattcattcggctaaggtggtcggctgctgagcttcagggattctcctggtgctccccattatggaagtgtgctcccaactcagaccctcgtgcttgcatagcagctgcccacccagccgcacatctttctcactcacagtttattagtagcttgtttgtaacatggcggatgtagcactgagaggccatactattgagatatacaggtccctaaaggcactgttttgaaaggtgtgtaggatattttccctccagtgtgcttttgttgcatcccagatttaggttcccttcattgtatcttatcttgactatataaatgtcgacatggtttcagaagttagaactgcagaggcgacaccttaggaaagcccgtgccctcaccactgtacccttgcttacgtcaggcggtagtatactcgggaaaccgttccatgtgagttcccagaaccgtgaaggtgaccgccatgaaaatggggtaagtgggactctctggaggagccctggtcagcgtgcatgtgggtggagtcctttaccctatgaggacagcaggggtctggtgccgggcaggagcagaagttgagaaaaagcctgaggaaaactggagtgagtcctggtggaatcctgcaccacagctgccctgtgctagccaggttttttaattggaaattttatgcttaattagcatccaaggggtgtttgtcctggaggagattcaggcagcttttccactacaagcaatgctgggggcctggtaagccaccaagctctgctcttccagagagcctctctcctccttagcatcacctacccattcgctctccattcagagtgtctagaaatttcctgtgataactagcctggtctataggcccccactgattaaggtcacgttcccaccccaccccttttgtgagcattatgatagtttatgtagcaaaaagttgcctataaaaatgcatatgagtgagacatcatagtaaagcaggccctttggggagcagacccgggcctctctgctcagaggccatcatccttagcacttgtaacacttgctgatcctgggggatcaggatttgtttagctcagtggctagcaagtgcaaggccctgggttggagcccagctgcaagggaaaaaaaaaaaaaagggtagcatttgctgtctcctcctgtggccactggccctgggttttctgtggctcactagtgtcgtctccccaccccccgctgtttccaagatggctaaagggttaaagtccctcagggttcttggcgatcggataccaacatttaatttcagcgaccacctcttgtctgaaaatgactttagcctttaagagtggtggccctcgctcatggcagctcctgggcaggctccgggtgaggccgtggaggagcggcagccatgagcacagactgtgttgcataaggtcacgtgcccagagtggagaagcactcgagtagaagcaggttatcatggtttgattctcctctggatggcgaggagcttgcagtatcctgcagcagcagaaggctcacaggtgatcccatcgccagaagccagtgtcttctgagcccgtctgaaaagccttcgcagtcatcagatgcttccgtggtcctaggcctcccgcttgcgtatggctttgatgatggaatatttttgccctattgtaggctggagccttgaactgagctggactaactaaccagagcctacccagaggggtctggggtttggggcgtcaggttcacatttgtggacaggagctagtaaagaacaaaagtaaggaaatgggggtgggagggagaggggggatgccgtgggaagaagacggcttgcaagttcctactggaaactaagggcttcagggcccagtgtgagggccgggcatggcaggcttggtggatggagtgcttggttgtcaggcacagagctttgctttcacacttgtggtgtgttcctataagcccagggcttgggaggtggagataggacccagcatatcagaggccagcctgggctaaacgccacactgtctcaaaaactcagaaggaagcctgtgccttgggtctgaagctcgtgcaatgttgcgaaggggcctggggactctgcgaagtttctgagccccacaaatgtggttttctcccttagtctcaagagcctcccctccctccaggaggagctatttcaactgtgttctttccagaacttcctgggtctctcagtagggtacagggttgaggcgttcctttctgcgtttcctctcttgcacagaggatgctcagtcccaatctgtccttcactgcagggaaaaggaaaggccttgacttcccttgcagaggggcctatagagggatggcaccggacagacacttcatcgggatccttatcagtgatttctaggttgttgttgttgttggttttttttttttttttctcagcaccacttgcaggctgttgagtgaagtggatgccggctgtcagctctttcttgattgctgtgtgattatcaccccccccccccagcagtcagttgagtgaccctgctgtcacaaagctccttcctgctcactgtggaatgtttttctcagcatgagtcaaattgaaagcaaaccctgcaccatcctagtgagaaatggtttccatacaaggatacatgagctagtgagactgcggaagacgggaatcatgggaagatgggagacggcccagaacgagatacatttaaaacataattttacactcagtcctgactagtggttaggtctgttgtttatgtatgatgtggtcagctgtactaatagtgctggtaatgaaattcagtcgggaacaactcatcttatttaaagctacagtgaatttaataacactttagtacatgttcactggaaaaaaaaatgtgagcggttatgagtgaaggtttccaagcacgaagcctgatcatgtggttttaagctgctatggtgtgaccgtgctctgtgggggaacccaggctggtggcagctctgcagggggacttttccaggatctttctctccagtctgtgagtgagcctgagggcaggctcttagccgaggggccctgcattaccctcgcacttcctgcagggacagcgggcaccacatcgcagcaggcctctgtcatctcattgctttccgccctttttccctctgcttcttggtacaggaaatagatggatcagtgactgagagagcgtggttaaaagttgatgcgatggatctttgtcacctttctcctgacgtagttccctgatgtattttgggcctttccttactatgtgaatcagcaagttcaagttgtgtggacttctgaaagtgtgtgtgtggggggtggggggagagaactgatacgtatgtgccatggtgtgtgtggaggtcaaagaacaactcctagaagtcagttctctgcttccacgtggggcctagggtggaacttggcttgtcactcttgcccagcaagcgagtttcattgtgtcacagagtgtgagaacgtgtgtgctttttaccctttactttagccattctttgcccttacctattttttaaggtgccaccttgaaagcaatgtaaagttagattgtgtgtgcacactcggaaattgaaggtgaagtttgccgttggtgacgctgctggcgacgttgctggcatggccacacaagcttcaggacttagttatgaaggcagtagcaaggcctgaagagacgcccgtttgggaagactgctgtgggtgaatgctgtcaagagaacccttcaggcaggcctcagtgaatgaggagaacttcagggtgtctttaagaatggagaccgttaagggcatcgtcacaaactgcaggctagcctggtctacacagagcgagttcctggccagccagtgctacactccaagacgctttctctaaaaaaagaaaccctgaccatgagcggttgctgttttgatgaggttgcagccataggtgctcagcaaggtggaaggtgggaggagtcctccatgctgagggttcaggtgggcttgagcagtcataatttaatgtcaggtggggccacaggaggggacagggtcgcagggtgggattagctagtgtagatgagagtctgcaggtgagcagtctcaggctgtgcgtattcagggagaggctgtaagtgttaggctttgctgcactggtcagttgttgccattgcacatgagcctcgtccagtgggtgggtccaaggccacagcatgtcaacaaagcactcacgcagggctccttccactctctgtattgagactcgatgcccttgctcgcttgcttgcttaatgacctgctgcagagttgaccgtatcttttttttatataccaggaaattaaaaccacccaagtagtttgctttgcatgccagccactccactaaagtagtctggcaaagaacccacagtgtcttgaggtagaacggtggccgttgccttagccagcctctgtcactgtaatattgttattgattatcctgagataatcaatttgtgacgagaaagaattgttctggcccagagttttggaagttttcaacacatgactggttggcccagttgggttgggtgggtggcaggcagcaggaacacgtgggcagagcttaaagttacttctcaggaaggagaggagggtccttcaaggatttcctttcaatgacttgaagacttcctgagaggttcctgtggcactgtcctggggatgaagccttatagtgtgtatccctggaaaaccctacaagaggaagtaggtgttaatcctctcacccctaaggcactgctcttaggtggtattcttagtaatgaacttgagttcataacccatcctgtagtaatggtgtgtttcagaacatcgtctcatgcttgataaatgtgtatagttttatcaatctgagataaattagttaacgctacaaacaagaatgcagtttaaggtataaagcaggcacaggggttatgtggggttggagcttcgtctgcgactgtaccgtgaggatgggtgtgtgctccagtcagggctgcctcaaccattgcagtgctcacgttgggcagcatgtgctcagggttggtcctgaaacatctttggatgcctgacaaatcttcataataaatttttccataaagaattacaatgtaatgaggaaggaagatgttacccaggtattaagccgggtaagttagttcatatggttgttaaaggaagggtgggtgacccagctcagacatgaggtgttccttggctctttttgctggtttatgattcttcagttgctggagttttgcttgttgcaagtctttgttttgcagcttccgcagtcttcccagaaatgaagattgtaaggggccagctctggtttgtgcttggccagagggaatgctgtgtttgctttgatctttggtccagaccactacgactttctctggatgttcagtaaagcattttgcttttcggtgtctcaagttacttagcctttgcaccgagagcttgggctgactgatgcagaagtccggcttcccgcccgtcttggcgttcagtatggctttcccactaatgttaatcatttctggtctttttaaaatgtctaattttattttatgagtgttttgtttcaacctgcacgtatgtatgtgtactgcaagcatgcctggtgcccacagaggtgggagataacattggatttcatggacctagagttacgagccagtggttgtgagccagcgtttaagtattgggacccaagtccgggtcctcaggagagtagtaagtgctcttaaccattgagttgtctctccagcctgacttttggtttaaatttgggagatttgtgtctcatctctttgctagaacatttagaggttccagtatacctattaattgatctcttctccaaattgcatctaggtaagttctctgtcttacctgagcatgattggtgatagcccaaaggggacaaccttcagtgtcattccttagccagtgtccaccttactttttgagacagggtctctccctcgccggaactgacactagtagactcaactggcctgtgagccccagggagctgcctgtctgcctgctgcagtgggctcataaccacacacacaccacttacaaaaacaaaaacatgggtcctgcgctcaaactcgcgttttcaagctcgcagcaagcactgtactgactgagctgtctccctggcctttgcttttttcagactgtgtttgggtgtaggtaacggtgcgaccaaagctctgcattaggaggggcggctagtgggattgttgtaccgtgtgatgtttctcacgagccccttccgtacgtttccacatgggtgtgttagtgtacatcttcactgataaagttcaagggctcccccttctctacaacccccttgctcatttgttgtgaggcagggtcttgccatgctacccagcctagccttgaactcccgatccccctgctttagagtgcatttagtctacagtctggcattcattgtcttttctgaggtgatgttggtgatctcatgttgttggctacttgtatattgtcctttaccctcccctcccccaacagcaacagcaacagcagcagcctgaggtgactcagtgggtgacttgcatgctgcacaagcataaaggcttacacttggatgagtgtggagatgcgttgcaattgtggaggcaggaggatgcccagagctcactgccacccagtctatcccatcagtgagttccaggttaggtgagagacactatcacacaacagaagacaggatacaccagggaaggcacccatggtcagtttctgacctccgctcgtgcatgcgcaggtgcactgcccacactgtacatccatggtcagtctctgacctccgcgcgtgcatgcgcaggtgcaccgcccacactgtacatccatggtcagtctctgacctctgcacgtgcatgctcgggtgcatctctcacatggtacacactcatcgttcctctgcttctgcccccatacacacatcagaaagacaacaagaactctccgtccccatcctgtggcagccagctgttctcttgctgttgggttgggcctcttgtgtgctctaggctgtggggcaggtgtggccaactggcacatgctttcttccattctacaggctgtctctttgctctgctgacagctgtctttgctgcccagagttcttcagttggatgtcatcctatgtgcttccttttgctttgtaactggttgccaagctgagtatcattccgtaactatatttttccttcagcagattcatttgcatttatactcctgattgttttatttaagtccctttaggaagagcacgtcctagctctgttgccatctgttggtgctgtttaactgtttccggtttctcagtgtcctttggctgtactgtgtactgttgtctgtgctttcgacggacggacggtctgcctgagatctcggtggcatgtgcccgagagccactggattaagaggcctgtgctgggctgattctaattctcctccctagggaaggtgtgtgtgtgtgtgtgtgtgtgcgtgtgtgcgtgcgcgcttagcatcccctgggcactgtacatagtcatattctacagtgaataaggagagagggacagccacctctgtgcccctgtgcttagtttgttgtttcaatgggacagcttttggtgaaaccctgtcttgaactcagagcgaaatgaccctttaaggaactcaaatatgtttttctctgctctaaacctagtgttgtgtgataaagtcataattgcgacctcatcccttgcctttaaaccagcgcttctcaggttggatttgcagtcaccgtggtgactttgttgtagttggcctttttcattgctttggccgttacaccctcaagcccagagcagaggcaggaagatcgccatggctcccgcaggatgcaggcgatggcactagtctgaatctgtctgtgacagtgttgttgtgtttgtaactttttagtgaatagatgagtctgtgaaaggcttcttgacttgaattcttatagagcaacagtggtcagtgggtatgacatgaaggggtgctggggagcgaaagctgcaggatgctgctgtggaccacgtgatctctcccacggtcaccaatgcagcgtataaattccatgggccttcacatggaaacacatacttttttgctctccagttgcccttttgttacaatctcatctgaatacgatgtcttgtaggtgctgaccttaaggaacgagccaagatgcattccagtgaagttggtccctttgtctccaagatccgatcggtgatcaatgacattggtaagcacagctatgctgagggtgggctttacgtcacggttgtctctccccacgaggtggtcaaattcatagctaattcatcatgaactgtggttgcttgagcacttaaaagtatttcacttggaaagacacgtgaaatatgtcaggtaggatggctcggttggtgaagtggcatgcaaggatgtggacttgagtttgatccccggaacatgtgtgagaagctggctgcagtggtggtgcgcacacacttgtgattgcagccccagggagctgggagcggccagcccagactaatcggcagctccaggctcagtcacagacttactcagagagtaagggggagagcaattgaggaagataccttgccattaatctctggcctccacacacgtgtgcacacatgaacacctgcacacatgtgtatacacacacacacacactcttcctcttttctctcctctcttttaaaattcttgacaagtagattattaatcaagagttagacctgtatgtcgacacacagaggctggatgaggcaggaggattgcaggtggggcagcccaggttacagagtgaagttgaggccagcccaccaaacctctccttcagaaaattaaaacctaataaccgaaggaggacgggcagtgtgccagcatggcgccagtcagcattgtaagaaaacgagcactgtcagttactgctcctaccactggtgtctccatgggcagtaagatgatccacactgacaagtctgacagtgttagcaagtcgtgtgtcccttactttgctgtgaatccaaaaggacaaaaggtgataagtaatttttaactttagggatccaaacagcctggctttggggtttgatttaacagactcatgcctaaaccagaaagtatgcattattcttacagagtctttgtaaaaatgtgctgagccagaatctaaagttggttaaattttcacaaaattgatacacagagacattgttcttggttcacagtacaggtaagctagaaacaggatacacagagcctcaagaatcacggacttccaggctgaaaaggaactgggaggggtcgtgaatcacaggagaagctgggagagttacccgagactgtatgtccaatttcatgagacttgtcaaacacttgagggacattctcaaccttaagttcatgtcggcaagagaaacccccactaatgatagatagatagatagatagattgatagatagataggtaggtagatagataggtagatagatgatagatagatagatagatagatagatagatagatagatgatagatagatagccaggcattcgcagtggctaagaaccccgggacgttttaggaaagcagttatacaagaactggaagcgagtgacatacaagaagagtgacagtctaagccaagccacacctcacaagtgtggaatttaagggtggtttccattgggaaaactaatataaaggcaattaaaataaagtcctatgtttacatagtgtagtgaagaaagcctctgagaggtgtcagcacgtcttcatggaaaggccgagcgaacgggagtgggaggaggcgcctccagccacagccagtgcctatctcttcatggtgaacctttgaagctgtctcctgagcccagaagcaagtcgggagaggcctgtggcagcctccctctgcatctttctggagtctaccccctggaaaaggaggggacaaaaacaaagacggaaaagaacaaagcaaaacaccaagagatcagcttggttaactagcagaacattgtggtaagatggcagggcttgagacttgtgttccaaatggcaaccataggccgaagccatcacaaaaagatacttttggccctggaagtaatagtgtatctaggagcacaggaaccatgcagaggtgaaacagccttgtaagataggggagtgtgtattccctttagggttcagtttcaagaggtgcttctcatgaatctgtgtgagggacacacagccagagccagagtcaccaacagaaagaggacaagaagccttgctgcagccacggtgcaggctttatttaacgagacacaactaaagcactgggctgcttgcctaggccgtacctgtggccatgtctgtctggcccacaggacatgttggggaatgggaaagaaaagatgaataagttctgtcaacattaaatgaagaccaccggaggatgtgtctgtgaacacgcagaggcttgacagctgagctgcagcctggaagccctcgggaggactctccaggaagtagatgcaaagcccaccccctaactaagaagctgttcactgtcgatacctgatgggaaagaagaaatcagtttcctatagcagagtgtcactgggcacaccggacacacaccagggcaggccccatgcccaggaacagctggccaacacaaaatgaacttaatggttggtcagtcggtgagttggtctatctgtctgtctatcatttttatgtgaactttttgttttgttttgcatcttttgacttactgggtcttttggggggggtgctgaaggagggagggaatgggttagagagagagagagagagagagagaatgaaattgggtggatagggaggtgggcaagatctaggaattgatgggcaggaaaacataatcaaaatgtattgtgtgaaaaaaagaatttaaataaaaaaaagtccctcacactcttgggtagtggtgtttagtctttctgatgcagcgaccctttaacacagttcctcatgtcgtggtgacttcaaccataaaattatttttgttgctactttgtaactgtaattttgctgttgttatgaatgataagtatctgagttttgtgacctttggtgacccctgtgtaagggtcatggcccacaggttgagaattactgctttactgactgggcttaggctccttagtagtcacttgcagcttgtctcagtctcggtgggaggttgtatcccccagatcccacccagacattgaagcctgaggagcattataaaatgatagccctccctgacaggatggctctgtaggcagaggtttggagttcagtagcccacatccacatggtggaacaagagaatcgactctggcaggttgtcctctgacctccacatagacaccctcctcacgtgcatgcgcatgcgcggacaccctgagtaagtcagtgtaagtaaacccattgtgtggctttgcattttgtggatgaacgatcagagaggttacttggaaagactcctctcacagatacctctgtagagcgtagcactgtcctacatcttggtctctgttacgagggtcagcatctctggtatgacatcagaaggaaggaggaacgtgactgagttttaagtgctattatttatacacttagccgttaggttcatcctatcaccatacggtgttaagaacacggctgctgtctctctcactggtgcagcctacaggagctccgtctcctgtactggtgcagcagagtagctgccattcttgttgccgttcagatctaccccaccatgtaggtgtctgacttttgtccctctttattcaaaacctcggccggttagtgccacagcgatgttgccatgcaggcagaagccaagtgctcctgtgtttccgtgcgaacttgttgcctcctgataatttggcttttgctttcaccacattgtgctgagagctactcagtgaagaatagttttgttttcttttggtttttttgggttttttttgtttttttttttttttgaggcagggtttctctgtgtagccctggctgtcctggaactcactctgtagaccaggctggcctcgaactcagaaatctgcctgcctctgcctcccaagtgttgggattaaaggcatccgtcaacccgcccggcccaagaatagttctgagtttgcagactgtgtgctgtatgctcactgtgtcttctgcctgtgtctgagtgctgaggaagagtcgtgggaagggcgggcgagcttttaggagttatatagctagcttctttctgaagctctcctctcactgctgtctgtcctgtgagtctgctgtgcacagcgtgacacttggtcaggagcactctgcttgcttgcttgcttgcttgcttcctttctttagagacagggtttctctgtgtagccctaggctctcctggaactcactctgtagtccaggctggcctcgaactcagagatccacctgcctctgcctcccaagtgctgggattaaaggtgtgcgccaccaccactggccactctgcttttaaagcctgagtttaaactgccaacttctgccattccagagtaccattctagagttcatcaacaccaaaaaaaaaaaaaaaaaaaaaaaaaaaggaaagtcccttccattctcattggtctttctatacttctgatttcataaggaaccccggatgctgtgttttttgtaggcgctggcagtttctcggcagctgccatctttccctgtgtggtcattgctctgttatactgcctttgactcttacacaaggcacttgtgtacacatggggctcgtcgctttgcccctgctgcctcgttaaggttttccttggggcttggctgcagtgctgtgtgtgtgtgtgtgtgtgtgagtgtgagtgtgagtgtgagtgtgagtgtgtcagtgtagatacccttctgagtccagaagagggtgccgggtcccctagagctggctttccaggcagttgtgagctgcccagtgtgaggctccgtgcaagagctgtatgtgctcgtaactgccgagacgtctctccagctgtctgcgttaactctctgaaaataattacaaagtacttttctggcttgtcccacactgtggccaggacaccccccccacccccccctgtgcctgcctggtctttacattctaccctgcagtggcattagccctctctgaatgtcctctggcttattttgtcagcaggtagtttcccctccatcttccgagggtaaacatcaatgcaatctcttattttatgtcccagtacagcctggaaactaggatgggtcctgtgtacaggtgtgtgggatgggtcctgtgtacaggtgtgtgggatgggtcctgtgtacaggtgtgtggggatgggtcctgtgtacaggtgtgtgggatgggtcctgtgtacagctgtgtgggatgggtcctgtgtacagctgtgtgggatgggtcctgtgtacagctgtgtgggatgggtcctgtgtacagctgtgtgggatgggtcctgtgtacagctgtgtgggatgggtcctgtgtacagctgtgtgggatgggtcctgtgtacagctgtgtgggatgggtcctgtgtacaggtgtatgggaatgggtcctgtgtacaggtgtgtgggttgggtcctgtgtgcaggtgtgtagaggtagaactggccctcaggaggtggctgttaacagtattcccctccatgaggagcaccagagccttccaagctgcctcactttatttgaattttaacctggtgttagcatttagttgtcataggggtttgactaaggtggttgagactttcagtcttggatctggcatctctcccttgagggtggtggtgtttctctgtggcatgcctgctggcatccagcagcaccctgtgtggcagtcctgggccagcctccagcagagcctacccagcctgccagctttgctcagggaccactgtgttctgttcttgtggtttcttcagaagttagagaaaagggagaaagcatcttagtcaaaagtgcaattctaactggacctagagataactagggatttattgtgattttgttaataacgatttcatttctattcttgatttttatattcagatttttcatcataacatatatggacctttctgttaaattaatgactttgctgttttgtagcacagtactagatttttttttaattgtttaaaattacagtttatttttcatttgtgtgagggtcacggtgttaattctctgcttccaccacgtgggtcccaagagtgaagcttagatactcagcgctggctgcaagcacctttacccaccgagtcatctggctgacacaggatgcaggcctctaagcagaacctagggtgaaagtcacataaccagcaccagcctcctcctcacaatcagattgtcggcctttctcgaggcttacaattagcctctgcctgaggagcagagagtaggcacaacacgtccagtacagtgctgactccagcctcgccgggcctgggtgtgctatgggctctgaggtccatcacccaccgtgccttttcttctcaaaatagctccactctttaattattgctttaattatatttttaggagcatttcaaaaggattattatcttccttgtcatacctggctcacttcctggaatgaaactcaaaatagtatctgatcccactgttgcgtaacacactgagtcacggtttctcgctgtagccgtggccctggcatttcatttcctgcctcaagacctttgtaggcatttgcagctgccctctggctgttctctcaggcctctgtaccgatagtctgcctttccaagggcatatggctttagaatttatagtattgtaaaatattgactagattaagctgttctaattaaataattttttcagtaggaaacactatagccagctttctgccatgctggtttctgttactgtttggaagtcccaggcacagtgtgggcacagttactctccccttgccctgtttggttgccatactgtgctctatgtttctcagaagttacaatgttaaacttgttgtattccctttggaaacattaattcctcaaaacttaaacgtcagatttttaaaaaatactttttgatgatgccacaatgtttgatcatcactggaaaaggttactactgtttgtaccagattctgtgtctgaggtcaatgtctctgctcctgcccccaagccagactcctggtcagtcattgtaccttgctaatccagtcagcctgtttcttacccatttctttcattggtggttgggggttatactcactaactgacaacacatttcacttgtctggttttgtgtgtgacggtctggctgtgcagatgtctgccttagcctcagatcagtgccagcaccatatcacccataactcctgctacagggagcttagacacctctggcctctgcaggcaactacactcttgtgaccatacaccccctccccctatacacacacacactaaacatttttaaaagtattcactagtgaacagtttacaaatattaataggacagatttcattgtcagtttgtcataaaaaaaaaaaaaagatgaccccttcctagaaattttatgaaagagagtgttttctgcaagccagggcgtagaagtgaggctggctatttcatacataacagcacaggctcatttcttggcctcttgtaaagtctacgaagctcctgaaagttaccgagttcccacagttgctctgctgattgtctggaaggcttgggaggaggggctgtcacacaggccactgagcgaggggagcttgggtctcaaaggacccaagggattaaaatgccatccagcacactgaggaatagcagacagtcacttctccaacaaggaaaggttaatagtacaagggtatttggcgaatttcacctgcaaaccagaaaaaggaagggcaagggtggattacagcgggcaatcctgaggttacctagagcgcctgctagggtatgagggtgctgggacttgaactcaggttcccaggaggagcagcgtgtgctcttacctgtcagccatctctccagccagcatataatatgttccaactcctccccatcccccctctttccctctcagcttcatgtgtgctccccacttaagcgcacagctaggaccacctactgcaacaggctttcagagcccatatccctgaaggactgctcctcccccacccgtgctcatgtgtgcagtgtccctgtcatgtccagccagggtttagccgcagacatccgtgacctctggcttacagtttttctgccactttttccactgtgactcctgagctttggggctgcgacatagatgccttattatgagtctcattctctacacattgaccagctgcgggtctctctgttaatcttcacctactgcagaatgaagttccaccgaggaaggccgagaggtgtactggtctttggatatagcgaccagagtgtaggggccacttctttattaaggccgtttagcagggcagcagcaggggcctctcccctatggactatgaccatatgtcttaggcccagtgagcagtacctggcatgcattctcttgtggggtcggcttcatccagtcagagagtggctgtttactacagcagcatccatgccccagtcgttatgccaggcaggttgttattggagctctcaggcttcaatcctgggtaagattgtggatatatgtgttagattagaatacccatacaagtcagtatactggggaaagggctgtggtgtgggcttcaagggatggggttagaaatcaggcggtaggaagaagaaagggaagtgggcaggggattggggggggggggagccaagggcactacagtgacctttgaaaatgccatatggatacctgctactgtcgaaacttccagaaacactctcttgtaggctctgtgactaccacccctccccacatctacttctggtcagaatcccagagctagcgaagatgtagtcaaagcgtttgtacaccagctttctttggtactggggtcctggtctctgccctttatggctggtggcattgtgtgtttctttgagcagatgtcttgtcttgagttgcattctaagcaccagaggaccaggagttccaaactgctgcatagattgtccagtcttagatttgcatgagctaagcaccttgtaaaagactttaggtcctcaggatatgaggctatagaattcaataaaataatcctgaaagtagttcaggaatatgagaggttcagaggtgttccccagtcaaagactgtctacaattcacacagaaagcttttgagggatgctgggaaggcttgtgtcttatggaagatgaaagaggcagaaagtcttcatgggaccaatttaaaaatgtgtgctgaataagctgggtgtggtggcacactcctttaatcccagcattcgggaggcagaggcaggtggatttctgagttggaggccagcctggtctacagagtgagttccaggacagccagggctgcacagagaaaccctgtcttgaaaaacaagtaagcaaacaaacaaacaaacaaaaaacaaataaaaatgcatgccgaaatgaactgggcagagaggaattgctttgagtaaaggagataaactttgtctgtttcagcaaacctcccggtgcccaccatcgcagccatagacggccttgccctcggagggggtctggagctggctctagcgtgtgacattcgagtagcaggtgagaatttaatcctgttaacatatttggaagaaggagcttgggttaaggcattataaagtgatgttatttgcatttagagattcacatgtttattgaaatacatggaaagacattcagtttcctcttgtgtttaatctagacaaaaagaacaaaaaagacatgagaaggagattttgggatgaggagtggggtagggggggatgaagagcggcgagggaggagcagtcatgatcggagtacagaacgggctccgtgagagtcagaaaaagggatctgctgtttcgtacagggaatatgctaatgaagaagcctgaggtctggggcgggcaggttctgggttggcctctagaacacacagagatggcagcggcggtgaaggggtgcgcactcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcccttgttcagcctcagttgcaggacacatctgatctgggaccccagggctgcccattctagactcgttctctatctaccatttaaagtagagcgcgtgcctgtggttgtgtgcatctcacccatggggtcagtcagtaaacacatctggtccagcatgtagggactttgtttccatagtgacaacttcactctttggaagttccaccctttggagtgccagcaagcaccgtgttgagggggttgtgaagagctgggtgctgaccagaggccagtggccctttaggtggttcactcgccatcctgcatggaagccctctgagtgtctgagggagcaggattggagaggagcgagtgaaggagctgggcaccacagcacacaggtctgccctgctcctagcaagcgcctgcaccctgccctgggttttattatgagcactgtctcccagagtctcagcacacaggaccccgccctctggctcagcactggagaagcaggaggggtggacagcagggggtatcatcacagagccctgttttactctgtggctgctgctatggctgcatggcaggagttgaaggcctttagcttgcctgtttgttagtggcttcatgtggccatgtcttggggtgctttccctcttccccgtgttattgtgggttcccgggttgctgcgatgatcttcacttgtttttcctggtgctggaggatgagtttgcagctgagaaaccgagcctcgtgcagcccattcagaaaggccgcagacaggaggcaaggctatagggaaacagcccaagggacacttaagctgcggggccttttgtcagaaagtaactggacacttggccttatctgactgcagatagagtcatttggtctggggaccattgggcagctaagggatctgtacttgtcaggcgaagtttctcccttgatatcattaatgggatttgggccctcctgctctggcaacaccagatccaaaggtggaaccaccactttgatactttgaccactgggacctagctcactgccaggcagttttgtgcaaaaaatgtcctgtgttctcctgggggtggagcaggggagtgggggggggggtagagggtcattttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagagaatcttaccttgcttcctcaagttctcatattacaaagtgatgacatgcctgtcacttaattctctttatttctttttagcttcctctgcaaaaatgggcctggttgaaacaaagttggcaattattcctggcggaggtatgaattgctcactcttcgtctctcggtagcttagatttggtccccatatgggtgcaggtcagaaccccgcccatggggaaggtagcctttgggttaaagaggcagccagcagagcccctgctcagcatctgtttggcctgcaagcatcgtcgtcaggtggcctgtgttggtgtcaccgcttgcacggtctccttacagaatcacagccagtttgaaactgtgccctgtgcatttgagcatatgttccctcatcccagagtgtcaggtacatagccagaccctgagtctaggaggagatgttgcttcttctgctgtccagctttggccaccgtgacaagacaccagaggcagccgtctgtgggagggaaggttggcttgggttcagttcacttctcttgttccactgtctgggtccctgtttgagccaagcatgctgtccttctgggaggcttgtggagcaaactcatctcatggtgagagaaagggggcggtagagagggagagacagagacgagaccgggggtccctttcagtaccccactgaccaattctgtctctaggtggcccctctgtctcccacttccttgtagtgccttgctggggtgtcttggggggatattctgggtttaaattaccctagtggcttgggctctaggctgtctctcctctctgcacagtaggacagcagctgtctgtctgtgtgtgttcacatatggggtggggtgtgggccgggctgggcctttccctttttaaaagtcatttaagaattcactttgtcaacatcgataataaaatactttatctgctcctccaaaatctgaatgttctgctgttgtgattcatggaatttgtagacattcccattttgcaatgtcaaaggatacctttgagaaaggtatcatttaaggatgggtacagtatactatataatacctgataagttatttctctgctggtgatctgagccaattcaagccaaattagattatattaaaggcaggtttattggagggctgtgctccgggcaagttcactggccccaagtattgaggagcggggagggggaagaaagggagagaaagggtgctggagcagagaaagcagagagagaagagggagggagggagggagcacaaaatgtctggattatgtagggaggagcccctcagggaagggcagcccagcccccgggctatagaaagtttagggttggggccagggtatgccaggtagggactgagggatgctaggaggagctggaagccatgtctgctttgataggtaaagaaagtatgtgcctcagtccctagtccccaagtctgaaaccaaacatcccagccttttgtagatttttttcccaattttttttattagatattttctttatttacatttcaaatgttatcccgtttcctggttttcccctgtgaaaaccctctccctgtatcccatccctgttcctcctgcttaccaacccacccactcccgcttcctggccctggcatttccctatactggggcacagagccttcacaggaccaaaggcctctcctcccattgatgacggactaggccgtcctctgctatatacgcagctagagccacaagttccaccatgtgtactttttggttggtggtttagtccctgggagctctggggaagggggaggtgctggttagttcatattgttgttcctcctatggggctgctagcctcttcatctccttgggtcctttctctagttccttcattggggaccctgtgctcagtccaatggatagctgtgagcatccacttctgtatttgccaggcactggcagagccccttttgttgattataaatgtatgaggggcagtggaaatgtctgactccttcctgctgacacgggggcacctctgttacggggtatgcacagaagccgctgtcttaccgcagtccaggctctgggaccatctgtgggtaggagtgtattgaagcagtctgtgagactgggtcagagcaacctgtcagtaactgtgtaagctctcctggatgcagattctgagagaacacctggacgttaggggcacaagataaggtttagggaggaaaactttctcttggtcttttgggtgtatatttgacattctcaggcccatggtcttggtagttggagtaggggtggggtggagtgtcccaggaccagggaaagggaaaaatagaccccaccgtcaggagtaggcaggtggggagagaaacagactgttaattgacaatacttacctcgattccatttgacccgtgagaggcagattggagtggattccctgaagcttacaagaatctttttttaagtttacaagaaagataaatccttcaaacagtaccctttccttggtaattttcacaaataaggacagcttatgagcccaggagtggaacattcagtctggtccactgctctttaaccctccctggagagtgcatctgtaaggcctggggataggaagatgacagcgcagtgtatcggaggggagagtgcttaccctgaaagctaattgctgcgcccagtgccttcctgcttacacgtgccggctttgccgagctcatctgtacagggagcaaggaggataccaggagaaggagtcctgagagagagggtctacctgtagataactcatgggataaaaccgaattacggaagtgtgatttgttatgtcttggacttgacttttcacagtgttggggacaaacgcagggccttaagcatgcttgctcgagatctgcggcctagctgtaccccagtcctgagcctcttttaaggatcctctctttaactaggatgtaactaatcctagaaggccagtgtctgactgctgggtcccatcccctccccctctccagtgtgtcttcctggaacctgtaaatgcaaccttatttgggaaaggggtcctcacaggtgggaataacgggtcttaagaggaagtcatcgcagagaatcagagtgagctctaagcccaatgactcagatggaagacagggagttaatggacccataagcaggccccagtatctgagggccaaggcaggggatggacatccccaccccgccccctccacacatacacactgagcagcagtgtcttactacagagtcagacatttccccactctctttcccttccccttctccctccttctccccaccccactctcttccctttccttgtcatgggtcttgttgtgtgtcttgacttaggtcttgcctgtcattctctgtatttctcacaggnnnnnnnnnnnnnnnnnnnncccagtgagcttggcgcacatttgatagttctgtctcagaactgtgagagaacccctttctgttgtttagcactgtctgtggtgatttatcacagccccccttaggagaccggcagcagcagtggaagggacgcatctgccggattagtagctgtagtcggccctggtggtgggcagcgctgatctgggtatccactgtgtcttgtacatgaagcgctctgtgagctcagtaggagctggagtgtttgtgtgagagcagctgtgtgggtaactgtggacagactgactgttccgagacagggaggcagtgcaagccgaaggctgagaaatcacagttttctctcatgcactaggttctttgggggcctgtcacagtagaccactgaagatttgattgaattcaggctatgttttcttacgaatagaatttgtttcctaacttttactacatacattcataataaaaattggagtgcactggtgttttcctcctgtgcctgtgagtgatgggggtctgttgtgttactttgtaatggagtctgagcactggattttagcggctcctcaacctgcgaagccttcagtttgtgactcacccctcggtgtgctagtagggtgcggtttcactttgaaaggggtttgtttcttcctgactcaccaagattctgcatgtggcaagggcacattactattttgattcttaaaataaggcgctttctagtttaagttgctgaacgatttattttaagggagatttttgtcttaattaaaagggtgagtctaaaagcttgtaggagattgccctgagccgttctacctgctgccacctgtcctctctccttccctttcatggccagcatcatctgagaagactgactctagaacattctgtggcctgagagatggttcagccgataaaggcccttgcagtgcaagactggctcctgaatttgatccttggatccctcagtggatagaggaaacagccttggggagttgttctctggaccccccaggatgcacatgtgcactactagataagatagggtattttttgttttgtttgtttttaattctgtttctacatattggtgatttatttatttatttgctattcttgagagaagttctgagatgcctgctttatgaagctgttctgttaactattaaacctacctacttttacttttttcttagttcccagtggctaaaaggtttccctggtctctacatcccctgtccaccagggatggtctcccaggaggacctggctagaatatcaaccttgtctgcttttctcattttccagacaagagctaaaagagagtgaagggacagtccatctgtggggggcggggggtctgtgggaggggtcaatgccccatttcccttgtcaacgctttggaggctgtgtctcgtagtggggagacgccatcccccctccgttcccgcagacccacgcttccgtattaaccagcacttggaggtttgtccaggtgacacagagcttccccgtgtggatttcggtaccttgggtggagccaagagacttagtttccgccctcgctgcggtttcttcaggcttgtccttcagtgtgacctcagcagcatttgggacatggcctgtcacactaccatttggttctctttgagtttgaggctgaacctgaatagcagtgcgattacttctgacacatttgataaatgaataaaaagctcaactgtaaaatgtttttgagagaccacaatattcctaatgacccactcctatcatgtaatttattttagagttctcaagtgtagtttattagaatatcgtttagtgttaaaattaccattgtaagtacatagttcaatggacggtacaaaggaatgtggatgtatgctaatataagttgaccctctacctgactactgtctggttgactctgatgcagtccaggtacactgtcaggtacccacccgagcccttcctgacgttggaaagggggtgagctgcctgtctctgttcccctgagagatcaggctctctctccttccttccagcctgcaggtgacaggatacctgcacggctgactactgacactttcctacagcatgaacaacactcccagatgttcttgtgctgccatcttcctaacaaatgccctttctggtccaggatctggtccagaattctcacttgcacagttgtgtttggaggagcagggtctttcctttcttgatgaccttggcagtgcccgacagtcaccgtataggatctctagttgagtgtgcatcatgtttacccttgaggaagttgagattgggcagctttggttagaacatctgcacggagatgccgggcgaattcctaaggcatctggatgtctgattattgacgacggtacatttttttttttttttgtcctttaacagggtcttagtcagggtttgtattgctgtgataaaaactgtgtccaaaagcaacctggggaggaaggggtcccaccttgaaagtttttaagtctgttatagggaagccaggaggcaggaactggagcacagacctcagaaggatgctgcttacctggcttgctctcatggcttgcatggcttgcttccctgtagctctaaggaccacctgccccattcaccctggactgggtcctctcatggcaatgaagaaaatgagtcagtcaagaaactgtccacaggctaatctgctgtgggcattttctccattgaggttctctcttcccaaatgactttatcttgtttttgtttgtttgttttgtttgcttgcttttttttttcttgagacagggtttctctgtgtagacctggctgtcctgaaacttgccctgtagaccagactggcctccaactcagagatccgcctgcctctgtgtcctgagtgctgtgaataatgtgtgtgccctcactgcctggcgcttctgtgaagttgatgcaaaacttgccttgtctgtggtgaaattgccactttacctcaaatctgcacatatttatgtcctgtaatgtgggtgctttgacgtctgcatacatgtgtgactaagttatcatgtgggtgctttgacgtctgtatacatgtggtgtgattgaataaagcctccttaacatttccatcacttcagcccccccctttgttctctcccctcctccccatgacgccactgaggcctgctcccttgccagcttttaaaggctccatgtcttattaatagccttatcaccagtgccagagacctacaaaaggtctctagtatttcgctggcccagagcttactgtgtagcctgtgctagcctcagactccctgccttcccagtgctggggccgcagggtgagctgccacagcgggctgttcacacactggcttcagttagcattcctgcatgcttcagctggggttgaaaagtctggctgcaggccctgaaaggagatgtgtcgcatttaatgctccatccatcctgtgacagtgtttggctagcttgggttgttaatctggttaaagtggcaactaacttggcatcctctttgcagactgacaggtgaggctatatggtagaactcagagtgagaaaaggagccaccccccccccccaccgcctgctcccccccagttctgttctttccactgttcaggatgagcgctgtggcctctgggtacgtgtacttggcacattctccaggagctccgtgctaaggcatgtctctgaggtaatgactgacatttaaatcctgtcagtgtgttttgtcgctaacacagcccagagttgggaagctccgtttatatcctttgttgcagctctcttagaatttacatcagaatccgagcctcagccctgagtcaccgctaccctgggagggtgagctgggttctcagaaatagcaagaggtccgcctgtgcccaagccagcgggtaaggtcatccaggaaggagagccctgtcgcagcagagtgagacctgagaggcttagcaacgcagagtgggcagacagccttgcaggtctgtgctagtgggatggatgcatggaggtgcttctctgagtattctagcagagagctttctgtacgaatcctgaaatgccctccagggtcacttcctcagttcagtctgtcctggggctgggagtgtgtgtgtgtgtgtgtgtgtgtgtgtgtgtgtgtgtgtgtgagctgtcccctgacctccttgctgcgctcagggctgctgtggaggaagcacctctgtaggactctcttcttgccttggagtgccccttctgagatcaggtaggagagagtccacatgcgcccacacgtctaactaccaaacttgcaaccaaccagagacaaaggaatctaggactggcagtcagttctgagtgtagcacaaacagtgtaggccgcacgcacgaggcttcctgaggaaagtcagtcggttccagttggcaaggcctgctgctctctggtctccctccgcctcatcctactcctgttctgagtcaggggcatatttattcaactcactaacatagctctcaggtcctgcctgtgatcttgtaggaggtggctatagctgtgaaggaacaagctacagagtcgccacagaacttctttcgcagcccaggagcagagcaggggcctgtccctcaaagtagaaaatactgtagaaaaaataagggacagggtctgagggggatggggctttgcaaccaggaggccagagtccctcactaaacaaggtcccataggcttaaggcttaaaagaccagggaagactgtgtagccgcagacagcacccaggcccaagggtggaggtgggagagtgcttgcagccacagcaggatgcactagagggaggatacattgtgcagggattgctcacagcacagtgacttcggtctttatcccagtgagaaggagaccccggggaaggcaggtcagcagtttaataggtttctcatcagtgcactgaagacacacagcagttagccgagtctagaagcaggaagccagcgcctgtggcatggttggctgtggcatggcctggacagggctgcattcagatccggggtgtgtttaaagacgagtctagaaaaatctcctagcaggttggctgggaacataatcaggagagatacgtggggttttggaaagagcaactgccttctcctgagacgtggaactgcagtcaagagtcctgtcttggatattatttggatatttggttaaaaacggttactgaatatctagatgatctcttaaataaatgcggagaagaggggcatggtctgggctggggctaaaactatgggactcgttgttttccccactaacaacctgctctaaagagaagtcctgagcccagaaagccacaccctccatccccagggctgggataagtgggaactactctggtctcttggaggaggaggccatgtttgtctaaccttgtcataggagagagcaggcaggacttaggattgaccactgtgggccttcagctgctaaggctcctgccacttgataccttaggtctgggtcttttacattttgaacacagttaaaacacactgaaatgtaaaagagtttcagaaaataaatgaaagatgaagcatatcagatgattatctcttatccaaaatggtgggagttggaagtgtttcagatccagttttccgattgtggagtgtttgtatatggattactcggaaaaactgaaatccgagatgtccccagatctccaagtctgatgtttgctcaccaaagagtagggctgtagagcatttcgattgctagggtggttcatcctgtaccaacaagcagaaatgggagggctgagaaacctacaggtaacccactgtgtagacagagttgccaaatgcagctgaaggagacggaagagtctgaggtacaaacagtggacaggtctgcaggaagttactcagaattaagaaaaggaatcacaatgttactgaaagggttaatgtctaggcttccgaaagtcctagaaggagggaagaaaaaagtgagcccttataactgaaaaacagaaatggagtgagagtggacagagctaggaacaaggataaagcaggccaaccaggtggagagcccgcaggtccagccagctacaccacaggactgcttgcacactgtttggagtgcaagtaaaactttgttggaagcaggaggcacccgggacatacatacttataaagaagcagaggttaaaatggctagttctcatcagaaactactccagacaccaagggagacattgtgatttgctatagaggaacgccatgtgcaaagagggtggcttggccagacccagcggtcaagtcccttgtctcagcactctggattctgaggcaggagaattgctatgatgtccaggctaggtctcagcacctacccccatcccctcaaaaagaaggtaaaacgaggtgattctcagatcagaaaaacgaacagtttagatctcagtctcagtatctataataacgatccatccatgatggacacagccacatctcgacgtagttgagagagctgctggggagccttctcgggcatagattagatttggtgaagttgacggctatgtgcaaaaaaaaaaataaagaactttgatttaatcttgaaaatctaggcaaaaacatgagctcaaaatagaacacagatataaaaccacatggagttctgaaatccgcagaggtcacacactcgttcccagcattggagactgaggggcttggctccgggggctcatgggagtctccatcgagtgacctgcactccggagaaggtggtgctgtcagtgcccaccctcatggccattccctactccttgttttcaacatgtaggaacttgttatgtttaaagcacttgcttcaaaggcctggctacctgtgttcaatcccagagccccggagaaaggtggaaagagaatcagccccaccaagttatcttctgacccccatgaactcaccatggtgcctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtagaaagcagatgtttgaaaatcaaacttgttccaacagtcaggtaaaacatgtttatcaaagacagtaaaagaaactacaccagttctgccttagccccgaggcatgttttggtgtgtccatgagcactgcatctgggaattgatagtgccccgatttggaatagggggattgggaacacattcctttatagaatcaacacacttggcagctcagctgtcctatgcttttctgtctgaccactagcctgtgtagctgacgctgatccagcccgcaggaggacaagaaggaagatccaagctgcctgttcggtgcactgttgctgcctagttgttgcttgctacagtttttctttagctttaacaggttaaaattaaggtgcaataaacagcacatattttaacacacagcttggtaagtgttgatatagacacagccatgaaggcatagccacggtggaggaacatgccctgtgcaccccaatgttctcatgcagccccgggctgctcccgatctgtaaagtgatgcttttatcttctctctccggtggcgctaggggctgagctcagccttgggtgccgggcgagcactctatcagtgagtcacgtgcacagcctagatcatcctgtgacatcgtacgtatgtgatcttctctatttggctccattcacttgcacagttatttttgagttcatctatactgtgaatttcagtattgatttccttttttgttgctaaccggtgatgcattctgttcacgtccacagtctttctgtctgaacagacatcttttttccttttacctttggctggggtgagcagagccgccgtgagtggttgcatacaagactccgaatggctccctgctttcagttagcggaggcggatgcttctgactgaaatggttcatgccgtgagtgtgtgcttggctttagtgagttgttactggttccagcagcgtgagttctatagtgggtggcttccctttttcgagacagggtttccctgtatagccttgactgccctggaattcactctgtagagcggactagcctgaaactcagatccgcctgcctctgctcccgagtgatggacctacaggcgtgcgccaccacagcccagcagttcccccattcttcacatcaatcaaagatctgcatgtggtgatactggggaagcccatcatgtctgctcctcggtgggctgtgcttgagctcctgtctgcagctgacagagaccaggctggcttcctgcttcgtttagcgtgttgagttttctggtttttatctgtggtataaggcacatccctacctgtcctcacattatgcattgaaaagactctctcttctggcttcgggtctctaaggtagctacatctccataaaattagatcagactggcattctgtttcatgagcgtatttgtctggcttggtgccagggccacgtggtgaatcttgaaaacacccacatcggtttttctacttttttttggccagttgttttgctgaatcctagtccttttcatttccacatggtagtcaatttctacaaattcattcctgttgagtgctggggattaaactgagtacctgtcacatgccagagtcactaggctacattctcctgtaaaggatggagcacatttactatttactgtatacactgttttgccaaagcgctctcaggcttccctgtcctcaaaggtgcagttgagctaggctggtgactgcaggagttcctagctgtggtcagggaccatctttcctctgacgtggacgagctgctagctgtccatgtctctcagaagtgagcaccgtctgtcaagtggcctttgtcaaagaaatttttgccacttgtaagatccctctttggaactagaatgaccgtttacactcccctgcctcacttcccctgtgtttattttattttttcttttcacaagaaagtggccttaaatatatttcagggtctgtgggtcactagacatgacagctgtgtgcacaggacctgtgtaggtcctgtgtctgtctgtccgtccatctatctgtcaccatcatgtcatacccctcttctgtccccaccgctgcctcctgcacctgctccctccgctgtgcctcctcagccgggagactctgagctcaggtagactcagcaccttacccccagctacaaaggaagtgattctgataaactctggcttgagaagcctttaaaatggaaaatatgtagacgtgactgacacgtgatagcaaatacaaaacaatctggggagactggatttttaaactctcatttatctttgtattttcctatcatcacctttttgttgttaaaaacacaccatttctctctgttccctttcttagtaaagggtttcttaaaaacccctgtgttgcctgatgtcacttcatttcggttcaggcactagagaactcttaggtcagtaagtaatgatttgtgggtagctttccagagttgtaagctgcaggcaccgctcggctaacacacaagcatttctcgtctatgtgtaactcagatacagagaagtgtttttaccataaaacccttcttgtggtttttagcccgtgacactcctctcaactatgataaggacatgtcatgacattaacgctaagtaattcgatacttgaagtgcgttgttaggtgtgatggacggcttggctttcctggggtgaaccgtgtatgatgaccccatgttactcttctagagctggaacactcagactccaggttttctgcgcttatagcaggacctgtttttatagatgaattaaatgaataggttttttttttcatgttattttgacaccatcttaaaaagcatttgagctgggcgtggtggcgcacgcctttaatcccagcacttgggaagcagaggtaggcggatttctgagttcgaggccagcctggtctacagagtgagttccaggacagccagggctacacagagaaaccctgtcttgaaaaaccacaaaaaaaaaaaaaaaaaaaaaaaagcatttggaagtatactggctagttttgtgtcaacttgacacagctggagttatcacagagaaaggagcttcagttgaggaaatgcctccatgagatccaactgtaaagcattttctcaattagtgatcaagggggaaaggccccttatgggtgggaccatctctgggctggtagtcttggttctataagagagcaggctgagcaagccaggggaagcaagccagtaaagaacatccctccatggcctctgcatcagctcctgcttcctgacctgcttgagttccagtcctgacttcctttggtgatgaacagcagtgtggaagtgtaagctgaataaaccctttcctccccaacttgcttcttggtcatgatgtttgtgcaggaatagaaaccttgactaagacaggaagaatgatcgtccggtctgtagctagtccgtgaagttctggaactcttgattcctcgcagttctgtattaagtctcgcttgggtttttcactttggcactttgagattcctcctcacagtgggtgcacgttgcccaggttttcagatgtcttagcactgatgtttgcagcgtcatggtatccttagcccctggggtcccttcagagttccccgagtcctgcgtttgcagagctgcatggcgtttgtgctctcttcacaggccctcggccctgctcccagctccattcgggccgccttcttcctccctgggtattttcattccttttcttaaactcagagttcacgtgtttaatttgctcttgttcatttttctttttgaaatcacgttattacgagggacgcacagatcaaaacactgttcagctaggttaaggcagccactcacacatacacttgtgcccaccctaacccttccatcccagtggccctctctccagttagaagctgtacttggaagctgtggcacttcatgctggcttttacatctccatcaattacatttttatgcattaactaccctctccccctacacatacaaggagaaaaagctgacagagctggaaccaagaaaacagccttacgtcttctctcacaactcacgtgcccttttgcctgaacagtcattgtcagtgataaaaagtgtgcatttgtgctaactgcatacttgccacccaaatttatgtagcactatcattattatattacatataaaaattcaatttgcagtcctttgtagtaaaatatatatgtgtatttgtgtattacacacacacacacacacacacacacacacacacacacctcaagttactttgggcagtttctactctccagaagcattatactctattccaacagtgtcctctcaggcgttacctgcagctcctggctgtggcttttgctttgtatgagtaatgctttaatgccttggctcttcattgagactgtcttttagggaccttaaaaagaggctagcagtcattgacagcccctaggtccagttctcatctcttctgttcagtttttgtcttcgtgatctgtccagttaggagggggtgtgttgaggtgcccacttgctgtggtgctgatgtgaattcctcgtctcttacaaagattctcaacgacaccgtcttctgaagtgtctggtcttgtgtagtcactgtctccagcgccttggttcccccacgcagtgtgctcccctgtgacatccctgtgacaagtacagtgactgactcaatgttcgtgggggtgtgtgtctttgaggtggagtcttgccttgaggcccaggttggctgcctgcaccagcctccggaggtgctagcttacaggctcagggccaccaagtgcggctgcctagctactgggtcctacttctgagctgcagtgctgcacgtcccatggtgggctggagtttgcctgtgcagtgtagtgcatttcatttaggaggtggctttaccctgcccttaccttccttacctgagcagaaagccatggagtagatactcttgagtccctgtgtgtgtctggcttgtttcttacctcatgtcttcagaagctgttgtgtgagaggcacttttattttttgtttcttgttgtgtttttatgtgtgtgtgtgggtggggtggggtgagtgcgcatgcgctgtggcatgcctgtggaggtcagaagacaactgtgtggagttgacactcaccttctactctgggactggcctcttgtcaggcctgcatgacaagcattttgaccagccgagcttcaagccctgccttgaagccctcagtgtgcaccctgactggttatatttctgcgactgtgagtgagttctccacatttgtccttctcgtgtcactgttattgtttcacctggtgtttctccccagatgtctcactggcagggttaagtggaccagcaatctgccttgagtttctctctcttaaggtccaattgttgatcacactgataacttaatgttgcagacctcgaccttcattcaacggcactcatttctgaaattacaagaggccataagatacagcaaacattgtctgccttaggcagcttggtagagagatgccaagtctaagtgcttgctgtgtaagatgaagaccccggcttttcatccccacacctcatgtagttgactgtgaaagctcacacctgaaatcccaccactgtgggggacaaaaaggactcttggggttcatttgccagcaggccaaatctaatgcgctccaggtttagtgagagacccctggttatttaaaaaagtaatgtggagaaccatcgagaaaatagccagtttccacctctacccttagagagtgcatgtgtgtgtatgcacacacacacacacacacagaacacacagatacacacatacagatacagatacacagacagacagacacacagacctgcatacagacacacaaacacatatagacacacacataccacacagatcatctcagtacacaggaggttgagacaggaggattgtagtaagtttgagaccagtcagggctacacagtggaaccttgtttcaaagaaagaaaaactttttaagaattcatgtttaaacctaccaagcctcatttaatttaaaaaatagaaataacaaatgagctagcattaatttctgcagtatagaagggaagttgccttttgacatgagctctggctgtagcctgtatgactgtttcaggatgctgttgttgtgccatcttagagggtaaattgtgtccctttcccagcctagtaaccctgctgctgctggtcgtcaggactcaccacgctgtggcacttgctgtagagtgtgctgtccggaagcgtggggtggcatcagcagggccactcccctttcccagggctgtacaaggtcactagcatcctgtggcagagggcatcttgagacagatgtgggggctcctgttgagcagggaggtatgatgggatggaatgtggccaggccggggatatggtctggtagagtggctggcattttatggagacttttgggtccagcttctcctgggtatgagactcactcccccagcaactgaacaagctgagggagctgggtgctcactgggttacacttccccctggctggctttcaatatgtacagagccatttgctgttacgtttagcagcagcccgaagcaagtgcccacgaagtgtgcccaaaccgcctggctctcctaagttaactgtctgtgtaatctgtagtgaatactgctttgagaccagtggtataccagctcagtgtttcagaaagatggggaagctgagctactgcagaaccattgacctggcctgatggtggcagttaggggcctggagcagagctcctgacttcatgtgctcgtcctgaggctttgggaatgtgacttgacccttggagtctgccccatcatgcatgcgtgcgtgcatgcgtgtgtgtgtgtgtagccagatatgttttacatggccctgtgaggatagtggaggcttatgtgagaacaaactgagtgttctggccactaagtcctgccaggtacaagttgcagtaggtcagcatgttttagctgtcctctctggccttacttgtcagatacaccgttactcccaagcaggcatcaggaggtgtggcttttgtaggatagcccacatggcccacattatttccaaaccagccttggtgggtggagctcatcacagcaggtagtgagtgtgggccggtctctctctctctccttccctccctccccgcctccccccttctgtggtgtgtgtgtgtgtgtgtgtgtgtgtgtgtgagccatgtgtagctatcaggcatttcctcagttgctctcccccttgtatttgtgacagtctcttgaacctggagcacaccgattggccatgctagctagctggccggtcagctgctccacagggctggctgtctcagcatcccctgttgttggttacagctgcacccatcacagcagcttccccgtgggtgccggggatctgaactcaggccctcacgctcctacagcccagcagttaagagcatttgctgctctcccaagaggacccagtttggtttccagcatctacacggggcagctccattaggggatctcattgcagcttctgggttctgtgccacacacacagacacatatgacttgtttttttttttttttttttttttcaagatgaatattcaagagctgtttgtgtatttgtgcttgcctaaatttcaagtgggtaaaaagcattagtcaaaggtgtcaaagatggttttaaaaagctggccgttgaatttttataagtcggtgattgctctgaatcagagctgcccccacccagtgcttgtcatttggagtgcttattattattgttattattatcattattattattattattattattttgctgatttgcctcatgaatgtgcacacatgtacattaattttggttccataaaaacattctgtgacagccctcttcgtgtgtgactttgaggtatcatttctagccccagttaaaactgtagaactctaggcttgccattcacttgcaagctgtggctcttccaggccgcttcagctgctgttactgtgctaattaaacagccacacctccagaacctagtgctaggggacagcatacttttctcctgaagcccctggagagcccatgttacaggaatgccgggagggtcttgctggcaccaggcctcttctttgaatctctgggctggctgtgtaagtttgagtctgcccacagggtttgtggccttacccctgtctggaaggagtgcctgtggcaaggcccttctcactggtgtgaggctcgttacggtgcagtcctgcttgaggagcctttcggtttgtgaaaagattgatccttcagcatttctggggtttcctgaggctgtccaaaaaatcttctgagtaaccacttcacatcagtcagccagaattgtctccttgttccctagcggcagagtggaggggactgatgcttgtgtgctcgctgctctgccctggacggttgagtcagtccatggacactaacgtgatcacctgtctcccggactttgctttctcttgtagcagtgtccaacctggggtccaggacagctgcagatgccgcccagcacgaagttgtacttaagacactatgagggactgtgtgtggttaccttccctcttgtaatctgatttactgactctggagaaagaactttgtagactgtggttgtcaaagagatgggcacacctgctagaatgttctgtgctgactaattcttagtggatttcctcttggtcttttgagacaaggtctgggagacaaatgtgtgtctactgagtaccaaatgtataacaacctttcatacatgggctagaaacacagacctcactcagcacggagggctacactgttacagtgggtgtgtggactacactgttacagtgggtgtgtggactacactgttatagtgggtgtgtggacaacactgttacagtggggagtggagtacattgttatagtgggtgtgtggaatacactgttatagtgggtatgtgggcaacactgttatagtgggtgtgtggactacactgttacagtgggcgtgtggacaatacttacagtgggtgtgtggacagacacttacagtgggagtgctggaaggagcccgtggtctcaagtccatgtggtatagagtgttggggctctgttcccatttccgctcccatcaggaggcccaggaaggaatgtggctggcccagaaccctcccagctttgaaatgtccttccccatggcctcctggggccctggagcagtgtgggagcagcctagctccacttgagaagacacaggtggaatgagtttgaacttgcagttgctgtagaatggaactttaaacagggtgtaagagttagcctctatattttactacaaaagtttaagcatgcgaatcatgaacttgctaaacctgggctgtgtgttgtgtgtgcaaatgtctgttttagctgttgccctatacacaaggaatctggggcagctctgggctttacaataatatagctgccttggaagcagcttctgtgtttcctaatttagcacacaaaaaacatttgacacccaatacatgcaaacgctgatgtaacacacataggaaagcttgggaattatagaaaatcaatgcatattggggagcgtgcattactttatggaaaagctgatagaatgctgttactcaccaaccatatatgtttactgaagtcattatcataagcaaagtcctattaaatgctcttctatactttccactaagtgcctgatgactgtttatttttgtcggtgtgaatattaaagaaaagctaagcagaagcaatcttaatatcttgttgattacgttcgagaataaaaaaaggcagaacattaagcctgcacgccatttgctataattactccgagtgagatgttgctggagctgtcaggctgtgattgaggctcagtgatggttagcaccagctgcgtgcattaattgtctgcagcaagcatgccccacattcactcaccatttggaggcccacactttcccgttccctgcgctgcaaagcatctcacgaatgagtgaggaggaaagctgctcgcacccagattcagctctcacctcccttccacactaagtcctttcacccagccccacacagctctgtgcatgtgagctccaggccctgcgcagccaagcatctggagggggcactggggtttatttcggagaggccttcggaagcctgttcctgataaggtctggaggctgtgaacggttaactctttctaggcacacaaattctaacgttgcattagtagttttaataaggcagtctgatagtgaggcatctgttttcttcttcacccagcttccaagtgggctttttcatagatatgtagtccttgcaaaatgtaggtattttcagaagcaccgagacacatccatttttgttaagtgatgaatcccagtttgcaagtttatttggactgtgcgcaggtgtttgtgtgggtgagtcactatggcgtctgataggcaggtccctcatttagcagcattcaggttgtgccagtctgtcgagtagaactctatctaactcatctttacctcagtattacttgagcaaagactccaaggattcctttattattttttcccaatgggatgtctgttttaaatcttaagggaacccacataatgtgaatttatctgtgtgcttacgctgggaagtatttcactgctgttggccggtgactcccggggctccctagctgctgtttggagtcccgcatctgtcctgtctcctgagagcagtttccctagaacacaggcctgtgtctagtgggttgggaccagagcccccctgagtcttcacacatgacacacctccctcttggccctcagaccttccagtggtaggcaccgtggtggcagaggtctacggggtactctgggcctcccatgacctctgtcacttcagaagctccctcctcggtcctgaggaccttccacgagtcctcttttcctcgtgctaaccaaagtcaattgtcattgctcaaggacctttgaaagaatagaattggtttgagaagcgtgtgcttcccaaagccagggtgatatatatatacatctgtaatcttggaactcagccggcacacacagggagtgctaggccagcctcagctacctagccagcctctgctttgttgtaaattgtattcattttattgttgtttgagatgttcgggaatgtgtgtgtgtatatatatatatatatatatatatatgtagatatagtatgtatgtgtccatcaagtctgcccccccattccctccctcctaatgcttcccctgtctgccaacattttcctctcccaataccatgtactcttttagagtaaaaacaaacaaaaaacctcctaagcgcactcagggctgcttagatgtgcatgggtgtgggagtgtcatttactggagcacgggcagcttcccctgaagaaaatggacttctcccagcagctcctcagctaggggtgggacaccatgagcccctcccctgttctgctgggattttggccggcttggtcatatacacagaccctgtctcaaaacacatgaagccacaaaacatcctttcagagtctaacaccaagttttaattttatccagcatggactcccggcaggtgtgatatagcctggggctgtcccaggggctgctcttcccgaggcaggtgtgtccttccagccaggcactcgccaccaggctctctgtagcttgggtttggaggtttgttttgtgaggtctaatgttgcttcccagcgccttagcacgagaggctgcggctggttcctggatatgagccgtgttttataagcaggcagtcaaactcttcaagcgggacttacactgaattcttacgtggtgagatctcattaaaacaagcccagcttcctctggctcttgttgtatttaaggtgggcctgtccagatgagaaggagagtatgactcttagagcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctgttggcattcaacatgtctaagttaacccatcttttgtgagggaagttcatgaaaaaatgtcttctcaggtttgtagaagatgttaagcatctaaaacatatatataatcatagcccctcaccaggctacgtcacagtgtgtagtcactcagacccgtcctcaaatgttgtatgaggcatcacacccttggatgtacttacaagttatcacagtaaaacatttgtgggtttacttaaaacaaaggcgttgaagtagctgcttctagtacacggccgttacaactggaagactttgaggagtgttaaacagtcttgcttctcccagaggtgtcgtctcctttgcatgtcctcagagtttacagatgcatcaggttttatgcccccttccccattcaccatcgagttgtttgtcctttacagatatgtctcttgggaaggggcacctctgggtagtgatgaggctagtgtaggtcggtgtgtaggcagcacatatgtcacacatgctggggtcatgttctcatccgtggagatcacgctgtaggatgagcggttgtggagggagaggcagtcactgcctccacaccagagctctgcccctctttaaatgcttttcccacccccaggtgccacttcataattaagactataaggctacattaaagtactatattagaaaagcatacatggctaaattatctcaggtacaactaatgtaaatctctgattggcagatggttattcaaactgcccattggagttgctaagtacggatgtctctcgatgctgttcctgaagattgtatttagaggactcagcactgactgagcagtgtgaatggagtgggtggtagacgtggagtgtcttctccagttactacctcagctgagcgttcctttccgagtcccatgagctactactgacagatctagtcatttttcactcaacagagagaaatgctgcctcgattcagggcattttagaacttcagtctcgtcttgttcaggagcacattgttccttacgcctaaccacattgaaacagaccagctttgcctttataccttaagtgcttaggaaattgggcaaatctataaagcagctattttcagatgctagactccagatattacaggcgtgtgatcaataggaagatgtaaaattcctgcatctttctgcatcctgccattatgcagctggccggagtgcattaggtgggtgactggagtggaagaatgctgcaggctggagggtgttactaggtaggtgactgcaaggatgaatgaagcagggcggcgtgtcttgggtgggtgaatgcaagtatcctgcaggctggagaacagtgaaggtgggtgatcagaagtatgcagcagggcagagtgcattaggtgggaaatccctgcacctttctgcatactgtctacatgtagcaggtgggaaatccctgtgtttttctgcatattggctgtgtgtagcaggctggagtgcttaggtagagaactagaagtctgcagcaagccggagtgcattaggtgcgtaacaggtagtagccacacagaaaagctccacaaatttaaactagggtgaccttgcatttgctaccgcatcttaggctgtttgccatatgttaaagtgtacaagtccaagtaacgagcagtcggggaactgttagaataacctgcatccaccggcatcaattggtgttgcccaagtaatggctgaagaagccggtgtacaacatactgacaggagtggagaatcagagagtcagggcaagggttctctagatctgttccatcaaagcttaaaattaggagactccacatactcaacaaagaattgcacgtggtacaccgtccaatttgctctaagagtctatagcataactgagcacataacagaagtcttacattgtcccagttagctttgacagtcaacttgacacagcctagaatcccctgggatgaagttctaaattgagaaatcacccagatcagaccagcctgtgggcatgtctgtgaaggatcgtcttgatagttaactgatggaagagggaacagcctagagtgggcatcagcattgcctgggcaggaggtttggggagctagctgagcatggccatttgggaaggccagcaagcgacatttgttcctctctggtttctgctataagctcctgcctgttatgtccctcagtggtaggctgtgatctggaagtgtgagccaaataagttctttcctttgctacgtggctttgggtcaattgttttatcacagcaacagaaaggaagccagcacaccgtttaaccaataaaaaaatttgttagactcaaaagcatctcaagcaaacatcatggaggagaaaaccttgcagaagccgtgactgggcggtggactggagtcgtagccgacagtggaagaagggagttctgagcagagttttccagcataggtgcgaactaatgatttactttaaaagacttgcactgtacccagtgtactgtgggtggtgtcactgggagacttaaaagttcagatttatatcattttctttcaactttattttttccacagaacccactgagaaagatactgcagattgactcctaaaaagaaaaaaaaaagagaagaaaagccattagcgaataagcaggcagtaaagacagaccagaaaggaaagtgtgacggagagatgaagattaaaaacgggaaggcttaagccacgctgagtcccactagataagtgttttttacacaatgcagtcaaaaggaagaaggctgacaaaacagctcacttgtgtgttgtttatagagactctttcctgagtaaggcagggctaaggatgggcgagtgtgtgccgggccgctgtcacagagggaagctggagtgtcaaagcagacaccggagctcaggatgaggtcgctcctggggatgaaggaccacatttcctaacaacagagtgtatctgtcaggaaaacacaagcacgtactcagccaggcataacaaaacttcagaatataaaaagtgaaaacagagaagaaggtggaggggtggctgaggcaggagagttgctgtgagtttgaagccagcctggaatacatagtgagactgtttggaaggctaagaagcagagaacatactttttttttctctttttttctttttttttattaggtatttatttcatttacatttccaatgctatcccaaaagtccaccacacgctcccccacccactcccccacccacccactcccacttcttggccctggcgttcccctgtactaaggcatataaagtttgcacgaccaatgggcctctctttccactgatggccatcttctgctacatatgcagctagagacatgagctccggggggttctggttagttcatattgttgttccacctatagggttgcagaccccttcagctccttaggtactttctctagctccttcattgggggccctgtgatccatccaatagctaactgtgagcatccacttctgtgtttgctaggccccggcatagtctcacaagagacagctatatctgggtcctttcagcaaaatcttgctagtgtttgcaatggtgtcagcgtttgggagctgattatgggatggatccctggatatggcagtctctagatggtccatcctttcgtctcagctccaaactttgtctctgtaactccttccatgagtgttttgttcccaattctaagaaggagcacacactttttaaagttgctggttatataatatatataatatatataagacagtgtttgcaaacctgcctggctgccctgttagggtctggctgctgtcgtcataacaccccacgtggcaccggaactcagacaggcttgcaagacacttgaaatgctcatcagaatcaagtgatgcgccctgagtaaaaaccctaagttttagaattgaaatcgtgccagaatatctactcttgactccagcaacatcagtgacagaaaacggtatgacacagccctagattcctggaaatgaaagcacttgttagtcacctatgagccagagaagaatttacacgagacagtaaaacattactttgaacttaatgaaatgaaaacatagcaaactgttctgggtacagctgaaactgtgcttaaaggggaggcacttaaaggggaggcagggctctaaagccttagctagggaagaagtcgtcgggtctagcgtcagagccggcaagaaaggctccagatgacctctgcctttgggagggtgagaagtgacacaaactgtggaaaattaataacccgaagccgagtctgttaaagtggaaaaggtgacgacgccaccaccgcgcatctctaggcctgaaggcgacccgtgtggggggggggggagccaccttgcagggcgcaagtaccacctcaccgtcactggtgaggagattctcggggtatagtgcattctcagaaataccttccaggagcttcattgccatcccaccaaaagcagagaaggtcatatagagatcataattctgtgaaaacatggaattctgaaatgtttagaagtcaaatccactaatgtggcagtcactactcctaaaactcaacatgttagccagacgggacaaacagtgttaagatcccagtgttggtaggaaaaataagtaaacaggaatcagtattcattcatgatttaaaaaaaaaatgtttttcttagaagcaaggactttcttcagcctgacaggcttctcccgggaagggtataaggtgtgggagagcccactgcagctcccagtgtagcactgtgaggctggggtggggcctccccctcctctctgtggtgctgggtccttgtctgcctccacgctgggcctctgtgacagaggctgcccatgtccagatcctggctcgctcttcatgcagcagcagcactgggaaatgccccctggcgtaggctggggtgctcagcacagtgcaagctttctcagcatgggaacggtcgtcccccaaaactggatgcagtgtgaacctgaggggaacagtaccttcagctcagagatgaattcacacccggcagggagcaccgctaccagactagcatcccagcagcatcccacagccagccctgggtgggggtgggatggggcgggctcactggtgtctgtcagggatctggaacacacttgtgcacctcactaggtcagagcagtgacaggcaggtagcatctgcctatcttagcgtcaccgcggttgttgttctctcgatgtgctattttaggacagactctatgaagcatcgttttaggcactgaacacactctgcatgtgattggtgcagtctgagcagatgcacatttggtttacagtctaagcctcactgactgatttaatagagccaccaaaagcaatttcaaacacccgcacgtactacaaatgatcagtctttgttgtttataagacgaaacctaaataagatgtttatacaatattgtttaaacttgattaaattcagttcctataaaatggaagataagacgtcagcacttaatgctggtcctccgacagccgcaccagtgggcttcacttccccagcaagcgactggttttccaacttgagaaagaaaaggacgctttccaaagctaatttatattatatttggcttttaataatgaaggtcgtttctaaatgataaactccactatgtgtgccaagttaacatttgactgaaatagaaatgtcatttttatggctctattaagctcaaaggggcacctgagtattctgtgctttaagagcgtgcacatgcacagagtacacaggcctgcttacctggagagattgtgcgtcaggacagacgtaggaatgtcctcagagcagcttctcatccgcttcagacgtgtgcgtccattactgtgtttgtctttatcttgatcggcttgttctgtgagtgccaacagccctgtcgccagcagagttccttgtttggtgaggcagacttctcacaggcaaaaccagccgagctgctgagggtgaacccctgggtgaagcacccaacgtcagtcactggtccccgacacacagctccatcgcaggcactgaagttttaaagttgtaatcagagcagcagttgggaactcagatcttctctttggaaactgccttcagccatactttgtttactggtccaaggataaaatgccaacatgtagtctgccctgagagtggatgcaggtgtgtaagggccgccgacagggcggttcctgacgctgtgttaactggagggacactggacctttgctgttcagagttccctttcatttctgccaccaccccctccattcacactcaggatgcccgccaccgggctgatcttgcatcttgtagcttactctgtgttcttgccctctccatgggacttgtgtgcccaggtaattgcccagtcagatccatccagggattcacacggcttgtcaaagaaagcatgaggccagcctggcactgcatcagtgtgatcccatcctgggtctgtgcccattccaggtgacaccctgccctgccaggaatgccctctgttcatacagatagctcctgtctccttctcaactgtatctcttattactgtctaatctcaagcccagtggttctcagccttcccttaatgccgtgaccctaataaagttcctcatgttgcggtgaacccccaaccatgagattgagcgccccacgtgtgctgcctccagtgcctcggtgctcaagacagtacattcacaacattctttatgctgatttgttaatggaggagtctttatgccagaaaggacactgtctctattaccattttaattaggtagaaatgcaatcatcttccctctttcttagcttcttatgttaatttcttctaacacatttctagtttgtctgcttgagtcatgcctaattccctgccattaagatgtgattggtgggtttgcggctgaggagagggcggttctgagcactgtactgaggtcagtggacagaccactcaccacatggtgacatgcgtaggcagccttagtgagccgatctggaaggtttggagagtttgttcgcaaggagacgcgtgtgagggagaaaccttcgcctcagctcatgaggctcctggctgtagtcctcaggacccgcgatccggagggtcatgaagtcactgaaaccagttcccccaatacaagtgagagcagagaggcactcttgtgtacttggggcctggactgactagcacaaagtgtggtcttggtcccctgaaataaaaacctaagcttgtatctcttcctgaggggtttgtttgttttagattttaaaaatcaatttgcgtatatgtctgtgtggccgtgtgagtatttatgtgcaccacatgtgtgctggtgcccacggagactagacagggttggattcccttggagctggagttgcaggcggttgtgagctgcagaatgtgtgtgaggggaatcgaacctgggtcctgtgcaggagtggcacacattcctaaccaccgccatctccagccctcctgtgaggtcttcagtaacaagcttcctggttctgtaggcaccctgaggaatgtgtctgtacatggaacagaacgaggagcaggggcttcgcacagacctggtttctgtagcagaagccatggacttaggacaagctgagtatctgaaatcagagtgtctaactccagatctctagttattatgacacctcatgtacatcatggagaattccaactctgcatcccttcttataagatccattgtaaaaaaaaaaaagtgtgtgtgtgtgtgtgtgtgtgtgtgtgtgtacagatgcccatggagccagaagaggtagcagagcacacatgtggtgtgcataaaagctcagccacagagacatacacacaaattgttttttaagtttttaagtctaaaacaagcaaacctgtgacaggattttccctgtccaatcacgttagggcagcaggaggcctgtgactggacagggaaaagggaggcggagctaagagttacagagacagcatctcagagagaggaggccaagatggaagcagaggaataggaggaacctaaaccagtgtggcattaattagccacgggtagttatgatattaaaggatagaataattgggatatttgtctaatctaggtgggcagcttttattgttatcagttggttctgaaattattgtattggcatcttgtaaattgagaatttattgatacatatatccgttgggttaattataagcttctagagttctgtttctacggggtggatgggtgatgtgacagctgaccctgaggacagtcactgtgggggctggcaagagagttgccagaggcaggaactcaggaagcctgcctgtccggcccctctggagagctggtgggcagagagcacctggagtgcgaagaataggcggtttcttttttaatatttcccacaacacaaacccctcaagaagagatacaggcttaggatattatttcaggggaccaagaccacacttcatgctggtcagtctggccctgagtacaggaagtgcctctttgctcccactggagccacagctgcaggtggctaggagctgcctgatgtgtggtgggtgccatacccaggccctctacaagatcagctctcgctctcaaccactgagccatctccgcagcccccagtgcatcctgttaaacatgagtctgtgaactgccaggtagttttgtcagttccccctgggtaatggaacttctgaggtagatctgtgtatcaggcacacatttcctgagagaattacccgagggaccggaatggtggctcagtcattcgggtgcttgctgcacaggcatgcgctgtaaggacaggagggcactgtcagccagcttctgcctccttattgctgggatcaaaggtgtgcaccaccattgcctggctagtgatgaactgttttctaaaaagtaacaggtcccattatactttgaagaaaattatatttgatctgtctggttgtctgtctatctgtctgattgtctgtctatctgcagtgccaggatggactcagggctttgatcattcttggcaagtgttctacctctgagctgcagccccaaaaccctacactaatttaaaagaaaagattaaaccaaataaaacaaaacaactccccccccccacatccctagacaacaatatggtggaggctacaacagaaatagaaagttgcctgttctaatcatctaacacacctctgtgtgtgtgtgggtgtgtgtggtctgtgtggtgtgtgtgtgttagagagagacagagagagagagagagagagcatgggggtactgtgtgactgccatgcagaagtgacaagggcagacagagattggtgagttgcctcagtctggaaaggtcccatcttcaccccggtctgcttgcggcactctggtctgacttagcacatgctcagtacccacacccagtattctcagtggtatgctcttcagggggacttgtgctttctgtgtccaggggtggacagctatgcagttggccccattgtgctccctgccccatggattcggaccctgtaggacagctttacagccgtgtcatccttagagaggcatgagaggtagtgtggtgacatgtgagccctcagtttgccacgcctgctgtgtggccctaggctaggtgtgggtaatgggtacatgtgggttttgagcatgcatgtgtaagcgcctggcacacataagccctggcacacatccttcagcctagcctctttctcaaggcagttacttctgctgctggtcctcagtcatctgtgaaccttgttaaaaatgactcaaaggagggaagagattgatgggtagatgtataggttttctcaacaactttggtagctcaactagacccagagaaccacttaaccatagaggttgctgaaggaactgcaacagagatgtggcccacctgcttagcacacgttagctgtgctgccccccagcacttgttagaggttgcttccaaaccacccttcccttgtggagaccacagtctgaggagctcgcgtcccttagtgaagagcatttttgcacgggacctgcacacactcgctgtactgtaagtcacctcacctacgtatggtgcagatgtctgttaggcagggaggagggacaaggacaaacgtctgtgtgcattcagtctgtggctgcttgagtgtgggtgcagaacctgtggacatggggggacagttatgtagagtcacagtactcagggggcaatggggaccacccatcgcttcacccatggaagaatttgtccctgtcctgagtggattatcagggtaccagggagcatgctcaggagtcaggacaaagtagagaggccctctgtcccggcgtgtactccatccacacttgaccccttcccttctttcttttactggctctttgagaagccgcaccttctggcttttgtaatgggtacatgattgacttgtatttaccactctccagtgcccccccctgcccccagccctgctcctcctcagtaagttgtgcagctcctgcaggccaatctccttcctgagttaaggcacagggtgtgcgccccaggcagcctctccagtagcagggcaggggagaggaggcagaggtcagatcactgaggccagcttgtaagagcctaacaaccaactttgccagcacactccagatgttaagggaccaggcacttacaggggaaggagggggtcaggttactgctgctgcccccagggcacagggaaggagaggggaggagcttcaggcatcttggtgaccctcacaggctgacctcatgtgaggaagttgcccatcagctctggagtgacttctctctagctggtcctttatggcctcacagcagccctgaggtatgcaaggtccctagtgcagagagctagtgctagggtacctggcacctggatgctgggatcacgaaagtcacgtcagtctgataggggcttagaggtagctcactgtccatctgctgtcctaagatggtgactatcaccaaaagggcatagcggcatgcgctgggaaccctgattaattcagaaggtatgggtgaagcgatctttgagcccaggagtttgagaatagcataggcagcactacgttgtctcccattacaacaggaggaacagatgtagtggaggacagcctgatccaccactgtcttggtcagggttactattgctgtgatgaaacaccacacccaaagaaacctgtggagaaaagcgtctattcagctttcatttccacatctctgttgatcactgctcgtcatcaaaggaagtcaggacaggaacccaagcagggcaggaacctgaaggcaggaactgtcgcagaggccatggagaggtgctgcttactggcttgctcccatgatttgcctcagcttgctttcttatagaatgcagggccaccagcccagggatggcaccactcacaatgggctgggccctcccccgtcaatcactaattaagaaaatgccttatgctggatcttatggagacattttctcagttgaggttcccgcctttcagagactctagcttgtgtcacgctgccatagaactagccagagccgctgcacactggaagcctgggaaagtctatttaataagccccaaacatggcggctgtttcttcggagagaagaaaacagcggcttctcagattcctgctgttctccattagacacttcaggctggaaaaggtggaactttagggaaggtgcacacattaccaggttgttttctagctctagtggtggtcagcgccacagtcagacactaccaaatagggggtgggtggtagccggggaggtggctcagtctgtacagtgagtgccgtgtaagtctgagcacccaagttcagattcccggaacccatcttaaaaagcagggtgtggtggtgtgtatttgtgatcccagccctggggacacagaggcagggagattccttggacctctctgagtatctgggaaacatctgtgtgcagaagtgaccaacaagttctagcctctcaggtgagcagaaggtcagaacccggactgtgaagtgcacagtgggcccgctgagtgatgtaactaacgggtcccttggcagaccggtccaatgtgactacacagttaaaacaaaacgtcagagaaatcgggagaacctgcagcccagccctccagtggcatcaaggactaaggtgggtgggtggggcttgtgagctggggagccacagtctggatgcatccatctgtagactctcccccagaaggcaaacccagggcagttttccgattttctgcatttgatctagaatgtggactgcaacccctttgggagttgaacaaccatagggtcacagggtcacctaagactgtctacgtatcatatatttatgttatgattcataaccatagcaaaattgcagttgtgaagtagcaatgaaaataattttatggttgggggtcaccacaagaggaactgtattaaagggttgtagcattaggaaggttgagaaccactggcttaaagacttctcctccctccttaattcctgaaggacagggatgataaagactataaattttaaggaacccttacattttcaaaaaaactcctacggctgtgtgcaggcagccgacagaatcagcccagctgataggatgattccgtagactcccttaggactgcttcccatgtcccggccacgctgtgcctcctgccgagccctgtctgggtcagtgttcagaaacagtgtgccctttgcctcattttcttctgtaccatttacctgctgttcctatcccgtaggcaagccagctttgtcaccacgagggccacgagcagaagggtcaccacactgataaggatgtgcttgtgtgaaccccatccaggcacgaggcccctgccagctgtttcagtgaccacttgctgacctgcaccaggctcctcttcctagccctgtctgctgttcacagcgtggctcaactcttgtgctcacgtttctaattactataggcgttttagaatgtaaaccttttatagtaaggcttgggtcagagacagcccgttgggaaaaagcccttgtctgctcattgtccccatgcaaagagtaaacttcagcctctgtgtctccagggtcagaaataacaagtgtggatcaaagatccaagtgtagaaacccgaagtgaaaaactcacaacaagggtcaggggaacgcaagctttctgctcccgaggcaacaagtaagatttcggaattatcaggcgccagaagcgtcatgcatttgagaagaacatagagatgtgtggccttctgcgtcccagagttggggccacaaacatcagagactacgttctgagctcctgtggattgtctgtctccttgtcattcttccacgtaccttacagtacggcacctcctgcatagtgtcgcatttgtctaatcacccccaacagcttgtgcacgtgcaggagaattggcatccatccgatatactgtattgtttacatgagggacattagaatttacctgcagctaaaccaggggtcctggaaccgttcccctgacccgcagggcagcagccagatccatctaagtggaaaaacctctgctgtcagaagatactgttagggtggagttgggtcaagggtggggtggatgtgtacactacaggggcctgactgatggcggaccttgtgcctgcaatatgcaaaggacccttgaaactcactaggagggaaatacaactggttgaagaaagagccaggagattggagcacatctccctaagtggagggcggcagataagggcatgaggaggtactgagtctctgcagtcacgggcgtatagactcgcatgcagatgccatggtcagagcgatggctgggcagacttaggtgctgccatctgcagtcagggctgggcactgctgttggcgtggggcatctggaactttgatgcactgcctgtgaaatggtagacacaatttagggaacacttcagagttttgtccctccacctgagcagtgtggcagaatctggtctgtgacagtggtctgtgtgagtctcccgcacaattattttcacagctgcaggaacatcacccttgctttctcctccattgcagcatccgtgtaccccaccctgtgtaggtacacatggactttgttttcctttctttgcagttcaaataatgtcacgggagaaagctttgcgtactgtgtcacagtgtgtcacatagcacgtccccaagactggactagcctgaactctgaagggtaggagttccaaggggttgtggagatcctgctagcctccttccccgaccttaggtagatgctggtctgccacatgactaggccgttcggcgtctatgtacctctcacctctcttccctagccagattggcattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatctctagctccatccaccttgtggcagatgccatgatttcgctcctctttatggccaaatagcaccccagtgtatgcctatcacaggccctctttatctgtttctctgctgatggcaccagtgctgaggccatggcgtggctgttgtgactgttgctacaggaagcacatctgtgaaggcatctctctcatctgctcctgtattcctgtgggcgccataatgagtggagtgcctgggtcacaggggagatgcacagtccccttggtgtgctcctgggtaagcacagcccccaacccccagcggtgtagaactcagaggatgggctggcactgtggcagggatggtactgccctgtcttccggcctgccacccatacactcagcagcctagctaaggggctggtcgtgagatgtgggcagaatggaaacgcgccagccttaggctaacctccaggtgtgctccaaaggagttcaaaatatcaaagcgcaaaagcatgagcccaaactgcagccttgccaacccatgaactacctctgagtttcccacgatgctgcgctcatctggggagccgagcttcggaaagggaactgtggatggggagggtgggggcttcccttttggcggtgcggcctggggtaggcacagggagctggcactcgtgttaggcatgggttttcccatgtggtggtttaggtgaggattaaggtgcttcggtggtccattttgttcctgtgtttgattaaactgtagaatgttgtttgccttgcttttctgtttttcttgagatatgactcagcagttttgaaaacctgaccagtagttggatatggtttacaaaaataatgtttccagtaagtaagagttgcctcatcttgccagactatgccccagagaatgctcacccagctttcttaatgcaaagcagttgcggactgcctctgtaggaagactttcctgtgccggcatccacagagagcctagtggtttccctggtgaccagtagccctgactggtcggtccatcccggtgacccctggagcttggtgcttgtggacatttgctcgttttgctctctgtttttcggccggcaactccacgtggactgttcccaagcacatgacctcagagatttcacagtgacagtgtgacaatggccaggccttaaagcaatgcatagtagggagggtatgtttccatgcagtgtgtgaggagcaggctgccccccaagaggcgcagatgacgcccctctcccctccagcagcgcttgctggctgatctgagctcagctcttcactcaaagctttctgccactgtccgtgacattccagggctgccgcagtcagtttcagactttcccttcgttatgctcgctgagcctctgtccatccaaggagaactagatggggagttgtgaggccctggcccctgatggtgaggtaaagcaagagaccccgatctcccaccatccactcgtgaacacgcatacgcgtgtgtgcacacacggtttggtcactgcagttcttcgagcctaggttttcagtgtgacacgtgagcacagtgacagctcggccttctgggattgtcacggacgtagctgtgtggtgtgtaggcagctctcatcagatgctagtttgtgttcttgataattctgctattccagaatcctgcggttttcgctgtatgacctacttttgttaggaaaaattaaactcttcatgtcttcatctctgagtcattgtttggtggtattttggaaacattaatttttttccatgttccttttttcaataatattttgctggctggatggtaacgcctggcatttgtgagaagaaagtatgtagtggttaggtttgaggcagagtatgtgtctgctcctaaggatgcctggccgtgtcttaagcccttaggcctcactgagggaagctcccccacccacctccagtgcaaatgtagtaatagctcttcatgtgtgcactgcgtcatgtcatgtatgcatactgtgtcatgtgtgtgcacttggtcatgcatgcttgcatgtgtgctgtgcacatcacttcatgtgtgtgctccgtgtcatgtatatgcaccacatcattgtaccatgtaacatgtgtacaccatgtaacatgtgtacactgcatcatgcatgtgcaccgcatcatgtgtgctcaccatgtcatgtgtgcgctccatgtcatgtatgtacaccacatcatgtgtgcgtaccatgtaacatgtgtgcaccatgtaacatgtatgcactgcatcatgtgtgcatgacacgtcatttactcctcattgtcatgggcaggtccagaaactgtgccctcaccttactctctccccatttccttgtgttttaaagaggactcgttagcacgttgtttccccttcctcctcagcctgggaaggacgaggatcattgttggcttttgaaagctctgaaggttttctagaaagaaatggaggaagggactcctgttggtgttgcatggtctgccctgttggatgggatgatcagccccagaggcttactcggtgggctgacatcccctggagaggttgttagactgggacctctctctcccttgtatcttacctctcctgagtcacactatgccaggaggcaaccctcacaccttgcacatcagggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagcagttatgagtactaccttgtagacacccaagttcagttttcagcacccagatggtggcacccagctacaaggggggatcctctggtctctgtatgtccatttacacacacatacatacaaaggcacacacacacagaggcgcacacacacacacacacacacacacacacaggcacatacacagaggcacacacacacacacacacacacctttttaaatgtaaggaaaacacagaacacagtgataagcagagctctcagagtggcctggccctgtgacagctcatgccagcagtcagctatggtcagtgtgaaagttgtgcttccagcaaagccgctgtgtccgagaacctcaggcagggctccttaaagccgggttcctctgtgtcatgttaacaaaacataacaaaacacctgttctatttggtagacttggtattcatcacagaaagagacccagcctcttgatacttgagataatctataacaagttcatgtaaataggaattgaagtgggggagcaccacatgggagagtagacatggtcacaggcatgtagtggcatggcgccttatgctggcagcttgagggagctagctggtgccatacaggcttcagtggctccctcttcctggctgctgcccccgagagcttcaagccacgtggatgatatgtcgatgatagaggcctgctgcctgcaaggtctccgcttacatgagacttgcagactccacttggcttgggtaagaagcagctatcgtgaggtagccatttgttctctggatgtcccgaggaccctcctggagttcagcctgcagactgctcgtggtgcagagcactctgtgctgctgggtagtggctggaaatggtcagagtgcgctttggctgtcttctcatagctttcagaatgaggaccatccatctggctggcagcattgtgcttttagaacattaaaagacatgaggccgattatggcttagggtgtagctctgaggccgggctctcaccacaattaacaaggtcctgggttagagccccagaaatcacagaacgagaagctaagaccctgagaacgatatctcagcaaatactttttgttaaagacagaaaagtacatagaaacatttaagaagcgttgttttgtctgtaatatgtgaaactccagtgtatcttccactaacagtgtataggcactattagaaaggcttgtagtaacgaattctgaaatgttaaagctgccttacatcgcctcatttgctgccagttgcctagctgaccttgtgaaaataactgatgtgtaagctgtgttttttggtccagtccttaaacattctagtttttctaagtgaagtgtcggcaggagccaggcactgggtagttcaggatgttctgccatctgtctgtccatccatctgtccgtccgtctgtccatcagccagttgatttttctcctcatatgttctggcattggactctctgcacccattgccttacaacatgctcaaagcatggatggtagagatcattcagatactcagctggtcacagatcgaaggctacatatgacagttatttttatgtgattgtgacacatagagaaagtcaggtgtgtgagcatggggcctggtctactgagaaggctttgtctgaagcctctgacacagctctgtgtgtctgttgcatgaaagggcatctgctgcagtgtggggctctgttatgagagaggatttataaggagttccggagtcaaaggccactgttaattttgttggtaaaattccttgctatgccccgtgtagctttcaacttgaagtccatgtgccaagtgtccccttttgttagtatagattctttctctatgaagtcaagaggagggagagatgaaggacaaaccagccaggccgagctttgacgcttttacagtttacatttcataccagatggctccaaattatgttcagttgtttgtatattacgctataattgattgtgaactgtcaaagctttcttaagggaagttgcgtctgtctgctgtctgcacttagccttgagagctgcggtgtgggagaagagctgaagtctccactgtcagctcaccactgaccccgggctcttgacctgtctaaggcagccaaggttacgcgggtggcaacttactgggctaaaaaattgtatttctcccctggcaaaagcttgctccgcctgagcctctgttttatgtagtggaccctcggaaggcggctatctagggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgggtcaggacctcaccagggcccactggctcccaacatccatggctccagcctcagtaggaaactcgcagtgttgtcaagtgtccagtaggttaaaatctgcaaattaggaatgatttttaaggattaaaatgttctcagttggggccggagagatggctcagtggctaagagcccttactgctctagaggaggacctaagtttggttcccagcatgcatttgggcagctcacagccacccgcaacttgagctttaagggacctggcccgtcttcctagcctttcccccagaagatgctgcagtgagttggtctatgggttgatgtgttagcccctgacctgtgcttacccccaactgggcggttgtcttgtctttccttggctcagctcttggagccctagaggacagagctaagaccaggtgtgaagtgctgactgcagagccagcttccccgggagagaggagaacacatctgaatgaggaggagagtgagtgtgagagtgagtgagtgtgagtgtgtaagtgaaagtgagagtgtgtgagtgggtgagtgtgagagtgtgtgtgagtgtatgagtgagagtgtgagtgagtatgagtgaatgaaagtgtgtgtgagagcgtgtgagtgagttagtgtgagtgaatgaaagtgggagtgagtgtgagcatgagtgagtgtgagtgagtgaatgtgtgaatatgagttagtgtgagaataggtgagtatgagagtgagagagtgagtgagtgtgtgagtgaatgtgagtgtgtgagtgagagtataagaatgtataagagtgggtgagtatgagagtgagagtgaatgtttgaatatgagtgagtgtgagagtaggtgactgtgagagtgagtgaatgtaagagtatgagagtatgagagtgtaagagtgtgagagtatgagtatgagaatggatgagtgtgagagtatgagtgagtgtgcgagtgaatgtgagaatgagtggtgcatgtgagtgagagtgtgaatgggagtggataagtgtgagagtgagtgagtgagggtaggagtgtgtgtgagtgtgtgtgagtgaatgagggcatgtaagagtgtgaatgagtgttagtgagcaagcgagtgtcttcggcagtgggcagaccttccttcaggaacattgaagggtttttgccttagttgctttcatttccactgaattagaatgcgcttacaatgcacacaccatcaaggtttctcacgagtttatgaattgaacttgtcagaacttgctaacttcttcccaggctggaatagaagctccagggaactgttcctggtaggtggctccctggtggccctgattgtcggctgctggttgctggcatggcactgtctgttgccagggctggggagcagggcctgtctttgccagacctgccttgcctgaagaacgtaccaggtgtccaggtggccacaccactctatgacatgacgttctgaagtgctatctgtgttgttgaggtggtaactccagataccgcagcctttcctgaagcgcatattatcatcgggccctgttttaattttaggactgacttcaaatcattgcgtgctgtctttctcctctcccccttcaggagggacacagagattaccacgtgccatcgggatgtccctggctaaggaactcatcttctctgcccgagttcttgacggtcaagaagccaaagctgtgggcttgatcagccatgtgttagaacagaaccaggaaggggatgcagcctacaggaaggcgctggacctggcgagagagtttctacctcaggtactgtgagagcacctgtgtgtgtcactcgagatcaagcatagcacccacctcatgcactgaggtggccctgtcccgcctctcaagtaaaacggttaaaattaagatttgaaagtaatctgagggttgtgttgtattaccaacagacacatcacttgtgctacacacacacacacacacacacacacacacacacacacacacacacagagtgtaacttcctagtaaattgtctttgcttgtataccaactcagtactctaacctaagacatctctatggagagagagcaattgggggggtgggaggggagcactgtctcacatccaggcatgtggaacgacactgcatcctagcaagttgggagactgtgtgcacacgcccgcggaggccaaggtttgccattggtgtcttcctccattttcctccacctcatatatcggagaggaatctcttccttgggccctgagctttatagttcaacttaacctgtccactcagcgcagtctgcttgcttttgcctccctaagtgctgccacgctaacctgctattcatgtgtgttggagatgtgagctcccagtaagcctattacccactaagccttctccagagcctcacaatgttgtattttaatataaaaggccattcacttctaaatacagcaagtggatgctcaactcctgtagaccgatgtaaatcaagatcaaagaactccgctctggctggagaggatggccgcctctagggcagctgagcttccacagtactgaaggttgctgctgctcttctcagagagggtgtctggttctcccttccataacccagacgtacctgagggcatacgtccgtgtgtcctcctgtcactgcagtcagctgtccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtgtgtgtgtgtgtgtgtgtgtgtgcgcgcgcgcgcaattcgcttgcacaagcatttgtttgcacactgagaccaaagaagagtgtcaggtgtcctctctcaggttctgttactactttaagggagggtcttttcttgaacatggagcttgtcgctgttgctggtggtggtggtggtttgtttgtttctttgtttgtttgttttggggtgttgttgttgtttgggtttttttttggctaagttggcagccagcaagctccattgaccctcctgtctgcaccctcaccctccagtgctagagtggcaggcatgtaggcccacgcacgcccggcttcttacatgagtgtggggattcgaactcgggtcctcatgcttccagagcaggtactcttagctgtgtgagccatctctccctgcagctttggcattcagttattgtggttgtctgaaaaactcctcctcctctgcacacagggcccccaagcttccttggctgcgaggcagtgtccggagagtgggcttgcacgcactgaatgctgtgtcataaaattacgagcgattgccttacctcagtgccttaataatcttaacaatatttgcagagacacctcagataggccttacccagtgctaggcaaatcttcagaccacacttacttacccctcatttggtgaataccgaggctagccccctgtcagacatgtctctgaagtgaggctagccccctgtcagacatgcctctgaagcacagagaggtcgcgtaactttcccccggttgcacagctccccagatggtgcgtcaggatgtgaatccgagggcttacagggcgcaggctgcgcatcctcctgagcaagtgggctgtgtgggaggactcggtttaggatggggctattgaatttgagtgtgcattgaatctaccttattctgctgaaatgaattatgttttctcctcaggtcgacttagtaacagggttagccatagaagaagcctgctatgctcaggtatgtaacatggtgacagatccagagagtgggtacagcactgccatcctcaggggcagggccatctgggttggcaggagttgctgctgagattttacagcggtgatatttacggctcagtggccgtccctgggcttctgagccttctctttccacaggaaaagcaaagtgtatggttatatcgatagacacacatccccagaagcgaaagtctttgtcaaggtgtatgttctcgatcaaagctctcccccagagtgcgagctgagcagaccccgcgctgacacggtgctcaccgggcagggtcggggctgcggtgactcctcagtgtccccgtcagcttcaggtcaggagctgagctcatgcgccaaggcaagaccaagaagtggagcttctgacacacggtgaaaaggtagcagtgaagctactgacataaccgtctgagacagttccaaaaaaatcgacaatgggaaatcctcgtccaaggtctcagcaaagatcacactgatcccgcacgcctgtaacaagagaaatgcatgggcgtgttcttcgtagtcaagacctttaacaacgtctacccaagctctagagcacagaactagtaaacgctggtggccgacatcatgatctgtacagtaggaagtccgtgtttgggggagggggacccagcaccattcagaagtcagtcctgtggggcgtggtggtgcacacctttaatctcagcagtccagaggcaggggcagagcagaaacaggcgtgaatgccaggtcaaccagggccacacagtaaagtgagaccttgtctcaaagcaaacacaaaaaagtctgaccatttaataatgctggacattctataacagcaagcatctcagctcattatttagtgagtaaaaggttgattccaagtccaaggacaagatgcagaatagatagctgggtgtggccagaagatgaagctgggaaaccaagagtgcccaggttcaaggctttgtgatgctggtgacagagctcgtaagtccatctggggctgagttccgagactcacacggcccgcaccagtcaagatactttaacaaaaggacaccaaccactcagtggagagcagacaggagcgagagcaacatggaacatccgggcatccacatatatgatgcacacggccttaccctttgcaccaaacgtggttccgtcccagtggccgggaaagccgccactgtacagtatagtcggaggcttggccttggttatggtgatgtaaagccaccgaagagagaagacgagagagaagagcggagggtctgactccgttaaaattcacttctgctcagtagaactcggctggaaggatggaaaggggtgagctgggagccagccttcccacagtgtagacccagtaaaggcctcacatccaagacaccacagtaaggtagtgaaaacccactgtagaaacggacaagagccccgagtagcctcctcaccgcagtaggcgagcaggtgacaaactgtaccctgagactgtgctgcaaacgcctgtcatttggaagctgaaatctatgaagtatgtgttaagtgaccagaagtcagaacagtgggcactgactctcactgtggctactagggttagtggttcagtgaccccaagatagatgtcagtttgagataaggccgagtgtccactgaccacgtcacccagcaactgtgccccttgatgtttactgagacaaggtgaaaacctgctgctaaactttgttcacaattgctaatctagaaacagtcaacgtgcgcttcagagtcaggtctagagacacaagactaaaattcaagaaagggcaaggctagcctgtggtaacaagactttgaagatagcttcaactacatagtgagactctgtctcaagaataaataaaaagaggtccttgtataggtgatacaccacctggtacatctgtgtggtagaatattgcacagcgagaagaaggggggagctgtcaagtaacaaaatggcacaaaggaaccttgaattcacagtgctccagggaaggtttcagtctgaaagtactggctactgagtgactcccgacgcccagtgacattctggaagaggtgtttggcaggttggggatgagtacgtagcgaactaaggatgcctggggcagctgagcccttctgtacactgtggtgacaggtgatgttgcacttctttcaaaacccacagagcgtacaagtgcgtgagaccaccgactcctcacaaggtagccgctgtgtgctctgatccaggccattggacatgggagagcacgggggtctccacttcctgagcttttcatttgtttagcttctggaaatcagatatctcatgtttaaagcatagtagaaatggaaaaaatttgggggggttaaaaatagtttggccccattgttaggagacttgttcaaaggactctcggccttcccagcagctgctggtggctcttgtagttaatgcttgatccactgttgtggtttatatttttgtgtgtgtcatgttttgtctcttagaccatctcaacaaaggacagactggaaggtcttcttgcttttaaggagaaaagacctcctcgctacaagggagaataggaggagagcccgccgcagcctcccatagtgctggaagtggttcagagccaccccgtgctgccatgggaaattgcagtgaccaaagtggagagtgggttctcactacacccggagcaggcccatctgtactcaagccactgtgcgccatgtcatatttattcagatttataaagctagcaatgtccgtggtcaaaacacgtaaaaattaggtatatgtttttaatatttcccgcatatcaggctttgtcgttaattttttaatgtgaataatttatattgcacactctaggaaataattgattgtatgtctaccatgctgcattaagaaaataaaactatttctgtatcccaaaaatgtgaagttataccaaatgtagttgctgagtaattatgtacatgcgagcatacacatgtgtgtacataggaacacacacatgtgcatgcacaaacacacacacacacatgtgctacgagcatacaaatgcccatcgccaccagaggacctgggtggacagtctgagggaaacccctctagtttcaataaagccaatggagagtgatttgagaatccgcgtcttgccccttgcccaacatttcagaacagatttcagagtaaagtctctttgctgaccctgccgaggaaccatgtgacacggtcccagaacaggggtgaagggtcagcccatcagtggttctgcttggcttcaagccacagtgtcttcggcagaggtgtcccgggctgggcctggctgtgctttcacagagcttgatgcttgctgaagactgcagtgggcttcctgtcccgccacacacatgcatcctgcattcccttccctcctaccacacacatgcatcctgcatgcccctccctgctgccctgccctcacatcctcaccctgagcctgctctgctgtttgggagtgcaccgatgtgattcttaaatttctcaagagagaacaatggcaccagccaccacctctgccactgagctgcagatcagaatgtctatccgtctatctgctagcccagctaaccagctgacccccccccacccccaccatctgatgtcagactgccacacccttgatcttcagcctgaaaccttggccaggggggtgactgtcctttagacttcccagggtcatgtcctgtctgtccacgacacgctgaacatctcacagttattctaactgagctggaaatggtactggtaatgggagaggatgaggatttggggaccaggtcagcagttgatgattggtcaccacttggtttcctaacaagttgtgaagcggagagcaaagtcctatagcaacttaagacagggaggcagcaggatcaggtgctggtccttggtgggtttgccttccctgggttttcttttgctgccacccccgaggccagccattgtggagggctggcttggactcatagaccttgccacccagcatggagtatctgtgtacagtcatggtcacatctgttctttttgttgtatttttctgttttgaaacagcctcgtgtggcccaggctggcttccaagttggctgtgtagtcaaggatggccttaaacttgtgatattcctgtccccacctctaggtgctggaattgcaagcatgcaccatacctggttttctgtagcattggggctgagtcccagggcttcatgtatgccaggcaagaataccaccaatccaactacagccctagcacttgaagtagccgaaactggtggctaggtctgtatgtgtgggctaaagaaggcagttaccctccaagaggcaaaagcaaacaaagcatttcacttcatctcagcaggagacctgctggttctgatggaggaaacctacagaccacagaggcccctagtgactgctggaacactcatacttctagcacttgagaagcacaggcaggagaatcatgctttaaaggccagccttgctctgcctcccagttaaaagttcctgcagaggacccaagcctggtgtccagcacctcgaatgaggtggctcacagctgcctctgattccagctccagtgggttcggtgccccctactggccactgtgggcacctgcacacatgctcatccatgcatgcagacacataaatagtacatgatttagacagggtttcacaatgtagctctggctgtcttaaagttccctgtgtagatcagactggccccgaattttacagaatttgcctgcctctgcctccctagtgatggggctaaaggcgtggattttcatgtcagtcccattttgtgtgtgtgtgtgtgtgtgtgtgtgtgtgtgtgtgtgtgtgtgattgtgcatatgtggatgagtgagggttatgtacaggtgtcagtgcctgtagagacattggcgctccctggagcctggtttacaggcagttgtgaccgacccaatgtgggtgctgggaattgaactccacaagagcagcaaatgcttgtcacccctgagccaaatctccagcacaaaataaataccaaaaaaaaaaaagttatagatttttttgtggttatctctttgatttcaaggatcatctcagatttttgttttctacactgaaagatctgttttctccaccaaccaagacttacccctttatcaaatacagcttgtccggcagggtcatttccccagcagcaatgggaaggatgcttttcagcggtgggggtgtcggttcttggatccagggcttggaggaaacacaccctttcagatagcttgtttgtgctggctgtggccctctcctttgcttgaccttcatgtccacttggatggcatgacctccactgactctcatttggagtccaaagatcctgacaggctgacattttaaaataataagtccattatttgtctacctgacctagttaaatattaactgacgagtatgtctggttattgggctttatcgaaaagccagttgagattatttttttttcatactatgttaaaaataaccatggtacacgtgtcacaaaatgaaaatgcgtgaaagttgctagttgataatctaaacaaataagagctattttatactaatgaagcagggtgcagattgcgattagggaacaaggagagtcacgtaaatcctgtactcaaaatatctgtgtttcaagccctaaaattcctacagacacccagctccgtcttgtcccagctctcccttctggaacgttcaaagcccgcctcccctccctgccggaggacagcacttgagcctcagacagttggcggttggtgaccgttttctaaatgttcagggcaacaggaaagccagggcctggtagggaagattgaggaatccaaagagagtgcacacagacactatggatgcaccaccctgtctctcgcttgttcacattttgagaaggtggataggaaggtggcccttccttggcaagtgacagatctctggggacaactgctcataggagccagcatggttgttctttgtaaaaccctaacataaaaaaatggcattgggctgacagtgtggccaagtggtggaggcaggcctgagcacacgtgcagccctgggatcaactcccggcaccacaaaatacaagtgttgatgtggtgccataagggtatgttgacatgcctgtagagtatgtttacgtgtttaagggtatgttgataggctagggtggcacattgtcgttcagaggactgaattaggaacctacctggtgattttcaggccctgtgtgactctccgtgacattcagtcaagggctcactctagcctcctatggtacccaggggagaccagcacattgtcccaacaagtcagggattgatcccagaactggcgactcagcacttttgtgcttgccggcagccagatgacataaccgcaccaaagctttgctgggtgtgctgtctacacagggaagcatgtcctttgccctgatctcatgacttggggagataaaggaggtgtgcttatcggatggtgacaggcaggcaggcgtcagagctgatactcccggccccgtatactgcccatgttcttctcactctagtgttaaacaaatccctcaggaaaagtatgttatccagttctagttaaagaaactgggtcaggagtggaagctgagttaggtgtctgtgtgtaggaccttggtgctcacagacagcagagtactccgagagatgtgtggacaccaagggttagttggcctctgctgtgaagcccagagtaacctggccttacacctcaccgatccatcactgggacaagtgtcaagcccgagaaccacactgctcaagaagggaccccatctgtgttcaccaccatctgggctcttttcatcatggctgacatgcctcatctctccaccccggtcatgctggatgccgtgaccagcccccctcccccctccacccaacctgggacaggattttattgtgtagctctggctagctttgaaattacagagatcaactcacctccgcttctcaaatgctgggatgaaaggtgtgcatctccatgtccaatcttgtatccggttcttaatgccctagtcatggggatggatcatggagtcactggttttctgagggcacccaagaactctagagcaaactttggctccaccgataccaagagcaaagccataggcc

SEQ ID NO: 74 - DNA, 793 bp, Mus musculus
gggcgcccgctgtaaacatacaacatggcggcggcggctccaggcgctctgggcgccttgagaacgggtcgcgtccgcctggtggccgcgtgctgcgcgcggctcggccccgcggcctgggctaggggtaccgccccgaggaggggctacagctcagaggtgaagacggaggatgagttgcgcgtgcggcacctggaggaggagaaccgaggcattgtggtgctcgggattaacagagcttatgggaaaaatgcactcagtaaaaatctcctcaagatgttatcaaaagcggtggatgcattaaagtcagataagaaagttcggaccattatcatcagaagtgaagtccctgggatattctgtgctggtgctgaccttaaggaacgagccaagatgcattccagtgaagttggtccctttgtctccaagatccgatcggtgatcaatgacattgcaaacctcccggtgcccaccatcgcagccatagacggccttgccctcggagggggtctggagctggctctagcgtgtgacattcgagtagcagcttcctctgcaaaaatgggcctggttgaaacaaagttggcaattattcctggcggaggagggacacagagattaccacgtgccatcgggatgtccctggctaaggaactcatcttctctgcccgagttcttgacggtcaagaagccaaagctgtgggcttgatcagccatgtgttagaacagaaccaggaaggggatgcagcctacaggaaggcgctggacctggcgagagagtttctacctcagg

SEQ ID NO: 75 - protein, 260 aa, Mus musculus
  VARIANT (1)...(260): Xaa = Any Amino Acid
TYNMAAAAPGALGALRTGRVRLVAACCARLGPAAWARGTAPRRGYSSEVKTEDELRVRHLEEENRGIVVLGINRAYGKNALSKNLLKMLSKAVDALKSDKKVRTIIIRSEVPGIFCAGADLKERAKMHSSEVGPFVSKIRSVINDIANLPVPTIAAIDGLALGGGLELALACDIRVAASSAKMGLVETKLAIIPGGGGTQRLPRAIGMSLAKELIFSARVLDGQEAKAVGLISHVLEQNQEGDAAYRKALDLAREFLPQX

SEQ ID NO: 76 - DNA, 163321 bp, Homo sapiens
  misc_feature (1)...(163321): n = A,T,C or G
ccacgctgctctatttctttcttggtgccaagtgttttacatacttatcaacccaataaatgggcataattattctcattttataggtgaaggaattgaagataattcagtggggcatggtggctcatgactgtaatctcagcactttgggaggctgaggcagatggatcacctgacgtcaggagttcgagataagcctggccaacgtgacaaaaccttgtttctacaaaaagaaaaaacaaaattagctgggcatgatggtgcctgcccatagtcccagctactcgggaggctgaggcaggagaatcacttgaacccagaaggtgagaccacgccactgccctccagcctgggtgacagagtgagactctgtctgaaaaaagaaaaaaaaagaattcataaagtgaaatagatatattagctatactgcagatgaagaagaggaagcatgaagtatttaaataactcactgatgtctcaaagtggagcaattatagagcagggatccaaagccatgtctatttggtttggaatttgttaaattcctgatatttggcaatttgctgttagttgtcatgcttgacaggttgtgatagtcatggtgatgtttattagttgcattaatttttaagaatcaactttggtcacagacctgagatacgtgcatgactattgcaaataaggacgagagtcccaaatgttagggaaggggatagtcctctatgttgcattttttccatcaggctctatgcctttagaaacaatgggtggtcctttgttttcttctataacccaaacaatctatgattatctttctgcagctgtcctagtcaattatcagtattatctgaagttatattattttaaatagcactgtcaggagctctgtataactgctttctctaaatttaccatctattgatgaaccgacataaagatatcaaaacaactggagaccaatattaataaacagtaattatataattgcaataattgcaatggttgatctgtaaatacaattgtgagtttcctagtgttacggaacctttgaggtgtcgatttcctggccagaaacctctgtggctggtggcacctttgccagagttcttgtcctgggtccaggaagaatgaggtatgcagacaagtggagggtgaacaagacaaagagaagctttattgagcattaaaacagctcggaggagacccgcagtgggtagctcctctctgtaggcagggtgtcctgaagtctgcccagctcctaggagagaggaggccctggagagggtagctcctctctgcagctggttgtcctaacatctgcccagctcctagcagagaggaggccctggagagggtcactcctctctgaagctggtagttctgacatctctgcaagtctctgaagctctcagctgagagggtagctcctctctgcagctggttgtcccatcatctgctcagctctggctgagttggggattttatgggcctcagaggggagcaagtgcctgccgctgattggtccatgggcagccatgggcaggctcggaaaaggcaccacaagttcccactctggttcatggggctggcagcccaacccccagccttcaggccctccttggccagaagctggggcctcactggggacccacccccttctgcccaggagtctgtctgcctcccactgccattcatggtgcctgggttcagcctcaactttgctccaagaatggagcaggtgccaacagcagggagaagccaggcagcaggagcaggcatttctgagcctgtgagggcatgcagggccttcctgggcccccaagagtgcagggatgcctggggctgcagccgtggtttgggtggctacagctgccctcggggagggcagggctcctgcctgctcctggccccctaagagcacagggaggctcagatctgcagccacaccttgggtggtgcttctgcctgctctgtggagcaggaggccccagtctgcagctgtgctgcagaggcaaccagggagttcccaccccaactcagaaggggtgggtctcccgcttgtccctggctcccgccagagagcgtgcagccctggccatgcctccctgctgcagcagtaggccgtctggagcagccgctgccatctctagtacagtaattctcataattttattttgccttggtatccattttgaatatgtttaactttctcatatgagaagcagggctcaatcacctttgatacagtttccagttctctgcttcctcccagttcttcaatgtgatccatccagatatctgcttaatgcaactgcttcctggtgaccatctccctatgggacaggtaaatgcagcctgcttgactcacctgttgacctccataacccacatggactgtgtagatgggctccagtgaccacctcacagtgacagggtgactccatggaacttgtgcctgcttgttctaaactcaccaattagaacttccatgggaaactgcttgggtaacacgctggaccccaacagaggctttagctccacaagtgccccttccttgacccccttccactggctgaactccctgtcacctccagatttaccctccctctggtgaccacaagaccaaattagaaagaaaccataacaataaaaatcacaacacccagcagtcaacatgtacatcattatcagaaaagaggaaagatacaaaggaagcaaagttttccttgtagtaaacttcaggaaaattttcctgcatggaactttacaaaagatagaataaaaagtgggctgtgcatggtggctcacacctgtaatcccagcattctgggaggtcaagttgggtggatcacttgatgtcaggtgttcaagaccagcctggccaacatagaaacacccatctctactaaaaatacaaaaattacccaggtgtggtggtgtgtgcctgtgatcccagctactcaggaggctgaggtgggaggatcatttgagcctgagatgcagaggttgcagcgagaggcgatcacaccactgcactccagcctggccgacagagccagaacctgtcaaaaaataaaaaataaaaataaaaataaaagtgccttcaacatcattttacagcagatgcagtaatggaattcagtctactttttgtttctacattggataaaagttgaggacataatgaaggatgttttgcttaggactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcgtgtaagtcgtgattggttttagtgtagtgaagcagatcctggttattagtaggctgtgtgaactttcaaggcatggtaagaggaaagggctgtaatacctgcagggtttcgccatttgaaaggggttccaaggcattctttaataggcagtggattttgccatttgtgagggttcttgggcagacttatctcacgtgtaaaacaggaaaaacaataccaactttataggtttgttatgaagatgagatgagattgttaatgtaaattgccactagcacgtagcagtgcttcaggagtgtgatgaatgactttattccttacttattattccagacagagacaagaacatggtcaaaggcatggagatgtgaacatgtgtggtgtatttgggacgtaacataaggcaagtgtggcataagcagaatagtaagaaattcagctggaagcatagactagcactggagtgattagagcctgaatgccatcatcttttgggtaagcttagtcatgccgggacttcacttccgttaagtgtaccaacaatatgttagatataaagggattgcaagtacagctactaatatgcaccatattctatttttttggtcgttatgacttgaatgcaattaaaggaatatttgtgcagaatgtctggacagactttaagttaggatctgaatggacagaagagagaatatcagataataaaagataataaacgaaaatttttttgggtatcatggtttctttttttttttttctttagccttgatttcctgatgagataggacatacatcatggtttcttaaagttgaccccgcctcctttgagaattggcaagaatgacgactcaggcttggctaacattacctaggctttgctttgctttactgttgaaccagcaataagcagtgcaaagaaaaacatgaggtcaagggtactacaggtgaaggagtttcctgggtgcctttatttctcttagaggtgggtccaaaatttggtgctctcagcagcctctaaggaataggataactctcctagtcacaggagcctcaaacagcatgcagcactttaggtgggtgggggtaagtagtgcagaatacaccaggtctcatctgttatctgggctccatatttgtaatttgttgtaggaggcatagctctataaccaaatttccttttcttttctttttttttcttttgagatggagactgcccaggactttgaggctgcagtgagctatgatggagccactgcactccagtctgggtgacacaacaagaccttgtctcttaaaaaaaaagaaaaaatgtatgaacctatttatgtagaatagctccaacagaacatatgatccatttatgtaaaatagcaacaacaagccaaatggtaatatacaactctatttctgtatgtagatacgttgaacattttctggaaggttacattacatgtaactgtgataactgtggcttcttctggggaagggaatgagctggttctagggaaggaggactttcactttgagtgtattttttcattttgtataagcagaacgtattttgttttgtttttaaagtctcagcaaagttgttacattcatctttcagttgtgtgagctttatagagcaggattcatgctgtgatgtgaccttgttacagattcactgaagatttttgtatgttttgtgaaaagtcaggaaaattaaggttggcatgtgaacgcctaagcttttctgagtttggtaaactttctaggttatgtgaggaggatgcatgataattgagttcttgagaagtgattgaattgtgaattaaagtgagacagttataaaaaaaaacttttagactttgctgaataaagctaaggttttattccattttagaataccaaaagcctacagatacatttgatggtacagttgttacatattagataattcatttcagattgcagagctaatttctagctttttgaagtggaagtactcaaaacatcaagtctcagatatgggaccaaaattgctggaattaactgtgttagaaacattttgatggcactttacccttcagtaataatgtcagcattatcatatctagcagaaattatggtgaaacttttaatacttactgcatgagaggtgttcatgctagaagggaggttaattgggtcctcatgttgtaaattttacatgtatcatatcattcgattctaatacagtcccatggagtgtggaactgttagtatcttaatagagtaagaaactgaggatcagagaggttaagtaacttgccgaattcttaatagagtaagaaactgaggatcacagaggttaagtaacttgccgaatagctagtaagcggcagactgggatttcatccccagcaatcacaccttagagcctgcattcttagcccttggacgttgtatcaacttggatgtctgaaaggcacttcagattcactttaattaaaaacagaaactcatgagctttactcccctccaccctcaccttggtagttttatgattttgtctcattaaatgtcatctttcatccaattggtgaagccagaaacctggtaaatactccttaacactttcttccagttaaatcagtcctcagtctaggcatcattaactcatttaaaatttttgaatagttcttgaatcctttcactttcctttatttttaccaccaccaatctcagccaaacctgttatctgttgattggactcgaattgtgtcttgaagctcccacccctgtctacttctggtatgatctccaagtatagaaactattcccccgccagttttatatgtgcatgtgtatatgtttatacctacgtaaactccttcaatggttattaggatgaagaccagactttttagaaggtctgtaaggatatttctggcttgtgctgacctctttactttcattggtcactctcttctccccctcgtaggttacaggacattcagtgggaccatgactagtttatgcttttcctgtttcctctgcctggcagtcagcccctctccttcactctcaccttgactcctacttatccttctaaccttcactgtctggggtaagctttccctaaccatctccttttgccccagaccattatcaattctggttacaagttactgtagcaccacttacagcttgtaaagcagtttgaatggattattaatgatatttatgattattaatgatttctatgattattaatgtttgtatttccctcctagactctagttcccatggctgctgatcactatagtacgtactcagtatgtttgaatgaatggacacatctagtcttagctgcttgattttcttcctgaggaaactgaagcttgaacagtgtaacacagttttattcaagtatagagttagattaccacttaatagctgaaggaagttacttcacctctccaagtctccatttctttatccgttaactattgataaaagtagtgcccacctcttgggttgtggtggggattacatgagttaattcgcttaaagcacctggagcagtgcctgaggcctactggtggtagctgttgtcagtagtattgggacctacccaaagtcattcagctgtttaatacagatcctgtcagatagcagtcctttatgcttttctctgtactgagagcatttggaattcttgcaaatttactcttgtgagcagaagttcatctttatactttaaagaatgggtctgcacagtttcttgcacagcgaaggcatgtgtacattttgttgtcttcagtttagctcagttgcaaataagaaacatacccaccctgactcagtggaaggtatttctgatacactgtgaaaatttgtctactccaagaacaagaaggttagtagaggttgtgtagaactttgaatatcaaattaggatctttgaagttggatattttgaaataaataatgaaaggattttaagtaggggatgcattctatgcatagtactgtttttagaaaattggtaactggaaggaatgggaggctgggtttaggtgatggtctttgattaaaaagtggggcagttaggagtgacagctgggtttgtgggagagataatgaactttgttttgtataggttgagttggaagtacttcttggacatcttaaatggaagtgccctcaggttaagtatatcagacagaaatcaggagagaagcttgggatagaattactgaaaactgtgtagtatgaacaacaaaaaaatggagatattaacaactggtcctagaaaaagcagatgctataatacctgcatgtgacaaggtttattagcggttactttggtatctacttgaagatgatgaaaccacattttaaatagtatcctttaacttaaaattttcactaataagtctagtcttccctctagtttgagttagtgatgtaaaatttaccaaaatgttgcaaattatcttggtgcttaagaagagatcgattgaagggaacgtgatgtcatgaatttctttgatttgttaagttcgaagctagctagatgtgtgatgtagagtctgttctctgaatgccttgctcactcaagtgcttgtactttttttcccctttaactaggaattgtggtgcttggaataaacagagcttatggcaaaaattcactcagtaaaaatcttataaaaatggtgagtgtaaagattaaactgtttgcttctaatattaagatatattattgtcatcaatgtaaaaatgttttgttttttttttctctttttcctcctatgcttcctatttctgtttagctatcaaaagctgtggatgctttgaaatctgataagaaagtacggaccataataatcaggagtgaagtcccagggatattctgtgctggtatgtaaatatgttgtattatgaaattaaactgtagtctgatttttcctcaatagtaatctgttttccattagaatgttctttggtttgaaccccattaccaacaactcctctttgtctgtgttttactgattcacaagaaaaaaacatgcttagtctgtcagcattagaaagaagcttttgcaacatttagattgttttggaagttgaaaaaaaatctttgagccattaaaatacttgtttgtagtacctgtagtacatgtagtacaatgttgtttgttgtgtcttaattgtggccaatattctttagtttcattctttttttttttttgagatagagtcttgctctgtcacccaggctgcagtggcgtgatcttcgcttactgcaaccctcgtctccccagttcaagtgattctcccgcctcagccccccgagtagctgggattacaggcgcctgccacctcgcctagctaatttttgtattttgagtagagacaggatttcaccatgttggccaggctggtctcgaactgctgacctcaagtgacccaccatctttggccttccaaagtgctgggattacaggggtgagccactgtgcctggcccctagtttcattcttaaggattctcaattttttaaagcttcaatctctgtggcttctgccttaaaatattgcagaatagtgtgatatttagaaatatgcagtgtattttggcttttgataaggttttattgcctccttaatacatttcttaaaatgtaggataccgaaaagaattagttttaattccagttgagtaaccaaagagtgtaggtttattactcccagctgctagggttatggtgttatgcagtacagatttctgttttcacatttgtcaaatgtgagtaatactgtctgcttagtaggagtgcttataagggttttatgtatattttgagttctttgtttttttaaacaatgtgaaagacttatatcaagagaattaggattcttatgtctagatcatattcaccaggtgaatatgatcttgaggtaaaggagtataacacatgactgatggttgagaggttctctaaaggtcattggatggcttattgggaagatacagagtagctttagggtttttaaagaaggcccaattatatgaatttttgaggagtgatatcaatgttgtgaagacagattaacattttaaaaataagtgttagtggtcatcccggcattgtttttctgttggcagtaggttttataattattgcactatagttactggtggaattctttttattttacatattcttttgcagcccatttgttctagatttctgcattaggaatatactttgaaaaaagctttaatgctttagcacagtttgtggatgtctgttacagattgcctttttgaggacatgcaaaatgtcctcaaataatataccacatgctgtttattagaataacatgttagccttgagtactttttaacaagttaatttaatctatttactttgctttatgtgcttttaaactttcgtacaatcaggataatcttttaactcaagatttgtgactgtattttgtcaacaaaagtcagtgtcttaattatagaaaaattggggcatatcattctcttttagtaattcagtgtatatgatggaactgttctttcagatttctccgaaaggttttcctttcttgtttttttttttgagacggactttcacgcttgttgcccaggctggagtgcagtgccacgatcttggctcactgcagcctctgcctcctgggttcaagtgattctcctgcctcaccctcccgtgtagctgggattacagatgcccgccaccacgcctggctaaatttttgtatttttgctagagacggggtttcaacatgttggccaggctggtcttgaattcctgacctcaggtgatccacctgcctcggcatcccaaagggctggaattacaggccacacatggcctcttttttacatgtatttacatttataagctgaccagtaggtctgccttttttttttttttttttttttttttgagacggagtcttgctctgtcacccaggctggagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgagtgttgatagtgcgcacatacacacacacacaagtcaaaacaattctgctatttcaaaatgtttatgtagttaaaattttaatatttgccaatcacaaaattctaaagaagtctgattgggctgctgcgttggatgtaaatgtgaaatcaccgtcatctgtttatttttgttcttttacttttctaattcaaagtaacaaagtgcacatgcattgtttttaccagaacatttttgaaatgaaattttgtgagaaattactgagaatgaggattttttcttttgaaatttcctaagatatatgataaacaattcttggtaattgattgctatatgtagaaccctaaattgtttcactgaattacaccagtgtgggttttataaaaaagtaaaggtagttttgcttctgcttttgaattctagtaaattatgttatgactaaagagtgacttgtcactaaaattgtcaacatgcattattgaatgttgtgtgctgttcatatggataaaaatgtcatgatctggatagatgtgtgggcacgttggactatgaagtaacctggccgttgttgtttcagaatcttagattgtcatatttatgtatttaactgttagtccttcagagagtttgataagtaacgtgaagggatagataccacaaatttgtagtagtttaacaagtttgtattagtttagctatatagggttttgtttttttgttgttgtcatatattgtttgttggaataaaaaatgttttatttaggtatgaattacttggaataaagtttaccaatttaaaatgtataattgatgaattttgacaggtatttaaaccatgatcagaatcatgatacagaacatattcgttacttaaaaagttttcttgtgtccatttgcagtcaagccccttcccttgccctgatctctgaaagtactaatctccttgctgctcctagtttagcatcttctgtaattttaaaataaattgactcatactatgggtagtcttttgtgtctgacctctttcatttaacataatggtttgagcttcatccatattcatgtttcactagtttcattttattggcatgtattttattttattgctgagaatagtatttattgtatgactgtttcacggtttgtttattcattaggtgatggtcatttgggtttttccatcgtttggcttttatgcatcacttctgtgaccattcacacacacctttttggcaatgcataattttatttctctcaggtaaatagtcagaagtagaattactggttttatcctgtgtgtttagttttgtaagaaactgccaactgttttcggtatcattttgcattcccactagcaacggatgagagtttcaggcgttccacatgcttaccaacacttgataatatgaggtttaaaaattgtaggcatcctaatggatacaaagtcatatttcattgtagttttagtttacatttcatatgtgtcacctgtatatctgttttgatgacttgtttatttgaattttttcccaatgtttttcttagaatctcatctcattgagttgtaaggttttttttttgtttttttttatattcttgatacaagacttttatctgttatacttggtaagttttcttccactaaatggcctgtcatttttctgccttataatttgttttgaagaacaaaagttttttatgtgaagactgattttttaaaaatttacatattgtttcttttttttattatactttaagttctagggtacgtgtgcacaatgtgcaggtttgttacgtatgtatacatgtatgaagactgatttatcatttttttttccttttatggtttgtacctttttgtgaattttagaaattttgttttaccccacagtcagaaagattttctcctgttttctaatacttttgtagtttttatatcttatatttaggactctgaagtattctgagttaatttttatatatgttgtgaaagagaataaaaaatatatttggtctttgcccttgttcttggtacagagctcttaaaaccctgggagtttcctgaatggtccaagtgctttttgttgtgtaatgagatgaccctagatagcttcaggatgggggggcagcttgtcagaaaaagcagccatgggttagaggattagaacttttagcaccctctccccccagaggggaaaggggccagagattcagctcagttaccagtggccagtgatttagtcattcatgtctccctatggaggtaatgaaacctccataaagacccttaaacagcggggttcagagccaggcacggtggctcatgcctgtaattctgccactttgggaggctgaggcaggtggatggcttgagtttgagaccagcctgggtaacatggcaaaaccccatctctaccaaaacaaacaaacaaacaaacaaacaaaaaaccctcttaactgggtgtggtggcacattcctgtaatcccagctacttgagggggctgaggtgcaaggattgcttgagcctgagattttgaggctgcagtgagctgtgattgtgccactgtgctccagcgtgggtgacaaagtgagaccctgtctcaaaaaaacaaaacaaaaaatggggctcagggagcttctaggttggtgaacacattgattttctaggaggttggcactcctaaagagggcatggaagctctgtactccctcttcccataccttgccctatgcatctgttccattggtctgttcctgagttgcatatagtaaataaagtgttttttttttttttttaaattctgagtcattctagtgaattaagtaacctgaggagtttaggggaatccccaaatctatagctggttgtttcagacatatgggttgcccctgggacttgtgagttgcatctgaagtgagggcagccttgtgggaccccttaacttgtgggatcccactaattttggatggtggcagaatttaactgaattgttggatacccgcttgatgttgaagaattggtgtggaaaccctcagacatttggtgtcagaagtggtgttagaaaaaaagacgtcataattggtctcaggaatgggatttgctagagcatctcacgaaactcaggaaagtgctttatttactattaccagtttattataaaagagaaaactgaggaacagtcaagtggaggaggtacttagagcaaagttagggtggagggttgcagagcttccataccctctccaggtgtgccacttacccagcacatccatgtgttcactaacctgggagctccctaagccctgtttcagggattttttatggaggcctctttacataatgattgattacatcattagccattggcgactgagctcaatctccagctcctctcactccctgaaggtgtgggtagggcactgaaagttctaaccctctgatcatggcttgatatttctggtgaccagcgcctgtcctggagctatctaggggccctctaagagtcagttcattagcataaactcaggtttggttgagaagggcatgttaggaataacaaaagacactctgtcactcaggaaattctgagggttttaggagctttgggccaggaacctggaataaaaacgacgaagtattttttttatacacaggtggctttttttggggtttttgttttgttgcattttcaattctcccagcaccatttgtcagaccaacttttcccccattacattattttgggacctgtctaaaatatcagttgacagtatatgtgtgagttatgtcagggttctctgggtactttttttttttttttttttgcgatggagtctcactctgtcacccaggctggagtgcagtggcgtgatcttggctcactgcaagctccacctcttgggttcacaccattctcctgcctcagcctcccgagtagctgggactacaggggctcgccaccacgcccggctaattttttgtatttttagtagagacggggtttcaccgtattagccaggatggtctcgatctcctgatctcgtgatccacctgcctcggcctcccaaagtgctgggattacaggcgtgagccaccacgcctggccttctctgggtatttttaatgccaataccgcactgtctgttaccatgttcaggtcttagacatgtttggttaaatttatttctaagtttttcatatattttgatgttactgtaagtggcatttcttcttaattttactcccaattttttattactagtatattgctagtatattgatttttgtatattgtctttgtatcctgcaaccttgttaaatgcactttttacttctaggactcttttttgtagatactctggggttttctacaaaggtagtcaagtcatttgtgaataaagatagttttacttcttcctttcctatctgttcaccttttatttttttttatatatccattacattttcattatagagttgactaaaagcagtgtgagtgttcgtctttgtcttttctcaatcttatggggaaggcatccagtcttttactactaagtatgatgttagctgtagttttttcacagatgcagttcatcagggtgaaaagtttctttttatttgtagtttgctgaggcattttttttttttcatgaacatgtattgaattttgtcaaatctctttttggcatctattaagattctcatattatttttcagcctgtcaatatggtgaatgattgattgattatcaattattaacaattgtgtattcctggaacagacctctcgatcattaatcctttttatatactgctggatttgatttgcttaagttttttaggattttataacttttcataagggaaattggtttgccttcttttattgtaaggtctgtagttctggtatcaggatagtgctggtctcataaaatgaattgggaaatgttccttccttctatttccctgaacaagtttgcatagttgttattatttcttacttaattgtttggtaaaattcaccaacgaagtcatttggtctaggaagtttctttgtgggaagatttgtaactatgaatttgatatctttaataaatacagggctacttgagtttcttctgtttgaaaagtcaaattctgtaacatattcgaagagatttattctgagccaaatatgagtgaccagccccaggagatcatgagaatgtgtgcccaaggtgttcagtctacagcttggttttatacattttagggagacataagacatcaatcaatacatgtaagatgtacgttggttcagtctggacaggtgggacaactggaagcagtgagggatagggggccttccaggttataggtagattcagtgatgttctgattggcaattggttgaaagaatttatctaaagacctggaatcagtgaaaggcagtgtcttagttgtggagaccaaggttcttattatgcaaatgaagccttcaggtgggaagcttcagagaaaatagattgtaaatgtttcttgtcagacttaaagggcctgttctgtcagtcttcaggtcctgtgttgatgttaatgctggtcatctgtgcctgaattccaacgggaggagagtataatgaagaatgtcctactcccactcccactttccatcatggcctgaactagtttctcaggttagctttggattgcccttggtggaggggagggtccatcagtcagttggcgaactcagaattttatttttggtttacatttctttttgagtgagttttggtaatttgtgtcttttaagttgagtgagttttggtaatttgtgttttatctaagttttcaagttaattgccataaaattgttcatattattccttatccttttactacattgaatctataatgatatctgattgattatttatttatttattttgagacagggtcttgctctgtcacccaggctggagtgcagcagtgtaatctcagctcactgcaacctccgcctcccgagtagctgggattacaggcatgcaccaccacacctggctaatttttgtatttttagtagagatggggtttcaccatgttggccaggctggtctcggactcctggcctcaaggccgcctgcctcagcctcccaaagtgttgggattataggtgtgagccactgtgcctggccgatgtctgattatttatttttgatattgatacattgtgtcttttttcttaaatactagcaaaacattagtcacttttgtttatcttttcaaataagtggcttttggtttcctttattttgcttttctttctattcattgatttcttcattattttcttctctctgtttgcctcgggtttaatttactcttatttctagcttcctaaggtggaagtttagataactgatttgaggcccttcttttcttatagttgacccttgagcaacatgagaggttaggagagatgacacctccacctgcacccctgctcccacccctcacagttgaaaatcctcctataacttgacttctcaaaaactgaactactaatagtctactgttgactggaggcctcactggtaacataaagggttgagtaacaaacattttgtatgttatatgtattatatgctttattcttacagtaaagtaagctaaagaaaagaaaatgttactaagaaaaccataaggaagagaaaatacatttactatcaagtggaagtgggtcatcacacaggttatccttgtcatcttcatgttgagtaggttaaggagaaagaggaggggttgtcttgctgtctcaaaggggtggcagaggtggaagaaaatctgtgtacaaatagacctgatgttgttcaaaggtcagctgcacttaaattttaatgttttcatttgagcacgtcagagatgccgttaaaaatgactcagagtactcgtgccctttctgtgtaagtaatgattgattggttgttgctaattcatttctgactctaattccattttttaaaaagcctacctgttaatattttaggatctgtagagattttaaggaatatgaaatatatattagaataaactgctgactaatctgcttccattcttgccctttccccacacagcaggccaagtgatcttaaaaaagttaatggatcacatcactctgctatttcagacactgttcagaataaaagtgtgtgggaggcagaaatgaccaccaaagtgtcccacgtcctaatgctggaaccttacatggaaacaggaacttcgcagatgtgaggaaggtcaacatcttacgatggggagattttcctgatgtatccactgggcccaatgtaaagacaagggttcatacaagagggaggcaggaggactctgagcaggagaaatgacaacaggaagcagaagttggagagaagcaaggaaggggccatgagccaaggaatgtggacagcccctagaagctgggaaaggcaagggagctcatcttccctagtgcctccagaaggaatgcagccttgccaacccattttagacttctgacctagaattgtcaggtaatccctttaagcttgtagttatttgtccagcagcaccaggaaactgataccaagtgtgtcaggtctcgcctactctggccacattgccttttcccaccaatttcccactgcctttcttactctctctgcttgacaaagctcattcttctctccaactcgttgtgctcagtgttctctttgtgttcagaaaggcctctgctctaatgtcatcttaaatagctgttccctcatcacttaaaccaaagcaggtctccctgcttcccccagcctccatcacatttttctattttagcttcatctctgaacgtttctgttcttgaatttattttttacttattgattatcagtcagcctcccccgcagataagctcctttcgttggcattaggacagaggcctattgccagaacagtgcctggcccatagaaggcacttagcaaatagttcatgggatgactgtgaaccattttggttgttgaggaagtaacattggcaaaatgtcatggttaaataaaacaagctttgatacagagcatgcgtaggtggcttgtgtggttaagaagagtgatttgttcttgagatattgtcagtcttataaatagaaggttgtatctagggtaccagtaaatttaaccagtggagattaaaacattagctttatgacttaccgttaaacctgtttcaaagatatggctttgatgtgttcccagatggacttcaagttctctctcccacctgctaccacaagggatgtcttggaggagcacagctgcctctgttggggtgagcagagaatgggccccccctagtgggtgggcagctggtcagagagcctaggtggttctctcagtcccctttctccaaggctgcccagttatgtggtgaggtgagcattgtgggcagtgggaggctggaaggggtccttcctgcaggagacccctcttgcatgaggccaggggagtggaattcagctctagaactttggtcagcttgagtagagctccggcagttagaaagggagacttcaaaagttagaaaaaattagatttttgtcagtctgcttctggaaattgatactcagtagtagtttgccttctcagggctttctctgggaactggcattagtctagactgaggttagtaaattttgtgtgtaaaaggccagatattttaggctttgtgtgcctcttaacaatttttgtcacatattctttgttttatctttacaacccttagaaaagatgtaaaagctgggtgcagactggcctgcaggctgttttttgctgtcttctggttcacactccagttttctctgtttgttccagctggaggagcaggggtcagttacactgggctttgcaggaagaagctggagaggcttggccatggaggctgtttttcttgacataaaaataaaaatgttcattttttcttgtgtgcttggtgagtgatctggaaacagttgtacaactcatagtttgagaagtattttgttcagtgatagtgtcatttgggtgaatgctagatttgaaggccagcaccaattaggatgatcttgaggtttatggttcttaaaaactccctgagttgaagtttcatttgaataatgtattgcttttcggggtaaaataaggttgaaagagatggaggtagtcaatatttttacattctctaaagaaaaaggcaacatgattaataccagtattatttactcattaaattttatattaatggatattatgtttgttacctttttgtgactgtaaacatttggtaattttttttctttagaattatgtgaaataactgtcaattggttttgttttgtgacagataggacacatgcctattaggtatctttcttattcagtgtggttttgctgcagaaggtagttactgtcctggaggatcagtccagctggacataggtgttgacaagttctctctattcctgctggtcatagcgtgaatgcctttcagctcagtgtaatctctaggatttgttcatttcatagctccctggttgttttttctttctctagtaattttctatgaattgggagtttactgttcagcctaagcattagggaaccctagtgcattttactggagctcttcctctgagaggttaccccacctttccatttatctgccctgtaaattccagccacctcagcctccctgcacgctgatctcgatcagcaagaccacagtgctttgttggggtacccctgccttctaccagtctgtcaggtgtcttcaggaagaaaacagggacagtcacaggatcccagatggtagtcttttactgcctgttgatcaatagctgagccatttcatatattttgagggaggggatccagtaccagttactccattgcagccacaggtgcaagttcttagttcctattagtggggaatggtattgaagaaccaagatctgggtacaacatgtgctcactgttacatgggtgtctttgcttctcaagacagacctaagaaataagtagataaattacattacatattcacacacacatgtttacaaccatttctgtacttacatgttgaaaaccatgagtttatattgttacctccatttccagtttatcaccacagggttcattgttaccttctccctttccatatttgtagtacctgcagtatattgactcatttgctcaatcctgtaacttactgaaagtaatttcagagttgctgatccataccactgtggtaaacataccttttatccagagcttattacctattgacagtacagtccctcacttaatgatggtttgacttagcgatttttcaatttacgatggtgcaaaagtgatacgcattcagtagaaattgtaaccccattttaagttgaggagcatctgtaaaatgcattttccagttgtgatattttcaacatcccatgagtttattgggatataaccccattgcaagtcaaggagtagctgtactttatatctttggactgaaggtatgtaatactgtaatatacaatactaaacatattgtgtgaagagttacttaggttatttctttattgtggttgtgttttattcattagaggtaatgttaggtttcctcactcctatttattttattttgatatatgaaatattaatatggtttcagaagtctaaactattcaaagagatataatcatagaagtgtcagtacccacttcctccctctaatctcttccctccagttcccacccttgagggtgttagtgagtctcattagtttctagattatccttcatgtttctgtctgcaaaattaaggctatacctatttgttcaactatttccaatctttcttatgctagtagcattttatatatattcttgcacttgagtttttgcagttaacaatacctcttcccagcactttgggaggcccaggtgggtggatcacctgaggtcaggagttcgagaccagcctggccaacatgatgaaacctcatctctactaaaaatacaaaaattagcagggcgtggtggtgggcacctgtaatctcagctactcgggaggctgaggcaggagaattgctggaacctgggaggtggatgttgcagtgagccgagatcgcgccattgcgctccagcctaggccaacaacagcgagactctgtccccctgccaaaaaaaaagtacctcctagaaatcagtctctgttagttcattaaaatgtagtgatggctggaagtgtatgagggatctatgagactttttcaggatggaggtgttactatagtttgcatgctgatgaaactaatctgatcctattgaagagggagaggtgtcatcacgtttcagaaagaagcctcgaagtaggccttcaagaggggctgagacgctggacagaaatggagggttttggttttggttagtgaaaggacacttcactttgaggaaaagtgacatctgatttattagagccttgaattctaatagaaatcctgtggcagaatagtccttttcatcaaatgggcaggtaaaattttactggttgagtttccaagatagaaattttttatttaattggagtaaaaggtgggtgcaggttctggatgaggatataagtgaaagcacttacaagttggtattcttattgaggatctagtgctctagaagctctgacagtagtcatgttataccaagaaggtcatgctccttaatctcacttgatcctctccagacattacctagaaactttctgtaatcattagagctaattttatatctccaccaatcaattccttcccttgagaacagatgtggactgaagcagaaccaatttgtaatcatttctaatatgtcatctagttagataatgagctctcacctccatctaacaaagcattttcacaaattgacttaaactataagcctgttaggattgcctgaatccagtcattttgaatttttctgaaattcctgtagtttactctgtttgccagctttatatatgggttggtggcctaaaacttcagttctgggccccatatccatgcatgactttcttgaaagaaagagaatactctgctgcaatccaagctggagcccttcaattgagcttgatttgattgcttaggggagtggaccatgctggttagctcaaactaaccatagtccactcctggatgtgggggtagattcatcttcttccaaagtatatggactgtggggagttgggagggcaccagaacaaaaggctgccatcaggaaataggaggaggtaagttggagaggatgttaaggtaaatggttagtattcatacctcttaagcatttttactgtaactcttcatcagatctcaactacaaagaaaacacatgaatttcattaattaattcatgtatttaatattttttagagagagcctgccatgtgtcaggtactgttgaggatatagcagtaaataacagagaaataatctctgctctgtgggcagtggggagggaccatcccattttgccaagaggatgtgcgatagtattgttggatctcatatgatgtttatatgtgaacatttacttgatacagcttgtaaatgatgtgttgaaggcccttgtgtatacaaaggtgataagaaggaaatagatggcatagaaatgaaaacaagtcattggcttgatcattctgactgatgtttataaatctaaaaatgaaagtatattgcaattagggagcaaagaatatggctgtcctctttaaattaagagccatcagtgttttcaaaaacattgcatttctacagtgcaagtccaagaagaaccagaagtagtgatagtaatgatgatctgctagagatgtatttgaaacctagattcagcttttataaacctgtgcaatccaggttcatttcttttttctttctttttttttttttctttttctggagaccgagtctgtgtgatggaggttcatttcttttttttttttggagaccgagtcttgctctgtcacccaggctggagtgcagtacagtggtgcaatcacggctcactgcaacctccgcatcccaggttcaagtgattctcgtgcctcagcctcctgagtagctaggtttacaggtgtgcaccatcacgcccagcttatttttgtgtttttagtagagacagggttttgccatgttagccagactggtctcaaactcgtggcctcaagtgattcacccgccttggcctcccaaagtgttgggagtaggcatgagccaccatgcctggccaatccaggtttatttctgtctgttaacaatttcgttcaaatgatgtagcctttttcagatgtgtttgtgtatgtatgtgagtatatatttgtatatttataatatgtatgtgtttgtatgtatgtgtgtgtatatacatatatatgcatatgccaggaaaatataaaatagcaacgtgggttttttatgtttaaatttttactaaaatttctaataaagttgttttttcactattatttttctttaaattgtttgtaaattgacctaaatatgaaataaagatctaaggagtccattggccccagctgatagagtgttggttacttttcctggtctactgagggttaatgtaatatacctttgtggacattcatccacagtggttgatggctaggcattcgtttcaggcacacatggactatttatgaaaattagccatctgctaggccataaaacctccacagatttcagaggacagctatcatcagaccacattctgtcaccacaggcagttgttagaagtcattaacaaaaaacgtaattagaaaaagtcccctacattgggaaatttaagataacttctaaataacttacagctcagcaaatgaatcttaatggaaattagaaagcattcagaactaaatgctaacaaaaaatactttaaaaattgtataagatagctaaggttggacttcaggaaagaaaaaaggctgaaaatgaataaactaagcatgtaccttaagtgaaaaaataactgcagaataacccaaatagggtagatgaaaggaaatgaagtgagcataaactaatgacatggaaaacacattaagtagtaaggataatagagcctagagctgcttctttgaaaagccaaatagtcagacttttggcaagattaattgtgagtgagggaaaaaatacacaatattcagattggaaaagggagccatagatataaattccacagagattaaactggtaagataatgttaagaatgtgcaataaagtcaagattttaggtggaatagataaattactagaaaataaaaattaaccaaaactgacttaagaaatagaaaactagtaataccagagcaatgtggaaattgaagcatcagttaaagatctttccacacagaaagcaccgggccacaatgacttcagaagaatgttacatttacacctaagcattcatggagcagataattccagtctttatatactctttgagaaaatagaaaaagagagtcttttccagctcattttatgaagctagggtacccctgacaaccaccacgtaagagcagcgggaaagaaaaacagactagtttcctggtcctagttggagatattccaggactcaggagaatccccgctttatccagatttgcttgcaggttaagatgtggatttagccacatggaaatcattggttatcttgacctgattatttggctttattggagagaataaaagcctgtttggagtgggatcaagagaccagggtgtgttttttccccggccaaaaaaaaaatttttttttgggggggggcccccccaaaggtcccccccaaaacggccaagttgggttacaaaaattggaacgattgaaatcatgactttaatcactgcgtaataaccccctacaattttgtgaagcatttcatcttttacttctgagaaaaatgcaacttaaaattaccatttctcattcactagattgccacaatttaataagtgtattagggttctccagataaatagtatcaatagaaatataaaagatttattgtgaggaattggctcacgggattatggaactgaaatgtcccacagtctacatctgcaagctggagacccaggaaagctggtggtgtaattcagtctgcgtccaaaggcctgagattcatgggagccagtgtaaatctagtccaagggcaggggaagatgagatgagatgtcccaactctagcagtggggcggaaaatagaggccagttccttcctccttcaccttttgttctattgaggccctcagggaattggatgatggctacccacatgggaagggctgcttctttgcagttcacgaattcaaatgctagtcatccagaaggacccttactgacgtaccaagaaactgtattttatctgggcaccctgtggcccagacaagtagacacataaagtgagtcatcacagcaagtatgacaatgccgtgtactggaggcagtgtgtggatgtgcagccactttgcattccatatgacctggcaactgacttctgactgatgtgacttaaaaacagagatcccctggctggggctgggatgtttctaggcctcaggaggtgcacacatctgtctaatacataaagggtctgtctaatacataacgtgtaccctgtcataaaactcttcaggctgaactggaggttccagttctctttctcttcatagttgcctcttccacaatggaaagttattcctgatctttgctttgttgctacagggaggggaaaaaagcctatgaattgccaaaaaagaggcctttaaaatattaatgttgagaatttcagctgagattcttattctggcagtttctggttctttgctttcaacatagtttgaagacagtttactagaattgttgggaacttgttagatgtttcttgattacgatgtgattttttcaccagagtgctaaaggaatgacattgctgtagtaaacatcttccttgtttatgtgaaaaggttttctcagcatgagtaaaattgatggtaaatcctgcctcactctagcagtaaataatactcattcatgaatatatgaaataatgagaggagggaaggtagtcccatctatctcattgtgatgcatgtctaataaaagtttatatttagtatttaatagttatcaaatttgaaatatatttttgcttttgtcagttctgtgctaataatacttgtaatgaaaattcaatccagaagaaaacttttaaacttggcactttatagggaatttaataaaaattaatttaatttgcatacacattttgttgcaaagaaatgtgacagaatgacaaataaaatattttaaagcacaaataccagttatatcaggaaaaaaaaaattgaaagcagagcaaaaataccagttaatgaagaaaggagataatgtaacattttttatattgagaaataaaaatgaaatgctaagccaactgacttggacaactgtgacctccttttggccgaggaaaatctcagccatgacaggatgggaggtcggacatctcttgtaataccccctccctggagaactgccattaggctttctttcctgaaggttaaacaaaccagccctttggaaagacttgctccactgctgatatctactgcctggtgctgcccctgccttttgtagttttaactgcttaccagcgttctttcctgataagagagcgagaaccgcagagtggttctgggaggtctacgaaggatgcacagtgagggtttttgtgtcctctgcttcacctttgacagcagagggctgaaaactctgccctcgggccatgctcacgcccccattttttgtacatgacccatgaaagtgcatgaagctcaattgtgcgcacgcatttctccttttataatattcatgactcttagaacttgttaaatatgtatattcagccacctcgttcatcataaattccacttccctttgcctttcccttgaagtgtctgtttctggcttctggccaaaagctgtgctccccagcctgtcagtatggcacaagccgcaaccatttatgagaaataaaactctcctttccaagtttatgaacctcctcattcttcagtttacactttttaaggataggtttgtttgtatgttttatttatttttttgagacagtcttgctctgttgcccaggctggagtgcagtggtgcgattttggctcactgcaacttccacctcctggattcaagtgattttcctgcctcagcctcccaagtagccgagattacaggcacccgccaccactcctggctaatttttgtgtttttagtagagtcggggtgtcgccattttggccaggctggtcttgaattcctgacctcaagtgatctgcctgcctcagcctcctacagtgctgtgattccaggcgtgagccaccgcgcccagcttgttttaaatgcggtatgttttaatgcggatgattttgagaaccaaatcactgatagtgtaggttccactggattcattgaaaatggcatatgagttttgtttaaaaatgtgagtgttcatagtacattgaaatctttcaaactacttaaacttagatgaaaaatttcaaatgtcagcataaaaatgttcaaaggagcacatacttcaaaattcttttagcaataataggaacaaaaaggttgaagatcactggcttaaagcattagatctcaaggggacgttaacacccactgtggagccttttggaatttgagggacgtttttggctgttgaagagctttattgacatatggttagtgggggccaaggaagctagacatcatgcagtgcataacagagaatagtgtgttttcccataacttctctaaagttcattggagtagtttactgcaaatataagtatagaaatttaatacatactaatcctaaagaatatttaaaagaaggaatttattaaaacactgaaattttaggagagggccattatagtgggtggtgtttaaaatatatgttttctcaaaattgttaaataatgtatcaattccatgcgttgtctacttagtgtattatacatttccaactatatatttaaatgaaaagagtttgcagtagataatgcaaaagcaatacaagttattactggcaagttacatacaaatatgtaacaggagatataaagttcatttaaaatgtctgagaaccaggtattaaattattagatacacttgaaatacaaggaacatatgaaatcttattgaatcttattatactttctcttagaataatctctcctcagataaacctcattggctatgatactgccattcacaaagcttattatacattctcaaatagaatggtatttatgacatcgaatattgtgacatggtcaccacctttaatacccgtctgtactttcttcacctttttctccaaaacatttatccccttctatgtagattactaatttgttatgtttattttttactctttttgtctcccttgcttggagacagtataggaggagagcatgggaggcaggtcttctgaagagtttggcgtaaaaaggaggaaaaaattggcagctggagggggtagggcgtatggaatcaggaaacttaaaaaaaattttaactgaagtataatgtggacatacagaaaattgcacaaattaaaagcacataattctgtaaatttctacaaaatgaagtcccagcacaccacagtcgtcccacatgtcccttccttatcattacccatctcccacccaaaagacataggcaattattatgacttttatcgccaaatactaatattgcctattttcaaactttatgtagttggaattttgcaggctgatctcttccattgaacatatttgcaggattcagcctgtaccattcgtctaggagtagtgcagtcctgttccttgtagaaatatttcataatttgtgtcttctactgtttgcttgttgtttgaggtgttcccagcttttagctgtttctaatagtgctgccctgactatgcttgtacatgtcttttagtacacatcatgcattttttgttgagtgtgtatatttggagtggaattgctttccaaaatgattgtactggttttactcctagcagtcttaagtcagaggtctcattgctttacaccttcaccaatactttatgcggtatcttgactgttgttggcactttgcattttcatcttattaattttcagaaaaattgggatttttattggaacaacatttaatctattaatttggagagaatttacatcttttagtatgaactattctaacacatgaatgtaatgtgttcttttatttggggcttctttatttcagtaagatttttcagtttttgtgtcaaggtcttatgttccttttgttagatttattctttcactccttgatttttggatgttttgaaagtgatatcttttcgagatttcacattcaaatttcttttgctagtatatagaaatacagttgatttttgtatattgagcttatatccagcaaccttactaaatttacttattttcatggtttgaaaattctttaggctattcttcatatacagttatctgctaataatgactgttttattatacctttcaatccttgtaagttttattttggtcttatcacactcgctagtacatctgttacagtgtttaaaagtgttagggaacacccttgtctcttttcttggtccctgggaggaagcttttagtaattgactgttaaagattatgttagctataggtactttacagttactttttattataaagattcccttttcttcctaatttgctaagataatttaatcaggaatgagtgttgatttttagatattaccagaaaagcacaactgataaaaatttataattttgattaattttaatcaaaattaaaatttgtgcttcaaaaatcaccaagaaagtgaaaggcaagacacaaaaatgaagaaaatatttgtaaatcatatattttagaaagggcttgtatctaagttataacttacaactcaataaggagaaaacaaattacctgattttaaaaaaatgagcaagatttgaatggacatttcactagagcagctgtttgaatggccagtaagcacatgaaaagtgtttaacctcattagtcattagggaaatgcaaattaaaatccttataggtaccacttcacactcactagaatgggtataataaaaaagacagacaattgttggtgactaggaaaacagagaccctcatgcattgctggtaggaatgtgaaatggtgcagccaacctaggcaaacagcttggcagggtttttgttttttttttttcttttctccaagttaaacaaaaatttacagtatgacctagcaattctactttgtctttatccaagacaaatgaaaacatttgtccaccaaaaacttgtaagtgaatgtccatatcagcattagtcatagtagccaaaaagtaggaatgatatgaatatctgtcatccgatgaagggataagcaaaacgtttatatgttcatacagtggaatacttcatgcttataacatgcatgaacctgaaaagcaagccatatgaaagaaaacagacaaaaaaagaccacatattgtatgaatttatttataggaaatgtccagaaaagaccaattcttaggaacatagattagtgattacatggtgctgggatggaaacagggagcaactgcatatgggcatgagagatctttttgtgataatggaggtgttctaagatcagattgaggtgatggttgtacaactctgtaaatttagtaaaaatccttgaattctatacttaaagtggctgaactctattttatgtaaattattcttcagtgaagatgttaaggaatgaatattgaattttatcaaatactttttctgtaactaatgaaaatgtatacgattttcacctttatttcattaatttggtgagtccctttagtgggctctcttgttggtagttcctttttctccgagatcttggcctcaaagttctggctgagcctgtagtcttcactgccagtgtttgtctccccacttccaggagattacagagatttctgagctgctgcttcgtgctacggcttttataccctctttacccgaccagtttataactcagtgtatgttttgggaggaaagcagaggcttaccatagtttcccttctctggctttccagcctcttacatcctggctgccttagttgctcaagcagctgtcttacatattttctgcagtatttcatggaggaattggtctgatgatgacctattccatcatagctaacagtggaagtctatgtgagttttttttaagatgtcagtattacagcattgctatatgctgatgggaacgaacctctaaggaggggtagtattgatgccagccaaggagagcgcgtaagtgctggagtgagtgatgtccccaaggagattagaaggggttgaatccagtgcacaaggggatggattggcctccctcatgatgttacaggattccttcagtgccactttgccagccagaaatctttgctgcccctgccacctctgtctgggccttgcttgggccccctggccttactccaccctcttggcctggcaggttgtgcttggttcgcgcccacttgaatcccgtgcctgctgcacctccacactcagcttgaggctggactgggcatgccatgaatgacttccatgtcaggcaccggtgtctagacaaggggaatgtggtgtcacccaaaaactcagagataaaaccagcattcatggagccccaagcagtgttacaactcttgctcggggagtcctgaggtctgggaccccagaaatgttgcagctcttcactcccatagcttggctagcgggagcatgttacagctcttttattcccgttgcacgcagcttggcgagccggccaggggcatcacagccctttcattcctgtcgcctgcagctcagcgagttccaggtccttgtcccgcgaccaagaggaatgaggtgcgtggacaccagagagtgagtaaggcagagaagaattttattgagtgacataaggaaagctctcagctgtgagaggggacccaaagtgggtagccacctgagagggtgagtctggggtttttatgggttagaatggaggtgtgtgtgctgattcatccctgggtgggcttggaaaaatcactgtttgattggttaaaaggcatcatccagaaggaaccaatcaagagagtgagggtaatatggggatagaagttctctctctgtttatggactctctcaaaccagcagctcggtttttagactttaaactgtcagtggcttgaaggttgggtttcactggggacacatccctgtctgctggggaatttgtctgtcttctgtcactctcaatgagttagttcattcatggtaacaggaggcagggcggagtatataggttcaagtcctggatggatagctttggtggtaagtactggtagaatgtcttttctggcttttcgtaggattgataggaggttttaagattcgtggagagggaagttgtgaagtggtctatatgtgagtaggagagtgaatgaactcaggaaatacagtaggattgctgggcagcagaatggcccacttgagatgagtggtcataaatgtaaaatatttaaatttatgaagtaatggaactgagaaatactgggcctcaaagaacagtttggcaccaagttaagccagttatttgtttttggttctgccaacatttttctttgttacatattaattcttcatggaaaaattaattacaaagacatgtatcaggcattccaaaacatttaaagacttgcatatttagcacccaccacccaacctaagcaatacaatattacaaataaaattgaagtcctctgtgtacccattgccagtcatactccagcccccataaccaccaattgaatttatcatttctgtgtgttttatatccctgaatagcattattgtttttaaaatttgtgttcattatcctgtgtatctttctgtaattaatactttttcaataatattattcattggatttatctgtatttactcttaattctttcaccttcatgcttatacaggtaacattctatttataattatgtccttgttttattaattctcctatggatggatatttaggttatatccatttttttgctagtctttgtatgctcccttgaattttattgtacatattttcttgggtatttgagagattttctagggtatacatatctaagatctgatggatgctgggatatgtgctttgtcaactgaggttctcactcccctggaagtgtgtgagatcagaatgcccctgccctagcccttacttatattatgtatcagcatgattgatttgtaatagactaataagggtaaatagctgagtgtatgccttctatactgtaattttactttgttgttcgtctgtttgtttaattggggacccatcttttttcagattgttaattttgctaaagatcttctttgttctcagagttaattatcccttaaggaattccatgtgtttatttttctctgttccaaagttacgattctgtgctaaagtcataattatgaaatcatcagtttgttcatactttaaatctatgcttctcccttgtggttgacagtccccaaggcaggcatccatgaagtcaaaaggactgaccaaagtgtaatctgccctttttactgggttggcatttgtgctaatacactgcaaaagcagtggtggataaactgacagcaccttgcaaagcagcaaggtggtgtcaccaatttgtcattatttatgttaacattaatgggttcatttgtatttttaaatgaataaacatttaaacaatttcttagttttgatttctaatagagtaactatagatcagtagatgccaactatagtgtcttcctttaagagcgtgaaggggcctgagactggaaagctggagaagcaccgctttaagcacatggtagacgtatgaatagacaaatactttattcttgttgaacatggtcattgggaaggaaaactgaggtaatgtcattctattaaaagatgaattaggctgatcttgaagttgtatactaatcttaagtaaattttcaattctttgccttaaaattttgtttacaactagattatatttgtaaataaaatactttgcaggtgctgaccttaaggaaagagccaaaatgagttccagtgaagttggtccttttgtctccaaaataagagcagtgattaacgatattggtaagcactattaagttcttctttcagcatgccgaaggggttcttaaatgtcacatttaaaaagttacacattatatataagcattggttaaatatttatataattagataatcatgacctatagctgtttaacgtgacacttaatatatttaatttgaaaaattatgtaaaatatttaataattacagatgtcttatgtatgataaaatatgaaggtatttatttattagacaacaataataatttgccataagcctttgacttacaatatctatatttaactatatacatgcaaacatacgtttgggattcctttgttttttaaatatacaggatcatacttttttaagacttacagtaactatcaatttattttatttttaatttactgctgtatattaatccagtcttatccaaaattttatattatttcttcattaatgaacatttttttcctctgtttatgttatttataataaggtagtgaatacccttgtacataagcatagattcttaaacagggaatcgctgttccagttatcatttgttcattttatattttagtattaataaattctacaaaattatattcccatcggttaaagacagtatatgtttcctcacattcctgccagcatataatgttgctatttttgaagtttgcctaggttaaaaaaaaaaaaactcaacattttaatttgtattgccccaaatgcttatgtgatgttttatcttttcaaatgagatttggctttctttttttttttttatttggttttagtttttttttttttttaatttttgattttttctagagacagggtctcactttatcacccaggctggaatgcagtggcatgataatagctcactgtaacctccaactcctgggctcaagagatcctcctgcctcagcctcctaagtggttaggactacaggtgtgaaccatcaggcctggctgatttttaattttcttgtagagatgggggtctcactgtgatgccctggctgatcttgaactcctgcctcaagcgatcctcctccctcgtcttcccacagtgttgggattacatgcatgagccacattactcagccttttcttcatttgtaaattgcctttcacatcttcatcctccttttataggattatttaataactacttgtttatttaaaaggcatttttatattctttgtgtttaaatgtgttatagatattgtcctctaatgtgcttaatttgattccagtatctttaaatttaaaacttttaatatctagatgatgctaggttctctttattattctttttccttgaaggttttctctgttgattctcgcacatcagtttttccaaatgaatttagaattatttttttaaggcaaagaggaaaaatttctgtattgcaactgtgattggaattttataaattttgttaagaaaattttgacatttttatgatagtaaatctttctatccatagtgtgcatggctcgtattttctggggtcattcatttttttaatgtctttcaaggaagttttatacttttcttggtcttatatctttttttccccctcaaatatattcctagctattttatagcatttattcctttgaatgagaccctccccttgttttcgttgtagtcttgttattatagtctgtaggaaagttattaagtttttttttttttttgagccggagtctcgctctatcaccaggctggagtgcagtggcacgatctcagctcactgcaacctccgcatcccaggttcaagcaattctcctgcctcagcctctcaagtagctgagactacaggcacgtatgaccatgcccagctaatttttgtatttttagtagagatggggtttcaccatgttggccaggatggtcttgatctcttgacctcgtgatccacctgccttagcctcccaaagtgctgggattacaggtgggagccaccacacctggccaaaagttaataacttttatgtgcttattttatatcatgtcagctggataattacttgtgttaattcttctttaattttcttgtgttttcagttgaaaagtacaatataggtaattacctataagtaatgcagtttttatctcctcccccaacattttaaccttacatattcatattttttcatattggttcaggccctcatagagtattcatttgttaaggtgagcgtgatcatccttatctttctttgactttggtgggtgcctttaatattttgccagtaattatgatattcaggcagttctcttctatttcaacttgttaggagattatttctgtttttaatcaagaataagtattaaagtttgtcaaatgcttttaaaatatgcatcgggattataattgatgtatgttagcgtttgccttatttagcctttattatactgagttgtgttaatagatttactaatgctgcggtggccatacattactagaataagctctgtctggtcattgtggttaggggtggtgttggtttttaaaatatattgctggattcaataaaatgcttttggtagaatcataaaggagattgagcttttaattttgttttgtgttattcttttttggtttggtgtgaaggttatttgtcttcatagaatgaggtgaaaagctttccatgtttttctatgctatatacagaacaaatcattttacttgaaagaattgtagaatttgaccatttgacacctttttgcatcttctgtggttttgttactgttttctcactttcttagaattaaaatttaaaaaatacgtgttttgatttctataatgtctttggcttagctgtctattctgcctcttctcattctgtgctggtattgttttaggccctgcttctctccccagcttcagcctcatgtttatgtaccttctgacacagagcatgaactttgtttagaagttggtcagagagcttgattttagaagtaaaagttgatgctacctgtaagtttatatatatgcaagggggtggctaagattggtttcattgttcaaattaccttgatgtttgttccagagtgtctttctgttctgtggattctgaaattgggatttttctggaactctttctgtctttgcaatgtcattttcttttttgtgattgtagctatagcttttcttttctgggctagttcttatctccattttttcttgggagttcctccatatttattaatgatactttttattataacattacagtagacttactgtgatgattccagacattttgaaggacatatggaaactaagtatcttaatagtatcttaatagaatccactcatttaatatgttaaaaatcacaggcaggcaggctttatcttgaagggtcatatagtaaatattgtaggttttatggtgccatatggtctctgttgcagctatacaactctgactttatagtatgaaagcaaccatagatgatgtatcaacaaatgtgtgtggctctgttccaatacagctttatttatgcatacccaaatttgaatttcatttgatttttatgcattttgaaacaattttttattttgatttttttccccaggcatttaaaaatgtaaaaaccattcttagctcacaggtttgtactaaaacaggcagtgggtctgatttttctttgaatgtcatttgtctcctatcttcatttttcctgttgtttggagttaattcctctatatttattcaagaaatctcacttcagttctaatttgaacaacttgatgcatgcttggcttatacctttgtcattgggttttgctttttggagtcataaagcttttaattttaaggtcttcgctttgatagggagtttaaaatattgcatctgggggttttgtattcttgataaaattcaaagaaaacaaaacaaaacagttcaagaaaaaacaaaacaaaaaccaaagataagttcatccaatcttaaaaaaatgtaaagagaaaaaatagcataaacttagaacatcttgaatagtaagatgttgaaataagtcaagtactcactattaatgttagttgattaaacttgcggtttaaagacatagatgttcagatttgactaaataattgacatcagctgaatattgttaaaaatagccacatctgggatacctctttttgtacctgaagattactagccaaaaaaagatatatcagtattgatattggtcaaaatacatttcaaaataaaaagcattactagagagagagttgctgcatgtgataaaagattcaatttttcaagaaacatacccttaaacttgtatgcacttaaaaacaaaagtctcaagatacacacataaaatgatatggataaattggtaatttgtcatcactgacaaaattatcaacccatctccctcaatttaccatgaggtcaaaaagacaaaagttaataaaaattttttagtgatttgaacaacataattatcaagtttggtttaatagactcaaccccaacttatgtattctcatgaacacaagaaatgtttaaagatatgggtcacgtgcaggaccctaaggtctctgttaaatttcagaaaattggtgtatagagaccatattttctgtccacggtggaattaagttatgttaaaagaaaaacttcagccaaattaagtttaaaggagtttaatagaccagtgaacgatttatgaatcgggcagtccccagaatcacagtacattcagagagactccagggatgccttgtggtcagaacaaatttatagacaaaaaagaaggaagtgacatacagaaatcagaagcgaggtgcagaaacagctggattggttacagctcagcgtttgtcttattttaacacagtttgaacactgggcagtgtatgagtggttgaagtatggctgctgggattggccaagcctcaggtactgtcacagggcatactcctaagttaggttttctgtcttttctacctattaagttaggttgcagttcatccacaagtatagaagtacagagtctttctaaggccgtatttagtttgctttaacagttagaaacaagatatgcatacgtacagattctaaaaccgtatatttgtaaactgagaatactgaacagctcatgggtcaaagaagaaactataatggaaaagaatactaaaactgaatgattatacaattaccatatgtccaaatatatgagatttgattaaagtggtactgttagctgtgatgtatccatgtcatgcagcacaagtatgttagcatcagtgaatctgtacaggtctgtagcaatctcagttcttgcctcctcagaagaaagaattcgacccaggggcataaggctggaggagacactggggcaagttttagagcaggagtgaaagtttgttaaagagctctagagcaggaaggagaggaacttgcacaaggatcaagtagacgacttgagagatcaggcgcaccgtttgaccttttgaattggggttttatatgttggcattcttctggggtcttctgttgcttctcctgtgattcttcccttggggtgggctgtctgcatgcgcagtggcctgccagcccttgggaggggctgcacgtgcagtgtgtttactaagttgcaggcctgcctacttgaggcaccttcccactttgcagccccgtgttcctagagggacgtcatccgccattttgcctcagtgctcatgctcaactgcacttgcccagctcctgagatcttatcaggaagctgctgatcaccagtttcaggtatttctatctggaaatacctgatatttcgaggagactgcctttctctggtgttggctgtgaccaattattattttagagagacagttaacagccgcctgacaattacatggtcacctgacattcctggtgtgtgtattttgtggggagccctttccaactctgctcgtgtctgattagctacctactgtaacagtacttgaggggaatttacaacattaaatccataagttagcaaggagatgtcattgatgataaatagctaagcattaccttaaaaagatttttaaaagttttaagttcaaagaatgttgaactaaagcaacaatacaaggaacagaaatgagtaaaatggaagacagagatgcagtgcctagggtcaacacaaggccgtgctctttacagtggagtaaaaagtgttttaacaatacgtattacaaatgaaaaaaaggtgtgattatagatacaggagagattataaagataataagaaaatactgggaaaaaactttatgccaataaatatgaaacttctgtctcaagaagaaatcatgggctggaatagtcatgtaaccaaaagagggtccaacttctcgccgcttgtagaaagaagccaaaataacaagagtgaggtatgataaagagtgtgaattttattaattgttgccagcaagggggaaagtggacagaatcctttcccaaaactgccactttccaatttctggagagtgcaggggtttaagaagagggatttggaatgcaggagaggcaagggggctgggaggtgcccaatggcatgacttgctcctatggcttatcctgaattattgttccatctggtgaaggggccagcaccatcttgggcccaaccatgccaaatcagtcgcagtcagtcttgctgtcagtctctagccgggagtaactctggccttgaagtaatatcctgctcgggagagaattctggaggtgcctggtttgcatcaggatttggcccctgaagcttctaaggaaacataggaccagataagtgagcatggtgtgagcttaacaaacatccaggtaaatacatgtgcatcaggcatgaaagcataaggtgggaaagggaggggagtggagttttaaagcacattccaaggctgtatttagagacaaaagaaaacacatctgtagtttgtctcaaagctgtgtcttgagactgggatgaaaagaggaaaggaaaaaaaatttctaaaagcagtttgaagctaagctgcttggttacagtcatataatcactgaagtgatcaaccaattcttatagtaaactttttcacagagaaagcaccagacccagttttttgatgatagagatttacttttaagatgttttacccaatgcataaggaacagattcttacaatcttatacagacagttccacaggatagtaaagtgagagtttactcctaactcattatttcagactagtgtaatctttatacctaaatccgagagaaacaatggaagaaaggaataggaggagacagcctcacttgtgagcatacatgaaatccagcagattgtaacaaaagaccaaattgggctttcccaggaaggcaatggtggtttccactggaaaatattaaattttaactcatgatgttagccaatgaaaataaagtcatatgtgtatctcagtagattgaggaaaaagcatttgagaaatatcaacatgtattcatggaaaatgttctcagcaaactaggaatagaaggaaacttccttagcctgacgaaaggtatctctttcttaacaataaaatattagaagtcatctcctaaaatcaggaacaaggcaagaggacccactgtcaccacctctgttctatattattctgtaaatcctggtttctgtagtaggcaggaaacaacaataaataaggaccgaaaaagaaataacagagtccttctcatgtggtatggctgtctccatcaaaaagctaaaagaaacaataaattattagaaataagagtgttgcaagatggctggaaatgagatccatattcagaataatcaattgcctttctttataccaacaacagacaaaagatgtcaagtaaggataccctggaaagtaggaacaaaaatgagtctaggactacatgtagcatatttggagaaattataaaactttattgtaacatgtttaaaaaaataaatggagacaaattatcctcttgaataggaagattgagtattaaaaagatgattctcacaaatggtgtaattcagtgtaattacacctagactctcagtattgattttgtgagggacttgatgagcaaaaagagacccccaaatagccaaacactcataaagaagaaaatgaagcgtcttgccatttcagcactcaagatttattataatgacatagaaatgaagacggtgtattattcgctttcggatagataagtataccattgggttgaaatatagaacccccaaaagaccacccaagtggggaagttgatatgtgacagaggtggcattgcagatcgctggggaatggcaaagacttaatatgtttagaagtggaaactaaaacttcaatgatcttaacagagagaagagtttcttaaaacataaaatatgacacataaaagaaaacagtgatcaattttaccaaattaaacttaagaacatcaattcatgaaaacatactataaataaagtagaaagaaaagacacagactgggagacaatatttgaaacacatagtggccaaagattcttgtatgcattgataagtacatacaggaatcaatacatgcatacatatgtacagccttgaagtcagcaagaggacatgacagaaaaacatttcacacagaggtagaggagtgagggtagacataggaaaagatggtcagccacagtagtagtcatagacctgcaattaagaccacagtgggatgccattttacatccaccagattagccaaaaattcttaagccaggtcttactaagagttagtgagttaagtggattaccaggcaggaagatttatacttctaatgggagctgaactggtgtaactgcttaggaaaagtatttgatattgtctttcaaatttgaatatccacattccataagactcggtagttcactttttaaggggtatttacatagagggataacttaaagactgtttttattggacctgtagtaagaaatatatctacactctggcccagtaaacacataggggtgggagagtatcaaaggttatggttcttctgtctgtacactctagtttgatactaccctgtgtcattaaaaaaaattcctcatcttgactagctcatgaatgggttgctacttggatttgaaaccacattgttctgcagacattttgcacatgtgtcctagggacacttaacattgttaatagcaaaaagctgaaaaacaaccaaatttctatgacaggagaatggaaaaatattttggtatatttatacaattggatagtagagagcagtgtacataaatgaataatacacacatgtaccaatatggataaatctttgaaacacaatgttgatttgaaagtatgacttattttttataaaactaatagcattcaaagctaaacagtttgtgtttagggatgtgtaagtgtgtaataaaatcaacatatacacacacacacagactttacaaggatggttatctttggtttggaattcaggtggaaggatagttgaagagctcggtggcagacaggtgttagttctgacctagatctagctttgagtggtgattgtgttggagtttattatgattatgctttattacatgtatatgaatatattctttatatgtgccaaataagaccaatttttagaagattcatctatcttgaaacttgtggacatttcttatttactgtatttttttttctttcttactgtcaactgaagaatgacaaggttcataactttagaaaggagagctttatgtctcataaagggttacagcctgcaaggtggctattcccacactctgggaagcacagcctctggccagaatccagaaactgccacttggaaggtggggtaaagggaacaggaatgtatgctgagcagggtggccaggtatacatagtcaataagctgcaggaggagtcatgaatatttatgaaaggagaaacaggcacatgcgcatttgagcttcaggcctttccgtgggacccatgtgtaacaaatggcagccagagcaggatctgagggtggagtcttgggacctctgctgtcaaaagatgaaacagagggctgggcgcggtggctcatgcctgtaatcccaccacttttcgaggccaaggcgggcagatcacctgaggtcaggagttcgagaccagcctggccaacgtggtgaaaccctgtctctactaaaaaaatacaaaaattagctggacgtggtggcgcacgcctgtaatcctagcctgtagtgccagctattagggaggctgaggcacgagaatcgtttgaacctgggaggcggaagttgcagtgagccgagatcatgccactgcactccagtctgggtgacagagtgagactccgtctcaaaaaagaagaagcagatgacacgaaaaactctcattgcgcctcctctgtagatgggccagaaccaccctgtggttggtagtctctttatcaggaagaaatgctggttggttgttttgacagaacggcagaagggcggggcagcattcaggctgttggttgaaatcagcagtggcatctttcaagggctggtttctctttagcccgttagaagaaagcctaatggcggctattgagggagatggtctgacctcccatcacatcatagctacgaattcagcctctgaggtttctctgtggtccccttggccaaaagaaggtcagttcagttggttgaggggcttagaatttttttttttatttctcattattttcaagggaagccaagattttacatgtctagaaaaatagctcttgggcttttggttttaaggtgttttttttttttttttccttctttgagagagggtctccctgtgtcgcccaggctggagtgcagtggtgcgatctcagctgtctgtagcctcgacctccggggctcaagtgatcctcccacctcagcctcccgagtagcagggatgggctctaccatgcccggctaagttttgtgttgtttcgtcatgtttcccagactggtttcgaactccttgactcaagtgatcctcccgccttggcctcctgaagtgctgggattacaggcatgagccactgttcctggccccctacttttaaggtttttgacattaaaacttttcttgaaactttttctctttgatgggagagaaaaatccttttgcatgtctaacaaaatgcgtttatgggcaggcacagtggctcatgcctgcagtcctaacactttgggagcctgaggcgggcagatcacctgaggtcagaagtttgagaccagccttgccaacatggtgaacccccatctctactcgaagtacagaaattagccaggcgtggtggcacgtgcctgtaatcccagctactcaggaggctgaggcacgagcatcacttgaacttaggaggcggaggttgcaatgagccgagatcgtgccatttgcactccagcctgggcgacaagagtgaaactcggtctcaaaaaaaaaaaaaaaagagcgtttatggaccagatactgcacagaggcctccatctttctttctggctctcttttcactagttcttctcataaagtttgttcattttcttttttttttttttttttttgagacggagtctcgctttgtcgcccaggccggactgcggactgcagtggcgcaatctcggctcactgcaacgtccgcctcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagtttgttcattttctgagagaagagcttctaggcttatttttgtcttgggaggaagtgacttggccagtggatgttcatggatactgatggtggaggatcctgcattgtactgttaaaattatgggaggccattgttttggactgagctcctgctcaaatccccagcagaccagattaaattgatatagtcactcctgcaaaatgccacataatcaaattgaaactttattaaggaagcagacggattccaaaacagaccggtttttcctgaaagcaggagattccagtctacctgaatcagctcagtaagtctactctgctttaacccttgccaaaaaaacaaccccccccgcaaagcctgatgtaacctgttaaccaattagttttttttcctcttgtcctgttttcttgtttctaccttactttaaaacccactgttctgccattgcctcatgggaacttttattctattttgtagaatggaggctgccctgcctcatgaatcacaaataaaaggcaattggatctataactcaatttgttagatttttgtctttgacagtacttacgggcctgcttcctatacagaccctccagtaattaaatgccttggcagtggtgtactggggcctgctcacactgactccaggtgattgttaaattttcaggaatttttttttgtttgttttaaaaaaaagatagggtcccactctgttgctcaggctggagtgcagtggcacgatctcggctcactgcagcctccacctcttgcgttcaagtaattcttccaccacagcctcttgagtagttagaactacaagcgtgagccaccacgccggctattttgtattttttggtagagacagggtttcgccatgttggccaggctggtcttgaactcctggcctcaagtgatacccccaccttggcctcctaaagtgctgggattacaggcatgagccatgactcccagcctaatgttcagaaattttgtgagctggctgttgaaccataggcatctttaaattgtggcagtattagtactgatacaaatcagggttcacccttgtctgttgggtaccattttcccctcttgcctcctgttatattcacattttctacaactggagaattgatgggatctgaaaggcaaatgtattttctctttggcaaccgtgatttcctgtactctgtgtgtttttaatgaaagagagtttataagcaacttacagacatgacttatttgaaagctcttctgttttattaaaatagagatcagaaagcagttctgtatttcattcagagtcactaaatttactttattgttcctagtatcttagaaagtctgttcttaaacagtaaaatcctagaataaaattgagttcttttgttctttaaaaaaaaaaaaaagtcatgtgactatttttgagatgtttcattcaaaggaaatggtgaatttttagatttctaaaatgttaatcattgttacaagtccccttccctcttgaagtttaggttgcctggattagaagcagtaaactgattattttgaaatattaggcatcagcaaggctacacagcaatgaaattatcaggatctattaacagctgttgtttcttaccattccttctagggcttcctggtgtgcaccttccttccagtagttcgtggtggcagtgttgacatcactattgggacccatattgtgcacattagcagtatagaatatggggagtggacatgttaattacctcactgagggccattcttgcccttagtaacatttaaattagatgatatttcaagatgagatagaaaacatttttagaattctctaagtggaaactctaaagggatagacctagttctctcaagttgagacatcaaagaattgttacctaatgataaagaaatatttaaaataggttttcattagaattttagattacagaatttagtgtgaggcaatcatgtttttgtaaatgatcttccacagtaatcctttaaaatgccagcattcataacttctttttctttctctgatgaaataaaattgcaaaagctttaatttagcagtgtaaatgcaaagctgaattgaaatacaggtaattatgttaaaagggacagctgacaaaattcatgtatttaacaatttttttcttaacatttataaggttttatagaaagaaataatttaattttggaaattttcagtctctggatctgttcttcatgtgattgaaaatctactgtccatattcatttttctatgaaaaaagctctctctttgaaatacaaagaatatctttgtataactgaatgaaaaaattctgtgtgaaaaatctgatgtaagttttatggtataaacctcttttcaagcagtgcttctcattttatttttgttagcatgtctttcagtttgagaattgggatacatttgaattttattattgaaaggctcaaagtaatgcaaaacaagtcactaataattaacagacccactacagtataatagatgcacatacatatcaaactttcatcttggcctctcttctgcagaggtttgatattggaatcaaactcttctgtcctagcctaactatctttgtataaatgagtgttctttaatgttttggtaaccacatgatctatctttctgtcatctttatcctaagcttgaagttccattatatttcagcatgtaatgatactcttaggaggtcacaagatctgctcagtttaacattttctcaaagataatgccataggatggtttattttgttatagacagtttagattttatacattgttaaaatgtgatgaactcttgaattattttggtgtaagtttattgatcttgatctcttgatgtggaatcagaaaatgtggattctctctaccatctggtactttccatatctccccattgcaagaaccatgagttggctttttcttcacttatacctagtgtctagtaatgagcacatggtaggtacctgattgagagggcaaattggcttatatcttattggtgtaaacatgttagccatactgtaattatttcatcttatcttcaggctgaaccttctcttgcaatccctttcctgtctgcctctacctaaaattccaagaatgctgctcaacttgcctgagtttgatcctctgtcttttctacccaagctcctgctgctcttaggacatgactgagaatgatagaatgaacatgagtggagcagttgttggaatgtctattgtggtaaattaggactgatcctttgctagattgggatggaaggtctcgctcaggagtcccaagtttgatatgtgaaggtagtgatgcttagtggacatccaagtgcagatgaattcggagttgaggcaggttgacccaggtgaacttgggagtcatcagaatgttaatgctatgtgaagccatgaccactggatgagacacctagggggttactgtagagataaaaaaaagtctgaggactgtgaggcattatgatatttagaggctggaatgaaagcggtagattgagaaaggccacccagggtaggaaggtgggaagaaaacaatattcttaattgtttgtgcttattttatgttagatccggggatacatgtgcaggtttgttacatgcatgtattgtgtaatggtgagtttgggctcctagtgaacccatcacccaaatagtgaatgttgtatgcaatcagtaatttttcacctctcaccctcttcaccactgtcctcccctgtggagtccccagtgtctgttatttccatctttatgttcatgtatacccattgttttgcttccacttataagtgagaacatggcagtatttgattttctatttccgagttatttcactaaggataatgacctccagctccatggggcagcaaaagacgtggtttcattcttttattatggctgcatagtattccatggtgtatatataccacattaggaagaaaacagtattccaaaagccaagtgaagaaaatgtttcaagaaggagagtgtgattaaatgctgttgacaggccaagtaagatgaacagtaagaactgactactgggtctttgagacagtttgtgtatttggcaccacccaaatctcatgttgaattgtaatccccagtgttggaggtggggcctggtgggaggtgttggagtcatgggagtggatccctcatgggttggtgctcctgacctcaggttattctttcataactgtaatatcctaaacatatcgtctgatctttattttacaccctgatcccatctccctacacttgctcttgatatacacaccaccctgtgtgacattcgtctccctctaaccacttcacaccccattcgcaacgtacacttaccactgcaaccttgctgctgatactgagtgaccttacctcacttaatagcatgcttctctccccttcccattcagactactaaagctgaggtgctctggcgcatcataaaacctttcaactctcttaatgcagttggcttgctacttagcctgacttacgcttcgttcctcacttccttcactctcatccccttgccgcctccgactaacctcttctttcttctctatcacctctatactctccattacccaggcatcttcctctaactctatgacgctccattactccttctatcccgctctactccgttctcgccgctcnnnnnnnnnnnnnnnnnnnntccgtcgagggtgggtgggccgagctgaggatcgacccaggtggtggctccaaagggctggattacagcatgagccaccacgcctggccagcaattcttgacataatgcgttgaagataaaagttaagagccaggcgccgtggctcacgcctgtaatcccagcactttgggaggtcgaggctggtggatcacctgaggtcaggagttcgagaccagcctggccaacagggtgaaaccccatcgctgctaaaagtacaaaaaattagccgggcatgatggtaggcacctgtaatgccagctatttggaaggctgaggcaggagaatcgcttgaacctgggaggcggaggttgcagtgagccaagattgtggcattgcacttcagcctgggtaacaatagcgaaactgcgtctcaaaaaaaaaaaaaaaagaattgcttaataaggaacattttcaaagtttgcagaatttttttgtcaatccaccaagttgacctgaattgtttatttatgttcactgtgtcttttttgtttgcttgagggtcaaagagatttctaaaaatatgtaatgtagcttattagattgaatccagcatatattttactttttattttcctaatttgatgtaattattagaaatttgaagtgccgaattatggtgtgtgaaagattaattggtagaacactttactgtctttgttttctgcatggtgacttacagatcttagttttagttttctttatcctctcatcaagaatggtggagaatgaaaacaaacatctgggagtcagttcttttatgagttattaacatccctctccttttgaatcatagttcagtatgtagttttcttgtttttagagacagtgtctcgctctcttgcccaggctgaagtgcagtggcacagtcatagctcactgtagccttgaactcctgggctcaaatgatcctcctgccccagtctcctgagtagctaggactactcagtccaccatgcctggctaatctttttcttagtggatggatacagcttctttaaatatattgatgtgtttggtattaggcctgtcgttatgcttttctttgtcttctgattttggcaattttacattttaaaaataatcttaactatgttaggtgcttctctggtttgttctgtgtgtgggtttattctaataatgttaagcgttgtattttggtactaccttatcatcattattacacttacgtagtgtatttgatccactgtttctttagaaagttctattgaacaatgacagaatttgtgtatttcctgttttaaattattccttcccacctttctcttctcccacccttttttcttagtgttttctttatgcaatagttgaccccttattattaggggatgcactccaagacccctagtggatgtctgaaaccacagatgataccaaaccctgtatatactgttttttcctgtacatacacacctatgatgaagtttaatttgtaaattaggcatagtaagatattagcaacaataactaggaataaaacggaacaatttgcaacaatattctgtaataaaagtcatatgaatatagtctgttctcaaaatattttactgcattatactcacccttattgtgttgaagaagggatggagcaggatggtgcgagattttgtcatgctactcagaatggtgtgtcatttaaaacttatatgttgtttatttttggacttttccgtgtaatattttttaactgcggttgaccatgggtaactgaaacctcaaaaagtgaaaccgcacgtaaggggagactactataattttagatttacttacacctctgttacttggtgtacaaattttaaattatatctctgcatcagcccttgttcatgaaagctcaagaaaccagtgtactttcttttgttgactttatgattttcagatcaattagatcatataattctttaaaatagctttattgaggtgtaatgacataaaataaattgcccatattaaagtgtacaatttggtaacttttgacttgtgaaaacagcaccacaatcaagataatgaatatgtccatcacctccagaaatttcctcatggccgtttgctgtctctttcttttgcccctccctgctaccctcaacttatcctcaggcaattactgaacttgtatcactataatttccatatttttgaatttcatgaaaatgcaacagtatgtattaatttttgtatgtattcgcttttttttgatcaatagttcttttttattgatgagtagtattccattgcccagatgtactacgtgaaagacatttgggttgtgttcagttttgggctgttacacataaagctgctacagacatttgtgtgtaaagccttcactacccttacgtttatggatcaagttatggccgttgcttcctcagtagcattttcaatgtagtggatcagcatattatcctatggatggtgagactgtcaagttccctgtggattagcttaagtatccagagctcctcaaactgtattgtgtgtataaatcacctgggttaaaaatgtgcattgtgaaaaatgtagatcctgcttcagatgggtctgcgataggacctgggagtctacatttataaaaagcttacaggtgatgctaatcctgctgttctacaaaccatactctaaataacaaggttacagagcctgagagtttatgaagcaaggcaataatggtgaggttttttcctgccaagtgaaagtaaactacttatggtatgttatctttttatcagaaatagaagtgactgcatttaccatgttaagcagcattttaaatgccaagagtttggttaaatgtggaccagcaatcaacagaagtcatcactcagttctactagtaagtgtaaccttccagataagattgctgaatgggcatggacttccctgccagcctgtcatctgtgcatttcccttagggagggttttttgatttggaattttggtaggaaggaaatattctggggttggccctttttattttaatagcctatagagtcgtgtactggggggcactgccacactgtgggttttgggggtttccagagaaaactcaagtcagaactcgattacagtcagctgactggtgctttgcatccagttcccaaggtttccccagttgaacccagtgaactgtggtgttgccgtaggtctcaaggaattagtggcgcacagagccagtgtgctgtcgggcttcctattgagtttcagcatttcccttttctcgggtacgtggtcacaagtccttaggggaaggatggaaggatggcttacggtgttggggatctggggtgtgagaactagtgataggcagtaatggttaagagcaaaaccctgaaaccagacagcctgtgctcagactgtaccaggcaagtaacagcaactcctttgtgcctcagtgtgtcatctataaattgaaagtcatgagttcttacagcataaggctgatagaagtttaagtaatctttgtaaggttcttaggacagtggccacacatagtaaaaactttttaagtatttgctagatacataagcgtatatatagaaaggtaggaaggcaggtggggaaatgataggcttagaaaaattaagcaacttttctcagggctcacagtggtaacagtggtggcattgagccaggatttgacatttgaactccccacagttgcattctgtagcttcacttaaatcattcaacatggtatgtggcatatatttgatggaagcagtgactgaatttaggacttcaccagtttactaatttgttgagacgtgaagtgtcagcataagcatagtataccaatttaacatccctgaactcagactagactatgtctgtgatgttctggcttgggtcgtgttagtaataaagtagagaataagctcatgtgtagttatattgttgacccttagttatattaaagaatacgtcctttctaataactgaatttttttttaacttttcctggacataggtatatatgaattgctttttaaagaaattataggtgttctcttctaattgactaaggaagtcatctgatttatatcagatcagattgttttataaacattctatcatgttgttttaaagatgctaaaggaaataatatcctagtatggtattaaaataatatattgctgagtttttccaaatgaataatgtattgctgaaattttccaaatttttccatgtaatattttcaaactgcagttgaccatgggtaactgaaacctcaaaaagtgaaactgcacgtaagtggagactactataattttagatttactcacacctctgttacttggtgcacaagttttaaattatatctctccaccagtacttgcttatgaaagctcaagaaaccagtgtactttgtttttttggcttttttacttcattaagctgttttacttaattctttagttagaaacattttgtagacggctttctacaatgctaatttgttaattaataatttaaagtaccagtgcttaacctatttaatgatttgagaatattagtatcccatttttcttgttctttttgtatgtggaacccaaatttcttgtcattttgtgttatatatttcctataagctttaggtacaaggtgctgttaagagttaaggaaggtactttctgccttcatcattgagtataaaatctgcagcactgcagtgaggctgtcctcatgctgttgccactcatggtcttactctgcatcactcgcagtattagggaggagttggaccctattccatgttgcccacatgcctttggttttagctaaatcgaggattgattacttattttatgctgtttctaggcagtttttctctttttttcctagtaaaaaagtaaatttagtcctcttttctgtgtgaatccatacagcctgaaattactatgacaggcttgtataaaaaagcatgtgagagggaatgctagcttccagcaatttgttcttggtataatgaccctttctgtaaggaatgttgctgctcttcatctgttagtttttcttcacaacaacttgtagaatttttccatttcatttagattttaacctagtgctagaatcgaagtgtcatatttaaatactgttacttttggcttttggatatgtgttccttttaaggtctgtggtgcctgagacttctcactttgaactcccatctctcacctgtggtattatgtttgcagcaatgaccctggtgtgggcctccagggagcaacagcccagccagcctgcaggcctcactcagggcttgttttgttattgtgattttttttaaacctcagtgatgggaatgggagaatatacattaggatgaaggtaaagttttagccaaaatgaaagataattaggtatttattgtaattttcagttaacttagattttatttctattcttcttgaaagattttagtattcagacttccagcataatgctacatagggcctttcccttgaaatgcttgatttcactgctttctgtaggaacactattcttcaagcaaaaccaaatttaaaaatcctgtggggctgggcgcagtggcttacgcctgtaatcccagcactttgggaggccgaggcgggtggatcacgaggtcagattgagaccatcctggctaacacggtgaaaccctgtctctactaaaaacacaaaaaattagctgggcgtagtggcgggcaccagtagtcccagctactcgggagactgaggcaggagaatggtgtgaacccgggaggaggagcttgcagtgagccgagattgcgccactgcactctagcctgggcgacagagcaagagactccgtttcaaaaaaaaaaatcatgcgtctgacactaacattttcctttaataatcaaattgttcatatttttctagaagcatcaaataacctacattatgtgttgtatttatctgagaatcgaaagtagatactttaattttccccactttcatagtcccttgagtctaattatcgtaggctgcaggtcctacagactactgaagtgaaccaggggcctgccttacagttgcttttttccctcttaaaatagcaaactgtttaattgtttgctttaattatatttttaggagcatttcaaaggattattatcttctttgtcatacctggctcatttcctggtacgaaactgaaaatagtatctgatcctattggttgcataacatactgagtcataatttcttcctcttgctgttgggaatagccattgctcgttggattcgcagttcctgtttcatttatttgtgcttatatacaactgtcattttgctattcctttagatctttgaaattcataatctacctttctaaaggtgtattttattgagttcctgctatgattattaacattttttttccttttttttgagacagagtctcactttgttgcccaggctggaatgcagtggcacgatctcagctcactgcaacctctgcctccagggttcaagcaattcccctgcctcaccttcccagtagctgggattacaggcacgcaccaccatgtctggctaatttttttgtttgtttgttcgtttgtttttttgagatggagtttcactcttgttgcccaggctggagtgcaatggcgcgatctcagctcactgcaacttccacttcctgggttcaagcgattctcctgcctcagcctcttgagtagctgggattacagtcatgtaccaccacgcccagctaattttgtatttttagtagagatggggtttctctatgttggtcaggctggtctcaaactcctggcctcaggtgatctgtctgcctcagcctcccaaagtgctgggattacaggcgtgagccaatttttgtatttttagtagagatggggtttcaccatgttggccaggctggtcgccaactcctgaccttaaatgatccacctgccttggactcccaaagtgctgggattacaggcatgagccacactgcacccggccccctctttgattattaagtgctcccaagtagaagaaatactagatgtaaagaaaccacatatatcagactggcatgtgctttgagatgatgcatactttcctggataaaatttactacgacagacatcttttagggaataattaggatgatgtatagccttagaatttataatattgtaaaatgactaatatttaattacccattgaatacgaattaagctgttttacttaattctttagttagaaacattttatagacagctttctacaaggctaatttatgttaattaataatttaaagttccagtgcttaacctatttaataatatgagaattagtatcccatttttcttgttctttttgtatgtggaacccaaatttctcatcattttgtgttacgtatttcttacaaattgtaaggcatatggtgcctgagacttgctcttggagctcctgtcttccatctgcaggccctggtcctcacctctggtatgtctcttggcacctaggctggctctttttgcagtgaccctggtgtgggcctgcacaaaaggaaacaagccctggaattgttaagcttctcaagggcacacaattttcatcctctttagaaacataatttctcaaattctttcttaaaaaatcaagacgaggtctcaccatgtttcccaggctggtcttgaattcctgggcacaggcaatcgttcgtccttggcctcccagaatgctgggattacaggcatgagtcactgtacctggctcaaattcctattagacttaaaaatagtttttattaattccaaaaagtataaacttattggagaaataagaaagatgcatttatcactccagagattccaagggttttaagagctgtgtgtctggaaacagggatgaagaccaaatatgtatttcataatatcacggcctccagcagctacttgctgagtgacttcagcacttacgtagcagggagggagcacccactctttctctgcttctgctctctccatcttagaactcttggcaatttttcttttctttagctccataggactgcatatgtttatttctttattaaacaaaagaagttaataaaaaaaagaaaagtaggcaaaataccaggattaatataataaaggaggaagaggcagtgaaaaaccgtgaggtttgtcccagattagtaagaacgttattgagtagcattgatgtgatgttaatttttgtttcatatgggctgtatggtaatgaatgttctgatagaaaaggttatgcacagagtgccatgtaagcatagaggaagggacatttgagcctcgacagacaagtaggggctagctaggcattctaggcagagctgcaccttgtatacagatattgagtcttgaatggagacttttggagctgttttaagtagtttggggctggaacagaatatctgaggttttggaagagattaggcaggtgtgcagaacttagttccaggtgccttcctgtgccatgctaaatgtttacaccatttctatcctgaaggtagaataaatcattgaacagttttaaataggggaatagcatgactgtgtttacattttagaaagattaccctacaggaaaggtagaagatgcatagaagggtggcagattgcaggtgaaggagattaattaggtacttcctgctggtgagaaatgatgggacccagaacttgggtggtagaaaagggcattggcaaggaggacatctgggatgacttctgagtgtcttgagtaacttgatgaatggaggtgctactaactgaaatacagcctagaagaaggattgagaagaaatggtttggacacatgaagtatttaagtgggtatgtccaacaggcagggggctgtttgggtttgaggtagagatctggaaatcattggtggtagtataggtggtaaaagttgtggatgagaatgagatctcctgggaagagcttttattgagaggggaagaaggctgagaaattaccagaggtagatggaaaggcaggaaaaatgagggacccagcaggcagtgaagggaggaatacaaggagggagtgtccaggatggatgtctctgatcttttgaggcagtacatttaataggtactgaatattgtccactggctataggacaatcttataatgtcattggtaactggaacaagaatggtcttgcttgtttggaggtgaatgggtatggtggcatgggtttactctactcctcttagaagctggtctgtaaaggaggtgagctggagggccttagcaaggcctaaggaaggcttctgacgggtgagacttgaggttggagagatagtaggttgaggaggtctagaaataaatgatctctagacaggtttttaggaaggaagaggagttgagagtcggtaaccaaagtcattacattctacttgtagtagctcaggatgaccttgggaaggactcagtttaacttgctgttttatatttttattgatttttcttttcttttttccagataaaattcactagatattgtttgcacattaaactcatttccagactgcaaaccctgacatagctgttatttttttcactaagtgttctggaaagcacattttgaatttgtcctgtcctttcaagtccctccccacccccaacccctaaatgttcagacaggtacagatagtgaaatactgcctgtgcaaaagccccttccacgcctgctcttctgggagtgcttcaggcggcagctgtgtatatgtgctccttcctggccttttcagacttgatcttcaataagtgatgaattcctttatttatgaataaaactcagtgtacttcagcaaatttgtatattttaaaaggagtcaaggagtgagcctctgggggattttacatatcagaatggaagagagagattttgggggatagtacctttttattgtttttgtttgtttgtttgttttttgagacagtctcactctgtcacccaggctggagtgcaatggcacgatcttggctcactgcaatctctgcctcctgggtttacgcgattctcctgcctcagcctctttgagtagcttggattacaggcacccgccatcatgcctggctaatttttgtatttttgtagagatgaggtttcaccatgttggccaggctggtcttgaactcctgacctcaggtgatcctcccacctcggcctcccaaagtgctgggattacaggcgtgagccacagcgcccggccgatattacctttttaaaatccactttctgttatatattaacattggccagccttgcttcacattcccatagtcagaaataaaattaatagagttctgcttttcagaataactaataaaaccagtcactttttgaactggttatgaaaatgaaatctgtatgtcataatttacaaaagttgtattaaaataatactcaatttctggattcaagcaagttgagcttttagttctgtgactggctgacccctttccaggcatgcttgtgagcaggttctcagggcatcttgcctctgaagtggaagagcctgattgttttccagctcccattcataatgttagggctcctcactaaatgacagctcacgggccaatgccacagcaactacttggacagtttctttcttgtttgagcagatgtctttctttgaatgagactctgtcattccaagcactgaagtagcccataaaggatcataaatttcacaattatgtataagtcatttcaatttgaactttgtatgaaccaaacatcttgtgaaagacttctggctctaagattaagaaatcgtagaactgtgattctgttaattcaacaaaaaatgtttatgaaagtaattcaataatatgggaagatttaaagatattgcacatacatgtgatggaacactatacagtaattatataatgttttgaagaataatgatggaaatgcttatattttgttaaaggtaaaagggatacaaaagtctgtatatgatctcccatttaaagcataaattcacagaaaaaaattaaaaatgaattacacagtgagataataatcttattaaggaagcataaaattttctttccatttcagctaatcttccagtaccaacaattgcagcaatagatggactcgctttaggtggtggtcttgaactggctttagcctgtgatatacgagtagcaggtaagaattaatcctgttaaaaacataatttaaaaaagtgaaggttgtgtttactcttcaggtaattttaaatattttattctgcttcctgttgttgagtagaatattttcaaaaagtcacttgttggtcctaatggtgttttcgaaattcccacctgaaaaaagtcttgtgttgtttcttgccaggatttgggtcaggtagaactgagtttgaatcttaggtcctggaccaggcgcgtggcttgcacctctaatcccagcactttgggaggctgaggtgggaggatcacttgagcctgggagtttgaggctgcagtgagccatgatcgtgccattacactccagctcaggtgacagagggagaccctgtttaaaaaaaaaaaaattaaaaaggaaagaaaaaaaggaaaagaatctgaggtcctcccttttttaggccaatatcttcctctttagaggaaatgggggaaatgactgttgctgttgtgaagattaagcaattaatctgtggatgttaatctaagtactaaatcaccatttgctacagtaatgataactgaatctccttgaagtccactttcttcctgaatggttttctgaggatcttatgaggtgaatagaaaaagagtgaaaagaattagtgcccactgcttactgtgtgcagtccaggcacccagtgttattctagcacttgacatgtattcactcactccatctgcataacaaccctcagagcaggtactttggggcactggaggaaactggagaagggagagaagccccaaagaagtgactgaactgagatttgaacccagactgtttggccacagcccacacacctgttacctcatgagagcaacgtagactgatctcccatattcatcgttgtggacactatatccatagagactcagctctgcctgtgtcctcgggctctgagactgagaactgggcacagcagacggcacagagttgtcactgttcttctcttgctttccattatcgtttctgatgtggctgcatgttaaaagcagagctgccaaggcagaaggattgattgaggccaggagttcaagactagcctgggcagcataaggagacctcatctttataaaagattttttaaatttttagaacaatgtagcgtcaacatgattcagtttcttgggatttctggttgctagtccatgtgtcctttttcctccttttcacttcattttaggaacctattttcttgtaatgaaatcattggattttaaattgaaaagctaaggtacatgtaatccatttctgaaagaatacaggttttggaaattagaatatgggaagtagtctaagtatatttggatatgcaaataaagaagttattaagatgttttaaagtagccatgaaaacagacatgaaaagaggaaccctgtccacctgtcagaatagtaaaactatttgtcagaaggtaactaaagacttggtcttgaaaagttgccatatctgatatgacctattaagctctttggtctgggggactatattcaggcaactgaagaatttgggcttgtcagatactgacaagtctgctgatcctgaataattaatagatctatgcctccaaatatgtcttggcaatattgggtctaataatggagttacagtcctggtcttgtgaatcaaaaattaattcactgccaagcagtttttaacagaaaatgttgtgggactctcctaatacatgtcatttagagtgcttacttatttccataacaatgccttttaagtgattttttttaagaatttgtgatatcaatttaattagtaaacaatattttagtatatctcataactttttcaagttgtcatatttgaatgtgatgatatggatgatacttaattttctttctttcgttttagcttcctctgcaaaaatgggcctggttgaaacaaaattggcgattattcctggtggaggtatgagtagttcacgcccattcctcaaatccttgatttggtcctagaaacagggcataaggcaaaatcatgttaattggaaaggcaacattttgcgtaaagagacaatggcatattgtttgcatccctagcaaagtccccattcaagttacaggcatacctaacagattttccccaccgcaatgaaacaaatactgcgatagagcaagccacacaaattttttggtttcccagtgcatataaaagttatgtttacactatctgcagtctgttaagcatgcagtaccattatgtctaaaaacacaatgtacatatcttaatttaaaaatactttattgctaaattttctaatggtcacctgagccttcaaagaatcataatctttttgctggtagagggttttgccttgatgttgaggctgctgactgattagagtggcggttgctggagtgtggaggtgctgtgccaatttccaaggacagcagtgcagtttgccacatcagttgactcttcctttcacaagagatttctctgtagcatgcgctgctgtttgatagcattttactcataattctttcaaaattggaatcaatcctcaaaccctgccactgctttatcaactaagtttatgtaatactctaaatcctttgttgtcatttctgcagtgttcacagcatctttatcaggagtagattccatctcaagaaactgttttctttatttgtccatgtattagtctgttctcatgcagctaataaagacatatgcgagactgggtaatttataaaggaaagaggtttaatggactcacagttctacatggctggggagtcctcacagtcatgacagaaggcaaaggaagagcaaaggcatgtcttacgtagaggcagtccagagagaatgaaagccaagggaaaagggaaaccccttattaaaaaaagcatgagatttcctgagacttattcaccacgacgagaatagtatgggggaaacccgcctccatggttcagtgatctctcaccatatccctcccacaacatgtgggaattatgggagctacaattcaggatgagatttgggtggggacacagccaaaccagatcaatccacaagaagcaactccccatccattccagttttataatgagacttcagaaattcagtcacgtcttcaggttactcttctaattctatttctcttgctctttccaccacatctgtagtgacttcctccactgaagtcttgaatccctccaagtcatccatgaagattggaatcatcatcttccaaactcctgttaatattgatattctggcctcttcccatgaatcatgaatgttcttaaagggatctagaatggcagatcctttccagaaggttttcaatttaatttgcccagatccataagaggaatcactgtctatggcagctatagccttatgaaatgtggtttttgttttgttttgtttttttgagacggagtctcgctctgttgccaggttggagtgcagtggtgtgatctcggctcactgcaacccctgcctccccggttcaagggattctcctgcctcagcctcctgagtagctgggactacaggtgcacaccaccgtgcccagctaatttttgtattttttgtagagacggagtttcaccatgttggccaggatggtcttgatctcttgacctcatgatctgcctgcctcaagctcccaaagtgctgggattacaggcgtgagccaccacgcccagcctgaaatgtgtgtcttaaataataagacttgaaagtagactgatccatgggctgtggaatggctgttatgttatcaggcatgaaaacaacattcatctccttgtctgtctctgtcagagctcttgggtaaccaggacattgtcactgaacagtaatattttgaaagaactcttttttttgagcagtaggtctcagcagtgggctttagtattcagtaaactatgctggaaaccagatgcactgtcatccaggttttatttgttccatttataaagcataagcagagttaacttagcatagttcttaagggctctagaagtttgggaatgataagtgagcagtggctttaactaaaagccaccagctgcattagtccctaacaagggagtcagtctgtcctttgaagctttgaagccaggcattgacttctcttctgtagctatgaaagtcctggataacatcttcttctaatagtaggctgttttgtctacactgaagatgtgttattcagtgtaggcaccttcatcagtgatcttagctagatcttctggataatttgctgcagcttctacatcagcacgtgctgcttcaccttgtacttctgtgttacggtagatggcttctttccttaaccatgaagtagcctctgctagcttccaacttttcttctgcagcttcttcacttgtctcagacttaactctagaattaaagagagttaagagttatagttaaagagagttagggctttgctctggattaggctttggcttaggggaatgttgtggctagtttgatcttctttacggaccactaaaactttctgcatatcagcaataaggctattctgctttcttcttattcctgtgttcactggagtagcacttctaattaccttcaagaaacgttgctttgcattggcaactaagcctaagtggtgcaagaggcctagcttttggctgatctcagcttttgacatgccttcctcactaagcttaatcatttctagtttttgatttccagtgagagacgtgtggatctttgctctacttgaacactgcagaagtcactggaaggttattcattggcctaatttcaatactgttttgtctcagggaatagagagacccaaggaaagggagagagatgggggaacagcccgttggttgagccgtcagaatacatgcatttattggttaagtttgccatcctatgtgggcgtggttcatggtgccccaaaataattacagtagtaacaacaaagattaatgatcacaggttaccataagagatacaataatgaaaaggtttgaaatattgtgaaaattaccaaaatatggcacagagacatgaagtaagcacatactgttggaaaaatggtgccaatagacttgcttgatgcagggttaccattaatttgtaaaaatgtagtatctgtgaagtacaataaagggaagcacgacaaaatgaggtatgcctgtatgccctatttttagcttacgtagacagtgaagatggtagttcttaagttttaagttactgtgctaattacatttttgtcactgtttggatctattttcctaaaggattacacaaatattttaaagcttttatgcgtgcatttaaatgtgtgtgtcctcaccaacagcttcatgcagacagtgaaaccccaagtggaagaagaagagaggtgcctgggtgcggtgtcttatgcctgtaatcctagcactttgggaggccgaggcgggtggatcacttgaggtcaggagtttgagaccagcctggccaacctggtgaaaccccgtctctactaaaaatagaagaattagccagtcatggtggtgcgtgcttgtaatcacagctacctgggaggctgaggcaggagaattgcttgaacccagatggtggaaattgcagtgagccgagatcacaccaccgcactccagcagcctgggtgacagagcgagactccgtctcaaaaaaaaaaaaaaaaaaaagagggttcccaggctttgtaccacctttcttgtgtttctctgcagtgggacaaaagttgcggttagtgggtagcctgaacttagagctgaagaggtgttgtttcttctattcctatgaaaaaaatagatgagcttctgttcttgaaagagccgtttaagaaaacatctttccaaaattgataatgaaatcttgcatcacccaataaatctgaaatttttggtcttttgattcagagaatttggaggcattcccattttgtgaagtcattctttcaaaaagtagacttcatttaaggatatgcatgttatagtaaccttccttggaacttttttttttttttttttttttgacacggagtctcactctgtcgccagactggagtgcaatggcacaatcttggctcatggtaccttttatgtatgctaaatgatgcttagagtatgaatgaaacaacagtaacaatgtaaatattaaactcagtgttgaacatggaagacatacttgcatatgaattggttaaaattgtgtggttaaccttatcattaaaagagtatttattctgataggtagaaatttaaaacataggttacagtgaaattgaagactgcccagatgaatgtgtaagactccccatgttttctactttggtaattgatgaaaatgttattcttgtaggccaaaacatttaatatatacttactctattatgcctgcctttttcactgtgactaataaaaaacaccagaaggatttataagacagtggatcaatttaaaaagaattcccagataactaatatgtgaaataaagcaaaatttagcaaaagggtgatgtgacatatttctgaaattcttttgagaagtaagcatttgttggtaatgaggatgtgattaatcctagaagatagaaagatagtggctgtagtgggttggatggcatgccgcctccacccccacccccccaacagacaccaagagatgtcagcctggaaggaaaagcatcttgcacgtgtaattaaggatctcaagatgagatcatcctgaattatctgagagaggcttaaatccaaagacaaggggtccttataagaaagaggaaggcacagaagaagagaaggtgatgcgaagacagaaacagagtgcagtaatacatctacatgccaaggaatgccaagggttgtcggcagccacgggaagccatgggtgagaggcatggaacagattttctcacagagcctctcgaaggaaccacactacaaacaccttgattttggatttctggcctccaaaactgagagagaataaatttcagttgttcagaggtaccaggtttatggcaatttgttatagcaatgaatacagcgactttttggtgatgtttacatgatttttggggacagatgggggttagtaggtggcagaaatttggggagggagcaagatgaacttggtaatttggatatttactgtgacttgattatgaaaagttttgtgttacaactaccagaagatagagagcagtgtttggtttgattagatgagaaaagatagattatgctataacaacctcttctgtcttgtcttgtgaactcactgtgccataccatatgaggtctagaaactagaattttttcccaatatacttaagttctttagagtcctctgcaatagtggctgcattaattagaacctactttttgtaggtttgattgaatttggactacatattctgacaaatagaattatttttctagtttctattaaataaatttgtcataaaagtcagaatgctttgacatattcccatgtacttacaaaggatggttgtctttttcttttctttcttttttttgtttggagacagggtcttgcttggtcacccaggctaaaggacagcgatgtaatgatagctcactgcagcctcaaactcttgggttcgagatcttcccacctcggcctctggagtagctgggactataggcacacagcactgcactcggctaattttcttctctttttgtagaggcagggtctcactatgttgcccaagctggtcttgaacttctggcctcaagcaatcctcctgccttggcttcccaaagtgctgggattacaggcatgagccactgcctctgacctcttttgtcctaagtgagtttgaggaatgtattttagttcctcttttaataccatgaagctttcaagttcatagctcataaaatgttatgtagctttgaattttttaatgtaaatgaaaatcagattcattttcgttattaataaaaatttcaatagtattcacatttagataagagatgcacagaatttttggtctacttttaaattaatattacagttcttaaagtaccctaggtgatgcctgttcttttgaaacagcagagattttattttaaaaatacgtttttgtgtttattacctaaaggagctattctgaaatttttatgtagaaaaatcttcttctgctccatccacagaagattttttatccatagatatttttgccatctcctttctcctctttcctttgttgtagatgatatgaaaagactgcttttttcaaaaattgtgtttttaaattggtgaattttgccatgcctaaagtgatctctgagatatcctccttttgggtataaacatttctgttaaatgttgtaaagagctttctataatagacacagtagactgtatttaatttttttctcccttcttggtagatctcttttggttaaaagaaaatgcgtcacttgcctcctattatagaagcttgtatgagcagccaggggtgcactctgcagggaaggcttggccattgccagtgagccttgctccactgtagctgccttagctcttcctcttttccagatgagcaggtgctgacagccaaaaaaatagaaaataagtggggagaattcaaatatggggaaaatattgtggaaaaaatagatgcttaatttttcttcttaatattatgtagaaagtaaatatctttgggtaaaatacatgaattgtagccactctagaaaacagatgtttaaaatctggcaaataatcttctgctaagttattacaggtccatgatttcatactggccagcatttgtaagttaatccaaatgaaattgtatctccttatttgaatttactgtacatttgataaagacaagagaattaatgtgatgctattgattgtcatatcatcacttctggccttttctgatagcagttcacagcaaaacaatttgtcaaaaaatagtgttttgttttgttttgttttctttacctgagctttgacctgcgtagcaatatgttgatttttaaggtatgttttgtaaattaaaaaaatgctattataaaataatgactttgaagagatggtaatatttctattgaacatattaatggaccactgctatcatgtagtttttaatttagaaggctcaattttagtttttattagaaagaatattgtttagtatcaaatgactattaaaagtatatagtgcaataaaaagaaagacgtgaaggaatgtggaaacattaaaacaaaatcgaacctccttaagtagtagttatatcagatgtaattaaaagatgggatgtaatttgactatcaaatacttgaaccaatgcttttatttgtaatatatatatgtgtatatatgtttttgattaccaatattaaacacaaagtgaaacactattgatttgaagcactggcccatttaaaaataatttaaatggttaccccagaaccttgtcgtaattttattggggatttttgtacaatatatagccctagtttcgtctccaacgttctcacctttaagaaagcatttacatttcctatcctctcccaactgggagaatatgcaaatattataaaataaaattctcttttagaaatagttcctaaaacagtactttcctttaatacatttgcaaggatgaaatacaagttcagaggattaagatccttttatttgacagtatctctttaaatttacagagaaaatagtggcagattttctaattcccgctctttgttcttacctcttctactggaggttttggggtctgtgtcaggaaaccttattattactaaggtaatttgttaaggctttttgcttgggtgtacaccactgggattgagatgctttgtatttccactgctctgtgaattccttttttattccccccagcttctggggggaggcatattcaaactaggaagtttgaatagcagtaaaacacacatttttataccctttacaaagatctattccttccattttctttctccttccattccccaaatccttctttctcatagaaacatttcaaaatatagatgagtctttcaatatttcagcatacgttttctaagaatcaagaatggtctcttacataatcaacactattatcacacccaagaatattaacaggaatttagtaatattatttaatatatgattcataattggatttctccagttgtctgtagccgtctttttgtattttgtttttccagttcaggattaatttttcatttggttaaatctgtagttttttcaaatttgaaagagtacctcattcatgttttttgttttctataacactaatttaacttttcatgttgcagtaatttcagatttacagaatagttacaaagatagtataaatcactcttatgtacgctttacccagcttcctcaaatattaacatgttatagaactgtaccacagttaacaaaagtagacagttaatactggtatgttattactaactaatctgtagaccttactcaaatgctgtcacttttctcacaagtgtcctttttctggttcaagacagttgaggcctccacgttgcatttagttggtgtgtctcctttgtctcttgtatttaatcagtgtataaatttgtatttaatcatcttgacaatttagaagagtgccagtctgtaattatgtggaatgtcttttatttttgagtttgcctaatgtttcctcatgaataaattaagattattcatttttggcaagaatttgtgttcttctcagggcatcctattggggttgcatgatgtccctgtgtctcatgtttggtgatggtaacttttcttttaacctgaaacatgatacttacccattttttttaaaggattaagtattttatttttctaattgacaagtaaaaattctatgtagagtgtttttatatatatctacacacacacattgtgaagtgattaaattaagctaattagcatgtattgcctcatatactcattagtgtgtgtgtatatatggggtgagaacatataagatctactcttagcaattttcaggtatataatatgttatcattacctgtggtcaccatgacatacagtagatcttttgaacttattcctcatgtctaaagtttgtgtactttggctaacatctcctcagtgtccccatacaaacacgataggtagttaggtaggtaggtagataggtagatagatagattttttttttttttttttagagaattcaggcgattgtctgagtcttgctcattctagatttaacttaatatttcctcatggttaggtttagggtaagacattttgccaacaacattaaaatgtcaatgctgcatgtttcattttgtgtttattatgtgattcctaatgttaggtcatcccactttgggtgataatatctttgatcatttggttggggtagtgacaaatgtgggcatatttttaggattatcttagaaacttttcaggaaaagaagctatagtaattaccattggctgactatttccaaatttaaaaagaaaggaagaaggaaaattagagcacagaggtttcatggaaccagaaaaagagaccaactccagttttgtctttttttcccctccctgggtgagggatctgggggcattactgtacatcattgttggctgtgttcagcagtagggcagtcttttggcatgttttcctggaactcgattttaaatcctgtgagtgtgtgtagtcctgaacacagtagtcattttgaaaggctttgtttataacctttgttgagatccttttagaagttccgtcagaatctgagcttattcttttaaatatcctcagcagtgactcatttttatcctgtgagggtaaatttgattttcataaatatcaaaagatcattctgtgccaaatatgattaataaggtcatactattccaggaagaaaaaaaagcataacaaaacgattttttttaaaaaagaggcttacataatgttgacattttaccgatgtgaagaaagaacagagtagttgggtttagtgtagcacttccccaggtgacttccttaaagctggcactgattcagccttctgaagtccagtgtatttattaacatattaacattattaacataccttgcgtatacacgagcacacactatgaagtctcatctttttatacattaaagtgtaattcagtgactagttctttttgtgtaattagggtggtttgggagttatttgctgactttgtactgtgtacagaccattttgttagtagctgtggaataaacaggtttatgtaggacttagtaatgctcccttggaattgatcacctaaaatctgttaggagagatgaaacgtgagcaaacatcataactgccctttataatactgttgttgtagtcaaacagggataaggcaatataaagctgggagtcaatgagttcagaaaaacagtgtggcttctgtcagccatcaccaagattttttttttttaatactttaagttctagggtacatgtgcacaatgtgcagatttgttacatatgtatacatgtgccatgttggtgtgctgcacccattaacttgtcatttacattaggtgtgtctcctaatgctatccctccccccttcccccaccccatgacaggccccagtgtgtgatgttccccttcctatgtccaagtgttctcattgttcagttcccacctatgagtgagaacatgtggtgtttggttttttgtccttgcaatagtttgctgagaatgatgatttccagcttcatccatgtccctacaaaggacatgaactcatcatttcttatggctgcatagtattccatggtgtgtatatgccacattttcttaatccagtctatcattgatggacatttgggttggttccaagtctttgctattgtgaatagtgccgcaataaacatacgtgtgcatgtgtcttcatagcagcatgatttataatcctttgggtgtatacccagtaacgggatggctgggtcaaatggtgtttctagttctagatccctgaggaattgccacactgtcttccacagtggttgaactagtttagagtcccaccaacagtgtaaaagtgttcctatttctccacatcctctccagcacctgttgtttcccgactttttaataatcaccatgttaactggtgtgagatggtatctcattgtggttttgatttgcatttctctgatagccagtgatacagcattttttcatgtgtctgttggctgcatgaatgtcttttgagaagtgtctgttcatatccttcgcctactttgtgatgaggttgtttgttttttttctcgtaagtttatttgagttcattgtagattctggatattagccctttgtcagatgagtagattgcaaaaattttctcccattctgtaggttgcctgttcacgctgatggcagtttcttttgctgtgcagaagctctttagtttaattagatcccatttgtctattttggcttttgtcgccattgcttttggtgttttagacatgacatcctttcccatgcctgtatcctgaatggtattgcctaggttttcttctagggtttttatggttttgggtctaacatttaagtctttaatccgtcttgaattaatttttgtataagttataaggaagggatccagtttcagccttctacatatggctagccagttttcccagcaccatttattaaatagggaattctttccctatttcttgtttttgtcaggtttgtcaaagatcagatggttgtagatgtgtggtattatttctgagggctctgttcgattccattggtctgtatctctgttttggtaccagtaccatgctgttttggttactgtggcctcatagtatagtttgaagtcaggtagcatgatgcctccagctttgttcttttggcttaggattgtcttggcaatgcgggccctttttttttttccatatgaactttaaagtagttttttctaattctgtggagaaagtcattggtagcttgatggggatggcattgaatctataaattaccttgggcagtatggccattttcacaatattgattcttcctatctatgagcatggaatgttcttccatttgtttgtgtcctcttttattcattgagcagtggtttgtagttctccttgaagaggtcgttcacatcccttgtaagttggattcctaggtattttattctctttgaaggaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctaaatatgcaatcatatcatctgcaaacagggacaatttgacttcctcttttcctaattgaataccgtttatttctttctcctgcctgattgccctggccagaacttccaacactatgttgaataggagtggtgagagagggcatccctgtcttgtgccagttttcaaagggaatgcttccagtttttgcctattcagtatgatattggctgtgggtttgtcataaatagctcttattattttgagatacgtcccatcaatacctaatttattgagagtttttagcatgaaggttgttgaatttagtcaaaggccttttctgcatctattgagataatcatgtggtttttgtctttggttctgtttatatgctggattacgtttattgatttgcatatgttgaaccagccttgcatcccagggatgaagcccacttgatcatggtggataagctttttgatgtgctgctggattcgttttgccagtattttattgaggatttttgcaccgatgttcatcagggatattggtgtaaaattctctttctttgtggtgtctctgccaggctttggtatcaggatgatgctggcctcataaaatgagttagggaagattccctctttttctgttgattggaatagtttcagaaggaatggtacccgctcctccttgtacctttggtagaatttggctgtgaatccgtctggtcctggactttttttggttggtaggctattaattattgcctcaatttcagagcctgttattggtctattcagggattcagcttcttcctggtttcgtcttgggagggtgtatgtgtccaggaatttatcccatttcttctagattttctagtttatttgcatagaggtgtttatagtattctctgatggtagtttgtatttccgtgggatcggagccatcaccaagatttaatagatgacatgtcctgcaaggtgggtccctggctacttctctgacctcagctcctaccactgctcctcctgctcacatactgttttccaggcatgtttactcacttgccttagcagacatttgttgagtcatgtgctgatgtggacactggggatacagccgtgaacaagcagaggaagatcctgccaccaagcagttaccttctagcacaggaacagtagacctagcacatgataaattgtgtattatggcagaagtggaaggtgctatagaaaaaaaaaataggggaaggggtccaaggagagtgtgggtttgtagtttaaaaccaagaggtcagagcaaaccccatttaaaaggtaacattgaaataaagacttaagggagttgaggaaattaatcatacagatctgaggaaaagcatgtcagtcaaaagtatcaactagtaaagaggccttagatgggagtgtgcttggaacattcaccacatcaccacaaccagagcagagaggaggaggaggagagcaataggagatactgtcagagaagcaataggggagtcagatctagaggtcttatagccactgtcaggacttttaacttttaccctgagtgagaagggggctcaccgtaggtttttcagcagaggtgtgacgtgctgtgacatgctcttagatatttgaaggttcattgtcatcactgtgttaggagcagacaatagtagggccaggttagaaggaagaagcctattcctgccacgagcctgttgctgtagttgaagtggaatgtgataggggcctctactgggatgggaatggtgaaagtagtggggtatggtttagattctcggtatcttttgaagatggagccaaaagaatctcttgatagactagatgggtaacataaaagaaaccgatgtaaagaatgactccaaggattctggctgcagtaactgaaaagagaggttgccttgtactgagatgtggaaagctattcaaaaagcaagttgggaagtgacaatcaagaatattgttttggacgtgttggcttcaaaatggtcattaaatatcaagtacacttttaagtagactgttacacagatgtggagttttcgagagcagcctgggtggaaaataaaaaaccgtgggattcatttttttcctgccttccagaggcctgttctaaaggcatcctgaaacacagaaatggacattggtacagacagagagaactccaggagagtaactccaacaaataaaaatcttaggattaaaaaataaaattgccaaaataaaaaacaaactggatggactgaattgcagaatgaagatgaacaaaagagagagtgagtgaatctgaagatagagcaatagaaattattattcagtctgaacaacagagaaaaaatcattgtgtaaaataaatgaactgaaccgtaggaacctgtgggataatactgaaaggttaaacatttgtgtctcaagtgttccagaaggagaggagaaagtgtatttcaggggggaaaaaatcaaagaaataatggttgaaaactttcctaatttggtgaaagatataaggatttaagaagctgagtaaacctaaacaagcccagagaaatccgcgatcagacacatcataaataaactccctaaaattcaagacttttaaaaaaatcctgaaagaggaaaatgcacaggcaattcaatggagaaagtgtgttgtaggaaaaattggacttccatgtgcagaaaataataaaaaagaaccttgatgtaaacctcataatttgtgccaaaattagctcaaaatagatcataaatgtaaaactaagtttttgaagctcatctcttgttctctcgagtgtaagaccaaggggcctagcccactggtaagtcctcagtgtgtatatttgaatgcgtaaattactgctcctggagaaaagagaatgagattaacttcaaaggatagttatacagaaaagattggagaattaataatatgagtatgttatttactttaactgcccttttttcattaaaattagctttatttatgtgttcaaattatgtaagtaatggaatctaattaattggtgattttggttatgagtattttaatttcctccttataacctcaaatttatgtcagtgtttattgctctcatttttaaaaattgctagtaacttgctctcttagaaaaaacaggttattcattttatgagtggcaggttactttcttattatccagcagtaatcaaggtggtcttatttacattttaatattctatagtgtttatttttgtatcaagttaaataaatggtctcaagaatcactttaagcagtctagaaagcagatgttgaaagacctacctttttctcagagtcattaaatagaatatgtagaaagttaatcaaggaagttaaattagttctgcctataaattaagaagagcggcagttcatttcccttatcttttaaaaataaaactgaattcactttttacaaaccttccagtttggtgactgcttttttgaacctctagtgcctgtaatgtgaaaaacagggtgtgaattgtttggacttaccatcagagagatatttcagtgtgtacctgtcagcatgccatccgacagacgtaaatgtcaagtctaatgataacaagaactctgatttggaataatagagttaagcttacattcctttaagaaaactgaacacactagctcagcagtaacatttatggttaaacatctgatgactagccatgtctacctgtggagtcgaataagtagctcatggcatgtgctttggagtgaggtccctcttggcttgtgatagagtttagatatttgtttccaccaaatgtcatgttaattgtgacccgcagtgttggaggaggggcctggtgggaagtgactggatcgttggggcagatttcccatgaacagctttgcaccgtccccttggtgatgagcgagttcacaggtgatctggttgtttaaaactgtgtggcacttccccctccttgctctcttgctcctgctctcaccatatgagatgtctgctccccctttgccttctgccatgattgtaagcttcttgaggccctcaccagaagcagatgctgatacagcacttcctgtacagcctgcagaactgggaggcaattaaacctcttttctttataaattactctcaggtatctctttatagcaacacaaatagcctaatactgttggaaatcccatctctatcactgaactgtatttctttagacaagttatttctctgtattatttatctcagtttcttttgtacaataaagataataataatgcctatatcataggttgttgtgagaattgactaggataatacatgtaaagtgcctatgtcattacctggcacgttgtaaggactaacactttatttttgttgttacttaatggttgtttgcgataatttttcttcatttttaatatctttaacagctttattaagttataattgatgtacaataaactacacatattttagcatataatttgataagttttggcatatatacacccatgaaatcataaccaagataatgaagaagagaaaaaactcttaaaagttttttcatgccaccactgaactgctttctgtcactgaagattagcttttgtttccagaatttgacataaatgttattatcccttacggaatcttttctttgcctgggttcttttcctgagcataattattttgatattcatccaagttaggttgggcagtctaagggctcatgtcgcttgtttcaacagttactgtcctttgttgccttatccagtgtcttgaaaactgttttttgagtttttcaggtaggaaggtaaatccagtctttgctaccctatcttggctggaagaggaagggctatgattcattaaattaataaatgcactattcttcagttgcattatttttgtgaaatgaccaaccacttaatcagaaaagttatcttactgtatatccagactttctatttttccattcgttgaaatcgcgccaaactacttccaagatttgttacccacaaaggtgaaatcagacttaacagtgacgatcttaaaaggcatttggtatgagtagtttaaaggaccacttttcctttgaaatagacttactggtttttatagttacttgtcactcagagtgagcaccatctgtcaagattgtggaagagatggaaaaaaaatcctcagtgttcaggtttcttttctttactacgtatgtaaaattgacttttataaaataatctttttgctacgcgtaagattacactgtgaaactagaatgtttttatatttgtgtgtcttgctttccccgttattttttcattttaaagtaggactttgtgactatattgctggatcctgtggtcgctaggcatggcacccttgtgtggcagtgctattgtgtgatcttacttcatgcagcatgttgccagccctccgttgttttcttttcctacaatttcttccccttggtcttctaccttctgctgtttctttcctgacacctcatcattaaaactcacctgctgcctctacgatgcctcctccagtggggaaaccttgagcaccctaccctcagagcctgtgtccccttggtggggaatcttgcataccaaactgttttaatctcagttaataagaaaggaatagcattacttccaaatttaactcccagagcattcaaagacaaaagtaatattgctaccttttttaaaaaaaggaaaatatataaacactaataatgtctgattaggaaatcagaatcatagttggaaataattttgaggaatttcaaaatttcatcttttagtaattgaggatttcttaaaagtagttgtctcatgtcacttgattttgattcaaacaatagggaaaacagccccaataagtaattattgttaatgatttgatgcctgccatttagaaatttttaaatgcatacactgatatattcatacatacatacatacatagattttttccctaaaattattatattatacattctcttctgcagcttgctattttgatttaatgttaggttttagatacctttccttttcacttacaactcttacaaaaaacttctgttttaccataaaaccttctcctggcttttagtttgagatatacttccttaatcatgttaaggaactctcttgaaatgttgataatactacattttttgatactggaattatttagatagattttccattgttgacagagtctagcttttctggaatgaactgtacatggtagtggtatattattctttcatgctaaattgtaattctggattctgtatatgcttaaattggaatggtattttatgcatccatttttatagatgagattattagcccttaacattttaaaaggtatgtggaaatcttagtattaatttttagagatagggtcttaccctgtaacctggaactcctgggctcaactgatcttcccatctcggcattccaagtagctgggattacaggtatgccctaccacacctggctggttttttaaaaaaatttttgtggagatgagtgtcttgctatattgcccaggctggtcttgagctcctgggctcaaacgattttcccacctcagcttcccaaagtgctggcattacaggtgttgtataatacatttcttttaagaggtgattttatcccattttcacattctttacttggggaagaaaaccacatggcaaacatattttataaacccattgtcttccagacttgtttcttgtcctctatgttctataagctattgttcttgagtcttgccagtgtataaggtgacaggttttgtttccatggtgctatgttgtaagttcagtgtttatgtttttctgtgcatatcacataaagatccttttttaaaaaaagtttagtgtttcattacttgcatttttctttagatgtggcgctgcaaagtgagtcagtaacctttgttgagtttcgaaaaaataatgacctgttacagtgttttgttctcgtttgttattgtttggaaaaagagtccaaaataattttattaaagtcacattactctgtagatagacataggccatatttttgagaattcacattaataacaattttgtatatgcaatactcttttttttttttttttgggagacagggtcttactctgtcatctgcagtctcagctcactgcaacctctgcctctggggttcagtggattcttgtgcttcgctttctcaagtagctgggattacaggcgtccgccaccacacccggctaatgtttttgcaattttagtagagatagggtttcaccatgttggccaggctggtttcaaactcctggtctcaagtgatccgcctgccttggccttccaaaatgctgagattataggcatgagccaccgcgctcgacctgttcctaatttttttttcaaattttgaaatgcagataatattatgtaccccattagcttatggggtacgtaaaggaaatttgtatttgatattggctctggttattacttttgtccttccatggacaatcacttaaaacctttaatgcatgaagctgtattttagaaagctattttggtactagtctcaaaggatagattgctctatctttcccaccctaatgaaactaggtcactggcatttggcacatctccatgatgtgagatttgatgttcagatgtgctgtctagaaatgataatgcattgtcagcaagaccacttttcatttcatcaacataatttccactgccctggaatcaatttattccttgacctgttaataattacacttgatcactagcatttcagtggcagagaaagcctctggaaatggccatagtcatccttttgggtgataagttatgggatttctgttcggcttggagatttggcctgttgaagtggttgacattttatgaaaacaaaggagcaaacttttacctgatgccgtgttaagattcactctgtcaagtggttgagaacacttatttaattatctaactgtacttttgcattacctttttttatggccaactttaaacatgcctagggaagttcccgttctattcccagccagaagcaagtgtttgaaaaatgagaaatcaccatagagctcctctaagattaatttttcacaggtccaagaatgcctaatatttaaaatgagctactttgaaatcagtcatgtatcacatcagtgtttcaaaaagagattgagaaaatatgggctgttacaaaaccactaacctcacctgttgctccgtggtgatttggagccctggagcagggctgcctggatctgaaactttgctctgtggccttttgggaaagtgacttgcctctctgtgtttctgtcctaatccttaagtgcaagagtggtcatgcatattttatagtggcattgggaggatgacaggaatgaatacatgtagaaggctttgaaagggttctggtagatcaccacccagtgtgtgttgtactagtcatcattgttactgtaacttaatgtgttttagtgttaatggatgtccttttttctcttttgctatcccagccccttccttgcctaattgttactctcttctgtgtggttaggagcaactagttcagtttaatttcccttagagagcaagtttcagatatagcatcattttgaactactaaggaagtttaattctcctaggattggtcatatagccttctttagcaaaattgaacaggaaccttaggtgaagcttggttagccaggtttatggatctggggccttttctatgctttaattttatatatttgactgtttagtagatgtttatcttccttatctgaagttcactttcatcttgttgttgttaacctacataaagatttatttaatgtggattaagtcctctgttatttagaaatataaattgagttgccaatctgatatttactttctcaatttttatacacttgactttgcagttatacattttttgctaattattcataaggcttacaactactactagtaattcaacagaaaataagtactgtattgtaaaatcctaaaggatttgagtttttaattcaagtatattaagaacacatccttaggtattgaaataagaaccttataacatcctgtcatcttccagtttgcagtttcacctctttgctagtgctgatgaggtcattgatgtgtcatcataacactctgagtgccagtagggaaggaactgtttcatttgattgactactgtattaacagtatctagcccattgctcattacatgataggtgcttagtaaatatttgttaaatgaaataaaatgattttctctatattttgtattttctaggatttttaggaggcatacccagaaaataggcttatatattttttttggatttgtttctgctaataatcagtatgctttgcacgtttgtattctgtttccatttcttttgttgctgtagtttgcttttcaataggcacagtttcagtacctgtttccctgccctacataacaccttgagagagaccttctcttgtgtgcccgttatttttaatccttagactcaaaagaacagattgtctttcttaaattcaaatatacctggtcagcccttttccacctctgagaagagagaaaagaaagtatattaagattctggaattatttgtgttttatggctgtgcagaattaaagtggcaaaaattgttcgtcaaagagctcagatccttttaagatgcaaaccactgaatttgtttgtcagtgattgctctggaactggaggtatccccctgccaatgcctggtttgggggccactgtgtaattattttttactgatttgcctcatgaatgtacacatatgcatgttatttttgatgccttaaaaacatctgttataaagacagagggttttaaatacttcaatttggtacctttattttgagcgaccttaaataaatgtaacattttcaatgccagttgatattgcagaaatctaaattgctgttcaaatatgtgaaatttatcatagtttttcaactattttcacttacagtgctaattaatagccactgaaccttaacactttcatactagtcagttatagtggaatcctgtcatcaccaatagctcctatagcagctattaggagataactgtgttacaaggaatacctggaagagttttctctttgatgtttatactaagtactcaagtgaagggtgttgtacaccatgactatagtgaacctttttgtgtgcatgtgtgtgtttttaaccttgccggcatcttaatccccctttccaaatctctgggtccctgctgagtttcagcagctttgtctctgcccagggcagcagggtccttatcagaagtgggcctctcgggtgtggcttggggcttcagtcctgcttcatggtgtcttactggtttttgccctttttgaacataattcttcagcattcctggtagtttcgggggccacccaaaaacctttcagcaaattcttcttcagctaaagttggtatccattgctagctgccaagaaacttgactgatacagctgtgtattgttctgttctcctaaatcccagtcagtgatgtatattgatgctaaagtacaaatgttatgtagtcagtattttgctctcctatttctttagagtatgttctatgcctactaggtcttacttgattttacagtgaagttttttttggtttgtaagtttgtgaaatatattcagctataattattttattgagtactgcttatgcaccagatacttgttagtaatggctggaaatacagtagtaaacagagacaaacccccagccttcatagagcttacattcgaggaggcagacggatacataaaatatatactatgttagaccatagtaaatgtggtgatggaaaaattaagcagaagatgggagaaagaatgtgaatgagaaggttattagaatgggtatcgggtgttttcagatgaatcctgatggtcttaagacagaggtgggagggtgctgggcactgctcccatttctgctgggccgaatggaggcccagggaggagcaaggcagacgcacagtgctctcggcttcaggatttcccttgactcctaagatgtgctgattggcccaggacactgacgggatgtgtagaaagcaacattttaaaagagtagcaagctgggggagcatgagagcaccttaagtgtacttcagcaggcacaggtgtagtgggattaaataggcaattattgtgggatgaagtttaaaagtacatttggatacaagaattgacattttaaatactttactataaaaattgaagcacatggcctattaaatctggaccatatgttcgttatcctaatgtctattttagttgtgacaccacataaagaatgtgtaggagcaccagcttttagaataacacaatttccagggggagctgctgttgtgtttccttatttaacatacaaaagcatttgatgcctgatactcacatgcttgtgcaatatatatagaaaagtcttggaattatagaaaattagaagcatatttaggccgggtacggtagctcatgcctgtaatcccagcactttgggaggccgaggcgggtggatcacctgaggtcaagagttccagaccagtctggccaacatgttgaaactccgtctatactaaaaatacaaagaattagccgggcgtggtggcgggcgcctgtaataccagctgctcaggaggctgaggcaggagaatcgcttgaacctgggaggcggaggctgcagtgagctgagattgcgccattgcactccagcctgggcaacaaaagcgaaacttctcaaaaacaacaacaacaaagcatattgaagattttgtattgcattatagaaggactaatataatatcttattatgcagaaaggctacatatatttgaagtaattgtcataggacaagccctactaaacgtagtcttctttcctcacttacattttttactaaatgccttagactgaatatttatttttgtcactgtgaatattaaagaaaactaagcagaagcagtcttaatatcttgttgattacatttcagaaaaaaaagaaatggcagaacattaagcctgaatgccatttgctataattactctgtgtgaaatataactggtagctgtcaagctttgattgaaatttacggaaggttgacaccagctgcatgtattaattgtctctgcaagcaaatgcacataccaccattaccatttggaagcatgctcttttctattgaatttgttgtaaagcattttttgattgtgttttgatgaatgctgctctaagttcagatttatcttttgcttcgtttctagcaaacaaacaaatgtccttttagctaactcctgagtacatctatatgagggatatttccaaatttgtaacactgaccatttggagaagggaaacttaaaaattattattttaaagaagtgttttgaaacatgtttctaataaaaatttatatatcttccctatttggactattaatatttgactcattctacatgaaattcaattcatgcattagtatttttataaggtagtttgatcatattaggacagttattttttcatcctttttaattgggcagtagcaacctccaactgaaatttttctatgcatactattcataaaatatatttttaaaagcattgaaacaaacttattctttatatcaaagtgataaatacaggtgtgcaaacttatttggattgtgtacaagtgtattttggtgggtgcattgctaccttgtttggtttgataggtaccacatatggcaccgggtaggtcaaatactgattctttattcattttgatcacagtcagaattgaacaaagattctaggtgcagcacaagcagaaggtgtttattccctttttgctctacaaggggtgtctactttgagtcttacagaagccaaaacagtgtgaatataacctaaattcatctgaagacttatactgagaagtatattggtatcattggcttattgagaatctacagtagacgtttgttgctttttagctgtccaggatctattctccttcctgagaacaccccagtttctatgaggaaagcacagggctgttcccactagggaagcgaaccagggccccctccacctcctttctctttgggtgtggaactttgagtttctgcagcctggggctcttccacagggctttacagtgggaggtggagcccagcagccctggaagtctccatggagatgtgctgaccctttccctgcatgttgccagttggtctctctggtctctgtatgttatcttttggagcctccctttgatggtctctgagagtcttccaaaaatcccctttccttatgctaaccagagtcaattttagttgcttacaaccttcacaggaactttaattggcttaagaagcatatccttttaaaatctaaaatggaattttaattttagtaaaagtgttcttctggctcacttgatagagtttgatgccagtttaaactccattgctgggagacagttcttacactagctctgtagacccagccaggtaaacactttgtttctctttgtagttaggttttgaagataaggtttgtacagatctgggtatcatgtcataaagggatttggcaatgtttttttgttttgtggaatagtatttaaaattttaggaacgtttcccagagcacgagtgtttaaagccatcattggtgactggatgctgtgtgtcataaaggggtagctgaactcaaacatttcttcaactgcattttgtatcatgtagttttattaaaatgaacaaaatatatccctcttttccttctcgtaattttaaagtgacacggttagaagtataacatgactaaacttgaaacattacatttggaaattcattaatacagaataaaatgtacttttctcattaaaggcacttggtttctattgaaattagaatattactagcagaatcatatattgaaaataatttaaatgtttatctttcaatctaagtatgaactaatgaaatggaaaatttaaacgtttatatttagatctgtcactacatagtttttgtattagactactgtctgtctctatcatattttcactgtaggccttccagacacgtaagtgtttctgtgaattaatctatgttttatgagggagttcatgaagactggtttcttagatgcttagaaaatattaattatctggcttggcgtggtggctcacgcctataatgccagcactttgggaggctgaggcaggcggatcacgaggtcaggagttcgagaccagcctggccaatatggtgaaaccccatctctactaaaaatacaaaaattagctgggcatggtggcgcacgcctgtagtccgagctcctcaggaggctgaggcagaagaatcgtttgaacccaggaggtgaaggttgcagttagccaagatcgcaccactgtgctccagcctgggtgacagagcgagactccatctcaaaaaaaaaaagaaagtgttaattatctgaatcataccacctcagtaggataaaccttgatataatagtagtcatgccagcatcttgttttatattcttgtctattaaatacatgcttagatattgtattatgcatatccttgaatatatttagaagcatcacaattgaatatgtatggatttacctcaaagaagactgggaaatagttacaactggcatattgtcataaaaactagaagtattatgggttttaaaaaataggtctatgggccgggcgtggtggctcacgcctgtaatcttagcactttcggaggctgagggaggtagattgcctgagctcaggagtttgagaccagcctgggcaacacggtgaaaccccatctgtactaaaatacaaaaattagctggatgtggcagcgtgcgcctgtagtcccagctactcaggaggctgaggcaggagaatcgcttgaacctggaaggccgaggttgcagtgagccgagatggcgccactgcacttcagcctgggcagcagagtgagactccgtctcttaaaaaaaaaaaaatgtctaggaagtgttatgtttttctcagtgtgtgtgtggtccttgcactttcatatggctgcaaacactttaaattttgtgccctcccaacatagatatgagttatgttggaatgagtttattttaaaccagagtatgttctcattatagaaatgttacataggatgagaagacctatggaatactgctgaagcctaatttaacccaaagtttaggtggagcactttgtgctttcatgtataaaagaaaactgtttctgcgtgaataaagttttaatggtaaaaagctactgaatttggaatgatgatgtttattacgattgttggtccttgagtggaggttgactctgtggggttttagtctggtcttcattttttctgcttgagaacatcctcctggtcatctggagttaatgtatgaagaccagagcagcccgtagctgaaactggaagttaggaggatagatctgtgagtccagaattaggggctctgggcaaaagtgcaatatctgtgggtggaggggctggaaccagcaaatccgcgttgtcatcttccaacaactcatatggaaaaggtggtagtagtgttaggtgaaggaatgcatttacagagtagagaaaaggggctaggaaaggggaaatgagctccctacatcacctttctgccctgcctgcctggagtactcagtacctgagagaagaagcaaccaaatgtttctgaatcatagaccgaggctcccttaaaccactaacagcaaggatgcagcatttcagtggaatgcttttacctcttcagttgcaaccactaccaagggagaatgctgtgtactccctgtggtagcttcatacttgctttccacttgcggaagactctgaggggcaagcagatgcggcccaaaggaataaaagtgcaggcaactgaagacatacattggaaaaccttgagttaacctactcggctgttagagccattaaacaagagcaagacaccgtaagaagggagcaggtgaatggtgaaaatgaaaaacatgggcctcatcctacattgtaaaggtttagagttaaggagacagggtttaaaccattaactaattgtgtgacaggctgctaattatggcaaggtacttgggtctctgatcttttctttctctgtaaaatgaaggtgatgatagtatctgtattgcaaagtttttttttaaagacattatatttgttaccttttaaagactgctttgtaaactggaaagtgccatacacatgttagttatcccatggctttttacattagtagctggggcacctttctagggcatgcattgctagttctaagtttcaatgatgcatctgtaggctaagctgacacttccctttctgccatctggactgataatcaagagacctggattatagtactggagatctggttttgctcctgagtagctttgtgcttctcagacttctcaccaaaatataacatacacacacggagtgcactagcagtctgtcacatgggcatactttgtctaaaatgtcagtttaataattttttataaagtttgctatctaacccttaaaatatatgtttatgttcaactatacatacctctaagttacctgtgattaagattgcctgagcctgttcctttatgtgccccagtcataggggcatacacacccaactcttgaatttttattacttgttaaagaagagtactggactctgtgaggcctggtgtacctttctggaccattattctgtgaacctgtgtagcagatattgcaaagaactcttgacctggttacaaaatcaaattatatgacactcatttttatcaactggtttctagatattgtgtaatccttacccatatgagccagttatagagggctttgctcagggtttattattgtagaggccacaaattaaccaatgttattggcttacagatatttttgaaggttggccatcaagtacatgacctttcattgtggtctttaccctacttttgtgtgtgattgtaactttcctttattttttatttttatttatttatttatttatttatttattttgagatggagtctcacactgttacccaggctggagtgcagtggcgtgatcttggctcactgcaacctctgcctcccaggttcaagcgattctcctgcctcagcctcccaagtagctgggattacaggcgtctgccaccacgcccagctaattttttgtatttttagtagaggcggcttttcaccatgttggccaggctggtctcaaacttctgaccttgtgattcacccgcctcagcctcccaaagtgctgggattacacgcatgagccaccgtgcccggccgtaactttcctttataagcttaaaaatcattaaggctctgggtcaagaaagcagactagttactgagcattgtcatctgccttctcattttaaggcttcaccaaaatgaaaacataaactataaaagagaaaaaaaaaggtataattacaaacatgaataccaaagaaaacgggaaaggaggcatcaacaaatgagatatataactctttaggaagaggggattgattttacagatgagacgggttgaaaagccctagcctaaatgtactgcaaagaggtttctgaagatatgcaagttttcagaaaaactgacttctttagacatgagacgaaattcagaaaactaagactcctgatgatatggattttgatgttgcacaataaaatccttctcattctgtggagtctactgctcgatagtcagactgttttctgttcatatcaagtaaagcctgcctattggggcaaatagagttcagaattcccccttaagggaggaggccctcccccaaaatatgccaactgacacgagtggaggagaacagttcccactctcctggtgttactatcttaaagaacacataaccaagaggtcatggagtacatgaggagaattgacagtgtgaaagaaaaacaactgagccttaaggaaacagctaatacagaaacaatgatattacaaaaaagagctattaggttttttttaaaggattgctgaaatgaaaatttaagtagaaatgtgagaaaatgaagttgaagtaaccttctaaaatgtagagcaaagaccaaaaaaaaaaaaaaatgcaagagcaaatatgtggggaattaacctctgaggtttgacatttgacttaatgaagctagagaaaaggaaagagaggagaggaaattatcaaaatagtggaggaagataattcccagagatggaaaagacacacatctttatattaaaaagacccactgaaagccagaacagttaatgaaaaagagtcactgtgggtgtgtatttgtgaaatttcagtgctcggaggattaagagaagatcataaaagatttcagagaggaagaaaaacaagttgcctgtgtgtgaagaagtattaagctggcatcagttgtttcatcagcaacatggatgctataagcattgcctacaaaacccaaaggtaaatacacttttaaacctagaattctgtacctgaggtgtatatagatatatatgagatagcaaagatatgtctagatataagatagcaaagttaagacattttcagatgtgcaaggcctagaaaagttagcttcccaaatacctctttttgctttttagagataggatcccactattttgtccaagctgttctcagtctcaaactcctgggctcaagcagtcttcctgccgtgggctcccaaagtgctgggattatagttgtgagccaccatgcccagcctcccaaatacatttatcagaaagatagttgagtatgtactccaggaaaacaaagtaataaccaagaaagagagacttggccttcaggaattagaggaaccaacctaattgcacagtcaaagcaggtctttgaggtaataatggctatacaatagtccagaaaacagccattccaaattggaacaggagtacaaaagactcttgaagcaaaacaatggttgacaacttggggataacatctatctccacttcaaccttatgctcccagaaaaaaagcaattagaaatcctaggagaacctccactcatgcctcagtttgtaggggaaggtcaggcttttaagcaatcagcaagaaaagtgggtccatttaatcttaaaactagatttttaaaatttattgtagtggtcagattatgacattagatttgtaaagaatgaaatgtaattttagtatacctcttggcctggtattaaattgtgtatatacacacacacatataacacatatatgtgtgtgtatatataatattgcagatactgattactgattttcaacacagctagtctgtgataaagtcttgatagtggttataatcttgatgttataggaaaagtgaagcttacctaaggtgggttgtggaagctcagaggaaaagtgtgttgtggctccagtatcagtgagaaattgatatacatggtggacttggtgaaacagagaatgtaatcatattctgtatacttacaatcacaactagtagaagagctaaaaattgggagaggcagttgaagattagtgtagatgagctaaattctaatttttaaatttaggagaatcagtagacattatgtaaaattattaaatccagaaacctagatacaagtttactatttagggatatagagatgactaccagaagaatgaaatacaagaatagtcagaaaatttattctgaggaatgggtcatggtatagggagggaatgtggaaacagaaattctctagtgttattggatttattctacatttacatattttgagaaaacaaaacacttaaaatatttcctaatttggcgtttcactaatctagacctataatgaagttttgttaaagagttagtttaaataattgtctgaactctttgatactagccttaaataaaataatatgaaaactttttcttcacacttggcttttaaaactgagttattttggataacgacaacaaaaagtcacatgaacaattatttttcccattattaaacctaacactttttcctgaaaacatttgtgcttttttactattagttgtatagatatagaaacaagtgaatacagctcacttttaataagtgtgaaattcagccctgaatctggtagactaagtcattgatgacacaaatcatatcctgtggtaaaccatggtatagaagtgaggatggggcttcagaatcctttccaacagtgtattccaagcatcaaatagacatttggtcatttgcagttgactcaaaagcaaagacctagtttgcgttcttggcactgttctgcttctactctaaagataacccatagtagagtgacctggggagaacatgtggagtaccatcttaaaacacagcaacactgcagtaactgcagcagaacaaaagtgcctgcaacactcaagaaacatacctgttgccatggccacttgcaacttttgtggcctgtaagtgagatcgataattcctatttatccctccccaagcaaatttctactatatgactatatctgaaagttctgtgattttttcatcctggcagaaacaacttattcacaaaacaggcagctggttcactgaccatagtttgccagcccttgatggagtagttacggagttttgaactagatcacctaggcatgaatgttgtccccaccccacgcccccaccccactccaattgtgggacttcgttttctaatctttagtgttaccgtaatggatgtgtcagtgccatagagttttgtgaggattaaatggagtgtataaagtgcttgagaatggtgcctggctcatagcaactgctttttaagttttataatagctgttattgaaatagggtacaagtggctaagtttactctcatatgctggctcagcctggtcacagtgtttggggccatgttcatgttcagtggaaataatgctgtctgattagctgtgttggaggggcgagggaagaccgtaatagctggtctaggtctttggtacctcttgcagatgatcctgtcatcctcagataacctcttcatgattaggaatgcaatactacattaaaatatttctattagaaagcagatttaattcaaaattatctcaggtacactgggttttacagaaacataactgatgtaaatttaaggttggcgagtaatggatgtataaactactctttaatgatgttagttaactcgaatttatcttgatgacattttgcaaaaataatatttaaagaacaaagcagtttgttgaacagtatgaactaagtggagtataaacatgaaatgcttttatttttctctagttattgccttcaactgaacttttaaaaatctttttttcccattggtttatgtgttgttgactgactcagtaactttctagtcatttttggttattcaagagaaaggtgcctgcttaatttggctcagttcaaaacttcattctcaagtctaattcaaaagtaccctttttctatttccagagaaatagaaagtaacagagtaacagagaccaaatgtgtctttctactttaaattactagagaattgggcaaatatatggaacagctgttttcatacactggattacaggtagcacagttctgtgatcctgagagaaaataatctactaagggaagtcctaaaatcactgctgctttctgcctagaggcattttccagactacagtgaaagaaagaggaacctaggaattctgaggaggctgaagtggattaatatgtgagatacaacacaggataggaagtagctacacagaagaacagaaatttgcacgagggtgaccttgagttggttggtgattgccaagatgtgctttcatttgataaaactcaacaaagccacaaaggaactaccagagaaagagaactgtaagcagactaattcccagagttcacacagaagtgaactgggaacatttaaaattctgaatagcagattaaagaggctttgtaggacaccctgaagaaagtagaaacccagaaggattatgctttggtagggccatactatccttaaaataaagaattctctaggcctgtcttaacaaagcttagaaacaagtcccaaaaggatccacctgcttggcaaagaatttaactgcctttggtacatcattcaatatgctttgaagaaatacagcataatccagcacagaacaaaattacataatatctagcaaccaataaaaaagtagtagagatgatgaagcaggaaaatacgacccaggagcagaagcagtcagtagaaacagagatgatggaattggcagaaaaggatctcaaagccacgactacgtttatactcaaggatttaaaagaaaaaaactaataagagaaatggaagatataaaacaactatttgagatgtctaggggtaaaatgtacaatctctgaagtgaaaattttgctgcatttatttacttcagaaattgtaaattttggaagtaacagcagattaggtactgtagaagaaaagtttagtgaatctgaagacacagaaatagacaccgtggaaaccagagtacacaaagaaaaaagacctaaaaactataacgaacagagcctcagtgacctgggtctattgtatatacatattatcaagtggtccagtggatataacagtagaagtggggaaagaaagaatattttaaaaagtaatggccaaaacttccccaaattgagtgaaaattaatttttacttctgcaagacttctattgtacataatgaattaacttctgtcctgtgcatctaagaggtatatgtaccatcattgggatattttaaagtattcatattatttcctgttagctgtattctctcataaagccctagctgagaaaggccactgttgatcaaccactaaaaatggagagaaatacagctagtaagccagtagtgaggatagaatggaatactaaaaacactcattccaaagaagacaggaaaagaaagaagagcaagtaacaacaggtgataaaaatggaaaacaacaagatggtaagtttaaactcatgtggatagttacattaaatgtaaattttgtatacaatacagttagaaggaagagattgtcagattaaaccagtagattcaatggcatgctgtttataaaagacacactttaaccataaacatacagtataggtttaaaactaaaaggatagaaggagatatgccatgctaacaatagaaaagaaagctggagcagctatgttaacaccagacaaactaggcttcaagacaagaaatattacctaagataaagaagggatgtttcataacaatagaacttcaatatacatagaatgaaaatttccagaaataaaaggaaaaataaataaatcaactgttttggttggagattacataattgatagagcaagtaaaaagaaaatcagtgagaatatagaaaactttaggtgtattaggaaacaatttgacctaacattttcggagaactcaacagaagaacagaattcacgttcaaaatgcacgtggaatatttatcagaataaaatgatggaccatgaaacctcaaatttaaaaaactgacataagaatatattctctgacaccagtggaattaaattagaaataaaaaaccgaaagacatatttaaaatctccagataattggaaaataaaagaatatacttctaagtagtctgtgggtcaagtaagaaatcacaagagcaatttgaatgtatttttgaatttagtgaaaatgaaaacattaaattttgtgggatgtagataaaacaatgcttgaaggaaattataactttaaaatcttaggaaaaaaggtctagaatcagtgatctaaacttttaccttaaaagaggaaactagtgaaataggttatgcacaaatagagaacaatcagtaaaaccaaagctgattctttgaaaatgtttaaaaaaaaaaagccaacctgatcaaggaaatgaaaggtggtaggtcagaggtgaggtcagagggagacaggacacaaatgaccaaaatcaggattgaaagatcattcaccactacaaatcctacgacatttaaacagtagaaagagaatattatgagaaacattataggagcaaattcaccaacttgcaagacacaattaccaaaacatgacatgagaatagggaatctgaatacttctgtacttttttaagaaattgaatttgtaattaagaatttttccacaaagaaagctctgagcagatagcttcactagtgagttcagtcagccatttaaggaagaaatattatcatttctactccaactgtttcagaaaatagagagcatacttccagactcatggtttgaggccaggccagcattaccttcctaccaaatacaaaaatagttaatgaaagatatatacagacaagcatccctcatgaaaacaggtgtaaaagtcctaacaaaattttagcatatcaaatccaataattcataaaaagataatacatcataaccaagcaggatttatctcatttataaatcaatacaattcacaattttaacagaaacaagaattgtgtggtcatctcaatgttcacagaaaaagcattggacagaatttaatattgactcatgatttcttaaaaatttcataaaatagaaacaaaaggatacttcctcaaactgacagaaggcctttacaaaacatttacagttagcatatttagtgatgaaaaactatatgcttttctgctaaaaggggaagtaaacaagcctgtccactctcgtcactcttatccaacattgtcccataggtttttgccagtgcaataagtgagcaaaagaaataaaagacatacagaggctgggcacggtggcccacacctgtaatctcagcactttgggaggccatggcgggtggatcacctgaagtcaggagtttgagaccagcctgaccaacatggtgaaaccccatctctaacaaaatacaaaaattagccaggtgtggtggtgcatgcctgtagtcccagctacttgggaggttggggcaggagaatcccttaacccaggaggtggaggtttgcagtgagccgagatcacacgattgcactccatcctgggctacaagagtataagagtgaaactccatctcaaaaagaaaaaagaaaaatacagaatggaaagaagaatttaaacactgtcttcacacatgtcatgatatgttcagataaaattttaaagagtctaccaaaacacttttggaactaataagtgaattaagcagggtcattggatacaagttcaaaatataaaatgaattgtggttctatgtactagcaatgaccattgcaaagtaaatttttaaaaatcactaaaatttacaatagcattaaaaaccatgaaatactttaaatttaacacaatatttgcaagatctgtagactcaaaactaccaaacatgactgagcaaaaatgaaagaagacttaaatggagacataatgtgttcgtggatcagaagatgaagtattttgaagatgtcctttctctttgaactaatctgtagatgcagtgcaatcctggataatatacttacagcgatttttgtgtacaatggcaaggtggttctaaaattttgatggaaatgcaaagagcaaagttggtagattaaacactacctgatttcaagacttactataaaggtacagaaatcaagacaccaggatactagtgtgagaacagacataacagagccatggaacaaaatagaaattccagaaatagacctgcacatacatatatgatgagggacccattggtggcaaggggctgtgatctgtttgttattctcctccactttcaagggagtggcagtcctctccaggacccccttcaccccattctagatcttgattccttctctctgttggggtgggaggaggctggatcaagaggctcctcgcactgctgctgctcctgttctctgggtggcatgtgtccattgctggctctcctatggtttctgttggtgccaccgctccctgaggtaggaggtctgactacagatccccatcttgcactgccactcgtctctggcagtgcccagtagtctctgtggcagagtctctagtagtctctgtggcagagactactagctgtttccaaataatggctggatctttcttccttttagtaataatactgctaccctggttcagatccagctagatcaacgtaaccattttagctctacataaccattttagcctcccatatagcttggagatggccttatggcaaagtttctgcccacatagatggctgcaatgtgaactggagaacattctcatcaacctcagagacaagagcaacacccagcgggtggcagaacaacacgagagataacccaagaatacctacaagtttgggatattttaaaaggagagagaagctttgatgttttttaagcctatgttatttttgtccgctgaataatcgtaactcatgtctttgcctcataggctgtctctctgtgtaagggtctggcaaggtagctgcagcccaggtaccttccatgatgttgaggagagactctcctatcctcaccacaccagagagtaggtatgcaggttgccaccagtgttctcctccctacccactccctcacttttcttttcattggttcagtagaaggaggggctgtgcagtaagtctgccgcttgagcacagggacagctgtcactgcagtgctggtctcctgttcttggaggcacctcagtctccttgacctcttagacaccctcctacccccaaggtggggaaggagcaagcagaggcaaaatcccagccctccttgttaagactacagtgactttcctcctctcccttctccgtgtccgtaatgcatagctggaaggaagtgtctgggtggtgatgccagtagctgtgctggtgccatgccaggtgctcttcatgagcaccaaaggagggcaggctcaggtttgttgctgtctttagaatctggggttctcgatagtctttgccctcaggttggatctcagtctccagattgtgggtagcaggtcagtcccacttcctgtctcattacaagatgtcatatttcagaataatcttgttaatggttttattaacaaatgttattttaggacagatttcatgaagtgttattttatgccactaaataaatcataagcttaattgctacagtctgggtagaagcatatttgttttacagtataagcctcactaactgatttaatggagtagccaaaagcaatttcaagtacttccatatattacaaatgatcaatctttgttgtttctaagataagatataactgaaataaaatgtttacatgacattatttaaatttaattatatttaattcctataaaatggaagataaaatgccagaacttagagcttatgtatttttaaaatagagctgcgtaacttatagagcctcaattcatgagcaactagcttgctttttgaaaatgaaaaagagaaaaaagatgacagtttccaagttaattcacattatacttttgattataaataataaatgtcatttctaaatgatcactttgctgtgtaccaagttagcacttgatagttgaaaataaaaattattttatgactactaacttgtaaggaggcagtataaatagcttttatatgaaaaaatagatatatatgcccaggcatatttaatcactaaaaattgcttatcaggacagtcatggaaatatccttctgtaacagtttctctcagatctatttcagacttatgcatctgttactatatttatctttatcttaatcagcccttgctgtgaggtttggttattttattacaagcagctgggcaaagctttttcttttaaaaactacattcttttgtagtgctgccatcactcacattacacacttggacagcaaaagcacgtaaacagtagaactagatgaaatacttgatgtcactatatttcatgatactgtaacagaaaccactccttcgggacgatataacatgaaagcattacaatttttaaaaatcttaacaaaagatacagtcagtgtatggatgatcgctcttagagtttttgaacatgaaacttcttttcttatgctgggtttaactgtgactatatttactcatctgagggttaatatcatgccaacatttaactagtttgctctgatactaatatatacatactagtgtttagtgactttataagattattagaagtctacaattccaaacctctggccgagatgagaactttttaaatatataaacccttttataaatctaaccttacactttattccaactttggtatgacagtttgaaatgttttcaattccaggctataaattccagattcagttttcctttgagtttatgctgtataccaggtcctggggtaggaattattccattgtctcttagttttatgtcaagtctaaaaggtaggttactcccatatcaaaaatatggaaactgagtcttagaaccttttccaaggtcacataggtaattaaggatatattgattgtcccattctgccatttaggatttttgttagttaagagatgtgctgtgatattaggaaaatgatgttcagtgtaaacatattgttgcattgatgtcatacgaatggttgccaatataggcagttcttgacatgttttattaactgaagagatatggacagcttgctattttagattacccatctcttatgtttagaattcgtttttgtttctactatcacacttttaatttagtcttctgttacctgccctcagagctaatccagcatcttacagttaaactctggaattctatcctccatacatttatatccatgattgctaaatgaactttacatcaaaaccagtggttcacattgcttactaaagaaagcataagctcatcctggcattgaacactttattttcattgctcagttttgcccttcccatcctgtctgcaccccgtctcagccatttgaggcccctgctgttgttgggagaggccttcttgttcccagtgcccctgctcagggaagactttccgcagcttcctcccatagtgctttgtttaatcctcttacattacctttattttagccccaagttataaaatctgggaaattcaagtcaaccagtaagtttgtgcacaccatccagagatattcttcacagatgtgcagtcttcctgtgtctgctttccgggagaggcctgtgcactgaagacaattcagatttactttattaacgttctttctgtgaatttgtttatggatcaatctttaagtatgccagaaaggacattagttttatttccatcgtaattagttggaaatgtaattagttggaaatgtaattattttcactctgtacttagcttatttatttgacttaacgttaattttttcacaacatatttatagcttgtctccttaaattgtgctttatttcataccattaaaatacaattttgtatgcagaagaattacttgtattaacactttaaagtatacaaagattatccaccacatagtgatatatttagataaccttgatagactaatctgaaaggaggtgctgagtgttaattcacatggagccccacaagggggtacagaaactgcttcagtgagcagcttgcaaggctcctgatgactgcagtccttagctctctagataccaagataagggatcagagaagagccacaaacccgtgaaagtcagctcctcattacacttgacaaaaaatttggttcaatgtaaatagaaaggtgtttgttctgggctaggaggtttactgtgatgagcatgcagtacatacagccttaggcccatgaaataatactgtaggtttacctcttcttgggtgttttattataccccataatttattttctgctttcacagagtttggtgggatgtgtttataaatttaacatcataacaaaaatattatttacaagtttagtttttaggctgtaagtcatgattttctgataaatatgaatctctcaaatcagagtatctgataaatttccagagttctagttagttgctcactttacattataccatgtagaaagccctaatctgtgcatctattaaacattagaatggtaactagtaaattaattttttcaaatttcccttgagaaagaagtaatttgtcatgtagtccgaggttgcaatgtttattaggtacgagcttacttttcattctgtatttatgaaagattattgtagaatcttggtaaacttaatcatttcaaatagtgaaagggctttgtttaagaaattgtatgatgaattattctctgaagagtaatggaccctagcatactttcaaaaattttaaaccatatgttggatgtatagaaaaagacaaccaaaaaaatcactggtattaacaactactacagaagcaaaaagtttgcgtattctcattacatatacagctatatcatatgtgattatggtccagtagtaaaaatgtaaaaattaaaagattgttttggtacctccatgtcaaaaggtcaatgctactggctttgtttctttgccttaaggcttttatgatagcttttattctaatgtagtcaaaatatgtattatatccacatccactgataccttagtagtgttgcacttcaagtattcttttgctgtctatttctaatatcttgcctctttggtaatccaggtgccatcctgccctttatgctactctagctgggtggggttgggagtcagtgaagatggccacacacagtctttgttgtcatgagagagaggtagcgtagtgatggatgtggtcacactgccaatgacagcctcttgggggttctgcaaaatgagggtgatggcaccacctcagagaatttatgtgaaaattaaaagttgataaagttcttaggacagggcctggcacataataagaactagatatgtgtcacctgctgctgttttatgctttttttccaaggcatcatactaacgtgtagctcttccttgaccatatgtacaagttttgtttttaaatgcctactacttttttcctaaaaaaaaaaattcggccggctgcggtggctcaagtccgtattcccagcactttgggaggccgaggcaggcagatcacgaggtcaggagatctagaccatcctggccaagatggtgaaaccctgtctctacaaaaaatacgaaaattagctgggcatggtggcgggctcctgtagtcccagctactgaggaggcggaggcagaagaatcacttgaaccggggaggtggaggttgcagtgagccgagatcgtgccactgcactccagcctgggcaacagagcaagactccgtctcaaaaaaaagaaaatcctgaaaagtaaaaagagattaaaaaaaataaaaaggttgaccgaagattgatagattttgtcaacagcatctggagctcagttagacttgaaccgtttaacagtaaggaggcctttgaaggtactggaatgcaggaaatatttatcaaccccttaccacattataattacataatcacagcacttaaaggggcagcgtgaattattctttgcttgatcagtataagaatttatccgaagagttgctagaatagatgagggctgttgggttatgagggaatgaaagagaatgctcaggagcagcaggagtaaatggaaagtttactctatcctggcattcactcgacatttggctccctttccctttttcttttacaggctctttgggagcttatatcaatggaaaccacagcttctggcttttataatgaatacatgatcagccagtgattgacttgtatttaccattctccagtgactcctctcagaaatccagctactttgtaaatagtaaagacccatcatgagtaaatctcctatgagtattcacactctgaaaacacacagcaaaggcataaatttcaccttggcagcctctgcattatagaaagacctgtgagaggaggtgaaacttctttactggagaaagattagtttcagcttaggagagaagagctcattttcatgtcttgataagagctcagcacctcaaccatgtcattgcactccaaatgttggagcactgctgctgcacctagaggggactggcaaggagaggacatggcgacctcccggaatgttcataatggcaagcccatcctgtctaccttacctaggaggtgatagaaataagattcccaaaggtaaaatgcatctttgtggtacgtcggtaacccctggtctggaccctaggctggtgccctatctcttctgctgcagccgtgtgtggtgggctcacagctcacccatgtgctgaaggaagctgccactccacccacgagtggtttcttctctttatcaaatacttacttgcctttacaacacccaggggatgtgctgatgtgtaatattagaagtcctctagagcagaaatctgtatccctctctaagttgaaggaaacagggagctcacacttggtcatccgcagtctgacagaggcttgtcttgagggcgactctctgccgtcaaaagacggaggacatcagtgattcattaaatattggaaactagaagtttctgtttactgagctttaaatgatgggtgctgtactccagagagaagaaaacataatgagtatgtcctcaacattttcttagggttttagttgcctgagcaataaaatacgggtatgcagattacatagttgctgcaaatatgtagcagtggcaaaaaatactctgtagtgatttagaatcacatactagcaaaaatactgcttaagctaataggtcacacatctggcagctccctgggaatataagagactcacctgtctccgtgtgtggaaaaggcaaggggcaagttctcctgctgtaactgatcctcagtcaggacatgcagtgaacaagaaaatgtaataaatagacactgtgtttgctgagtgatacagtggcctttagggccctttacagaatgctttggtatgagtgtggtatcaagagaatttttcagaggagtgagaaaaacttgcacaccatggcaagctgggatgggtgagtcgtgaggagtgggtgaggtgggtgtgcactgggagggctgccatgtgctgggcagcaggtgcggtctcagacctccgggactccaggctcgccctggcaggtggaggccaggttcttgacagctcctctgtccttctgcctggagacaattttttaagtttttcattttttttccttctttctaaaagaagaatttagtggagaatacaactggaacccctgattttttttttttttcttgagacggagtctcactctgtctccaggctggagtgcaggggcactatctcagctcactgcagcctccacctcccaggttcaagcaattctcctgcctcagcctcctgaatagctgggactacaggcacgcaccaccgtgcccagctaatttttttgtatttgtagtagagatggggtttcaccatgttggcaaggatggtcttgatctcttgaccttgtgatctgcctgcctcagcttctgcaagttctgggattataggtgtgagccactgcacccggccaaaacccctgatttaaaacaattgcaaagcctttttgtttaaaatgaacacaaacagtagttgatgaatacctttttggaccaccaataaacattggttaggttcaggtgagttgaattgtctctggaatcactgtttactgctttcctttttgtttgaaccaggacataaatatatggcctgcaatcttgtctttggaaaagacataacttacacagttggaggttctcagatatcagtcattagtcaaatttattggtgatataaaagatataaggaggtagtttagcccggcctaactctcaatcatatgctttgtcaagccaccagagaagtttggtgcttgacaacgttttaaaatgaaggaggataatgttaagtcatcttatgcctgaaggtacttctggagtgaaagagcattgcagttcttgtgtgtgctttatatttcaaaatgtattttgtagctctccccaccaaaaaagttttaaaatggatttcagcttcaactnnnnnnnnnnnnnnnnnnnnagtgaagatgcaaagaattaggatgacaggtaggtcgattctaaaagataccttagtggagaatacaactggaacccctgattttttttttttttcttgagacggagtctcactctgtctccaggctggagtgcaggggcactatctcagctcactgcagcctccacctcccaggttcaagcaattctcctgcctcagcctcctgaatagctgggactacaggcacgcaccaccgtgcccagctaatttttttgtatttgtagtagagatggggtttcaccatgttggcaaggatggtcttgatctcttgaccttgtgatctgcctgcctcagcttctgcaagtactgggattataggtgtgagccactgcacccggccagaacccctgatttaaaaacaattgcaaagcctttttgtttaaaatgaacacaaacagtagttgatgaatacctttttgaacatggtctttaagtgtacttttacctgctgtattcatagtcatgagcaaaggtacagaagatatttgagtattaagtatgctttgaaagtatctcttatattgctgatcttatgtcggtgttaccaaaaaaaaactaccgaacaaacaacttttgtgtaattagctcaaagaatagccacaagggtgaggttacaggaaaagagggctttataagatgatgtgtgagatattgtttctttggtatgtcacagagccatgtgggtccagtgttccccaaaccccctcttacagaactccaggtcagtgttcagaaatattgtgttctttttttttttttttttttttttttttttttgagacaggttctctgtcgcccaggcaagagtgcagtggtgcaatcatggctcactgcagcctcaatctcccaggctcaggtgatccccccaccttagccccccaagtagctgggactacaagtgtgcatcaccaggcctggctaatttttgtattttttgtggagacagggttgtgccatgtttcctaggcttgtctcgaactcctgggctcaagtgatctgcccaccttggcctcccagagtgctggcattacaggtgtaagccaccgtgcctggcccagaaatgttgtattctttactcatttctgtttttcataatttacatggaggtatccactgcaaacatagaagcctagtcacagtatcacagtgttgaccgtgagccaaaaatgccattgtgctagcctgctaataataacagtaagtcctcgcttaacatcatcattggttcttggaaactgcaactttaaacaaaatgatgtacagcggctcctgaaatcacatccttttgttcatccttgttcctttataatgttgttgtgaggggaaatggttttgttacatgttgtttcgcttgaagtcccagtttccaggaaccaacaatgttatgtgaggacttactgtacatatataagtgcattttgatatgaaacagtgaggacaaaaactggtattataagcttaagatttacgtactagttatttaaatttccgtgtcccaccccagagctcatatatgtaatctagaccatattcccactacccctgggggcactcccgcttcccacaggcttcctttgtatcactccttttaggttgtgctttctttgtctaaaatccaatattgttaggaacttatgcccatatttttcttccttatatttctaatagttgtaggcatttttaggaaaaagttatgtcctttatcttgagatgtttttggtagactccttagagacaaaaataacacataatacagagttgaacattgaaaaataaagcctcatgcaaaggcagttaatcaaggaaagaacaggcttttcaactattggttgtccgtatgcaaaagaatgaacttcaatccatagttctcacaatatgtaaaaattgataaaaatggatcacagacttaaaatgtaaaacctaaaaacagaagtgcttagaacaaagttcagggaaaaatatctttctcattttgggttagaaatctaaggtttcttagatgagacaccaagaacatgatccacatgagaaaaaaatagaaatactggacttactgaagttaagaatgtcttttgtcaggacactgttaagagaatggaagtacgagctccagaatagaagaagatatgtgtaaatcatatttttgataaaggacttgtatccaaaatttgtagagaattctctaaactcaatagtaagaaaacaaagcaacttagttaaaacatggtcaagatatttaagcagacacttcactaaagaaaatgtaagtatggcaaatatgcacataaaaagatgctctacatcagtagtctttagggaaatacaaattaaaaccacgatgagacaatactgaacacctatagaatgactaaaattaaagactagtaaatgttggcaaggatgtagaacactgggaactttcaccaatgctagcattattggtcactaattcagagagaatactaacagtttggtggctgaaggattttggccctggaggacacaatgggatttgttttaaattggagaatagattccttgtgccagagccccatgtgtcagggaggagggagggggcaggacaagatgtgatccaaggagatggagaggctgggaattgaggtactgtaggcgtgcagctgtgagagtgagaaaaatggaccagtgggagtgggagagacaggagagatgatctgcataagagtgtgactgactgaggggcgaggcagggaaggggaatggtgctgtggcaaccacctttatggggagtgagagttagctgccccccttaccctcttgcagagtagcactatcggttgaagttgatgggtctctgcagcagtgtttctctgtccggatgtagactcagaaaaggttaaaagggtgatgcagtgtacggaggagagtttgccagccatgtgcagtgagagaggaaagaaggcttcactgcaaagaatgtggctgagctgttgcagcagtgggaggaggctgtatggaagggaattgagtgtgagtaggctgaaggattgtcggggaaaggaggcaggtaacagaagactcagctgactgtggcttaacaaggccttgggtatctttttataagaagtctgggaaggcattgctggcatggctccgctgctggcatggctccgctgcttaggcatgatggggactaccagactttccagcctgctgttttgccatcctcatcatgtggcttttcagccatagacttgtcttctattcctaactcttggattttgtgctttagaaacagcagttttccttgttaaatagtcatttatcctttatgcctattctcttaacgtttatttgcttagcttctaacttcattgtgtgcatataccacctttaaacaagtgttttgcctttggcgtgatttctgactttagccttattccttctagcatgctatttctaattcatttattagttctgtatttatgttattttggtcctcagtgtttcagttgctctgcaatcttgtttttcatttcagcgtgttcatttgccatcgcctctttgagtctcatatattgattttatgtcatctctaaattatttcatagtaagcacttctgggaacttttcttcagttattagttaggctttcttaaataaaagacggtgtctttaggatgccatgtgtgtgcctttgctgtcctcagtagggggcttgtttggtttggtttgctttgaggagtggggaggctggcctgtcttgtccagtaactatgccatgtcttttgttaatcttccacgtggttttttgtttgtttgtttttttagcatgaacctctgtcagtattcttcttcttttacacagcgagtgagctttgggttgattctggttgagggctcagaattgttgtggtgtttcttttgcttttcctctttgtctgagagaatgggaggagaggaggcaggaatcacccagcagggcgggaggccatgattcagctttgtaaatatcttttcccaggctgcctccaccgaatctgctcatatctgtttcctgtgagacacaccctttgcttaatatggtttcccagctcaggacaggggtctggcattttaggacagtaggtctctggtgtttatgggccctgctcctgtccccatccccgtcacatcttgccagctttagacaagaaggatgggcacagtccatgagtgtttttagggacagcgcaggggtcaaaggtgcactccctctagaacacaggggaggagagggccagagcaggctccccaggcttgcatcctggctccaggccctaccttaggcctccgttttctcatctgtgtggaggaagatgatagtccctacatcctggggtaggtggaaggattgaatgagataatgcccataagtcacttggcacccgtttgcttctatcagcagatgtcagctccagtcattgatgcttcatagacttctcactcaggcacttcctactcagtcatcttggtcccactgatcttgtttcatttattttcacttttgctttactttttactcaacccttgcttaattgttgggggtgattagtgattaggtgattttgatatttttcttctttctccagctttcctcttatcagataaaaaccaaaatggctgtcttctgtgggactccctgctgagaagtggggccttgtttctcaaaaagcgttctgattttaaaacttttcattggctgccattgcacccctttgtcttctcatgggaagagggtgtaatagtctcatacttttcacagttctgcccatttgccaactctgtgcctggggtaggccatgcttccccacggggctcctggggtgggccgtggttccagttcccacctgctgggcccacacttgaaatctcttgtgtgtgctcccagccctgctcttcatgcttgtgccatgcaactgtgtcacttcctctctcgttgcttttttcctccccacctctcatcccttccctctctggttattcaactaattgttgttgctctgattgagttcaaagagggtgtctaggaattagttgtgagctagctaaatagagaaatctgcaatatacattttaaatttgtaatcaatgcatattttgttttcagtgtttaaagaatttttcatttaaaatactgacagtatggcttacttttaacctttaacctctgcatctcaaataatttttcagaggtgcaccttggtaaatccattgttgccataaaccatattttgtacagtgacaatactttgatggttcttgctaggagagcagtaattaatactcgtcatgtctagaacttcccttcacacattctcctggaacaggatacaggacagggattgccccctctggaacctgccattgtgggtttagaaccctcaggacactggtaagcggagtgaaaggaagtcactgaccttccttaccaacatacttaacagtgcctgtaggaagctagttgggagatgtggatgggaaggaaaaagtgtcaacatttatatgaatttcaaatgtatcttacctctagctgtgccttaaaatgttttgaaatatgaaaactaaaaaatttgttaaaacatgtttattaaacttgcagcttaagtttatattcagtttaatataactgactacattaagtttatgtgcaaattcagtaactaggaagtctacaggtggccaattttgtgaagttatcccccaacattttattatgacagctttggccaatgttattttaactgatattctattaatactatacagtgaaccttttacaaatattggatgatttttataaattacccaactgaacctaaagaagcaatagttgttggtgaatacattcattttatatgttgtgggtagtttttcttgctggtttagatagagattttagttgttttatggtatgccttgattttacttttgtttgggatgggagggaaagatcgtttggttttgttttgtttttcttgagatatgtcttagagttttgaaaaactgactggatgttggatatgttttataatataatttgtttccagtaagttagagtttctttgctatgctaagaagaatggctcattccactttcttaatatgaaacagttgttgactagttcgttaaataacaaaatcttctaatgctgtccttttacagagtgtttgatgattttcccgatgaagagtaaagctatctagttcacctttatagctttagttatagtcaaatatcctgcttgttttaatttgctcattttgctgctcgttttctgttaaaggttacaaagaaaaaaaaaagtgggctgctccacccgggctgatctccagcaggagaccccagaaggtgcagggtgggacacatgacacatcggctcaggcccctctgcacaggttctgtgctttgtggtcagttccacatctttcacgtctcaggccttttcttgtagcactagccctaaaaactgcaagataagattgaggtgggccagcacagagaatagaaagcgaggaggaagatctgcagcgaagtgaggaggcagagtgttgtgcacccttccatcacacgggccttgccgtgtaattcatttctctccagcaacacctgcccaaccggagctgactgctgtgtgattttgttttgaagctttctgccattgtcactgcctctgataacagatgagataggtaataattcatttttccttttgttctgattacccagttatattcgtatgcttattaagtctcgctgaggcttagccctggcaaagatagctaaggagctatgggtctcaggtttctggtctctgttagtggtaggtagctgactgttaggaaaagcaggtgacttgcagaatgagacatagctaatccaccactgatttactagtgcatatggatctggtggccaccttactgctctgagccttcagttttcagatttgtcaaatgaagataattatgatagtgacctcataggattctttgaaacattataagagtaatgtattccattacatagtacctagtaagttctcaatacgtggtagttatttacctgttaataatggtgttgctatgcccagaatctttaaattttcatcatgtgccctacttttgataaagaatatcagaaacattcttgtcttcatgtccactccattctttggtcatttctaggtaacatgaaatattttcacatattatttcttttattcctgatattttactatctgataacacctggtaaacttagccagatgttttgtgtttctaacatgcagttagtaaggatttctcacttacatcttaagtcttttattagaaccctcatttaatgaaaacatgaaagttcagtttttatgaaatggagtgttcactctttattgttacagttattacagttaattcagaaacacaagaaaaacggttgatgtgagggtgtcacttccttcacttctgactgtggttggcaagtacggtgtgtttttcatgtgttgagctttccaaaaggattgttttccatagtattctctccacacttttcctcctctattattttttcaagataagtggttcacatattcttttttacttcctccttgatttggaaagaatgagggatgattttgaactttgggaaatactctctgaatgttgtcttgaaaaatactggggttttttggtaaaagaaagatgagtggaagaaaagatgctccttacagtgtgtgctgcttgatcaatctttgtcctcatggtaggcagcctctaacctgactgcctggtgttcacacagtgtaatgctgcctgtggagtgaggctggccatgttgacttagaagcaatgggacgtcacctctcagataggttgtaaaaagactatggcttccttgactcactcgccctggcaatgccttgtcaagaggcagccctgcaatgtagcttatgtgtgcaggaccgagaaggcctgccagccgtggggaagggagcctggaagcaggagagccagccaagctcttcctggattcctgaccccttagaatctatcaaagagtaagtgtttgttttaaaccactgagttttagagtaacttgtagtgcacaataaataactattatttaaatcattagacatgatgacatagtttctttcttaaacagactacatggtttatgctttaccatattcagtgtccagttgggctaggaaatattacatagttgatttgttttcaccatttaagagagtttgatttttttttaaagtataaaatgttaaatacaactcttaaggggtggaatctgtagatatcaaggtattaagtttgacattttgctttagtagttacatgatttgtctagtaaggtaaacatgaaacattatatctctggcaaatgttactgcattaaaataatgtaatcaagacttttctttagggctggcttatgtattcatgttcatttgacacaagtatatatgtattacacatacataatacatattatgtacttaccacaaaacctaataaaggaaaacctaacacaaaatctcaaaaaggaaaaaatatccagcctagccataatccttataatacatttgtagatactaatatgactttaaatcaatcacatatacttatatataatatataacatattgtctatataaataactagggattagaatgaaaaagtgcaacacatgtaagacatagttggttaggcatgttatggcatgatatttttactgtaggtaggtagatgtcttactgcagccctagtaattgatctgatacatgtatgctgctacagaagagtccattggatcccctctttctattagttttgtttctctggacagtttccatgtacctgggataggtgttatgttcagaagtctgttgggaagatctcagtttagatcaggctggccgataccacttctcttgtgtatgttgagcaactgtattgtaagattatcatttagattctgaatgtcttccttcttaggtcacttttgtgtgacccaggttgtctagaccacagaacgcacttatcgctaggcatcagctggctgttttcccactttgtgctgtgcagcatcctcctaccctggccatgaactgtagagatgttgtgtagaccttctccctcagctgcatcattgactaagacattgggcatgttgaaatgaactgtaggtcatgtcaagtttctttggttttgaacagaaaccagtgttaccaccaaaagggagctcatgggaggctaaagggcccccagagactctctcagtggcaggagactctagacctgtgccatctagtattgtagccactaaccacatgcaatgatttaaatttaaattgatcagaatgaactaaaaattaaaacttgagccatactagtcacatttcaagtgttcagtagccacatgtggctagtgacttctgtattacatagtgcaaacacaaaccctttccaccatcacagaaacttctccctggaagtacagctccagatagccttacctggaggccttcactccaatttactagcccagccattccttccattgctctgttcaagatccacgctgaaggagagagagttgattggtctgacttgagtcatgtgctcacgtcttggtcatatgggtgtgagtgagggttgggcaggagaagcctccagagacctctcagagccaccagggcaagcatctgagttcacagcctcaagacagcactcaaaggcggaggggtgcacagtgctattggtgggagctggccaagaatggacagatgcacaccatggcagtctttaaataaaagattttgaaaggaagattttgtgttcctctggtaggtaacaatacatcttcaaaattttttttaaaaagatatcacaatgtatcagcaaatatttgtttttaaaggtgcatgtaaacattgaaaaataagcgtaattttgtttttaatgattaagacttgggtgtgtatgtttctctaacagtgtgtggcataatagttgaaaaagctttctataataaatattaatgaaagctgtatcacaaaagtgtttaattgtggccagtttgcttaatttgctctggaaaaacgtttttgctgtccagccttccttccccattccagtcctgattgctaaaggcttctctaccataatccacaaagagctcaaactaatatgcttcaggcaggttctgctggggttgagccagttaggtttttctccttacatagccctctgtcttgtgcgtgcgtgtgtgcatgtgtgtgtgtgcgtgtgtgttttcattgctttacaacaggcctcagtgaataggaagcattacaacactttaaacattggtcacaaatggaaggataaatatttttatggtttttgtatgattgtgacacaatttaagactagtaaacatgccatgtttgttcacatagctcactcctctttaaccctgatgctttcattgtaaagtgagaggaagttagttttgtaagcatcaagccctgatgcatgaagaaagctcttgcctaggccatctgacacagagtcccacaggaatcagcttgcagtgggctttataatccaaagttagcattatactgcagtgtttcctcccatggttcaaggaaaaaacaacctgaagtggggcttttctatttatgagagaagatttataagtaattcaaaagtggtatttactatcagaagtcagagatcacttctaagcatatcagtaaatgccctcaatttggtatccacatacttttaacttggaagatttgttatgagcatccccctttatcagtatgacttctttctttgtgctctcttgagaagggaaaagatgaaggataaaaaaaaaaaacagaacaaaaagcttgggttttccaccgttaaatgttactaaaacatactttataatccaaagtcataaggtatggtcagttctttacacattacattgtaattgaatgtgaaatgtcaaagcttgctttagattattttaatacatgtaaatataaaaagggggaagtaacatctatatttcacattattctgtactttgaatttaggtcttttggtcttggaggaaaggggagagtagtctcagattgctgccaacatctccccatggcattgaaggttctcatggctcccaagaggcagcagggaatacaggagataaccagatattttaaacattttacttcttgccttctctggcaaaagcttgctgtgctttaagcctctgctaagacaggttgctacctcaaagtaagttgtgttttaagtagtataatcgcaggagattattacctagggagaaaaattcttgatgtcttctcaaaaagattaaatgaaggaaaaataataaacagtaatattacatttcaagtatatctttattctatccaagtgatacatgaacatgaagacattttgttgcatgatgaaaacagttttgccacttgtggtagtgtctgctaattgcctacccattttcattttcccttagtgagagagtcccagttttattctctatgctatggcaaaacactcagcaaggaaactacatttcccagcctcctccagctacacatggccaagttctaggcagtgagatgcaaacagatactgttgtccagtacttagtcagtggctttgaaaatggagcactcccttcccattcccccttttcccttcctgctatttggtttgcagacctgattgcaaggcttcagcagcctttttggaccatgagataatctgaaaggacagaagatgcagcctgagaatgacaaatgagaaacattgagggaacctggtttctaacagtggtcatttgtgatatttatgcaaccctgaaaaaactggtcccaaaattttgtttctgacttttaagctttcaagaaagtggttaaatcaaagcaataaaattagtataaaacggacactgaaaatgttggcaatccagtagcccatgtagtgaagtactgactagcaaaaaactcattccccatactcccttggtaatgctcatcctcagtgctcgtcatttgttagaaaagagaagctttgaatctcaatgcaaaatctttaaaagaattcagaacataccatatgaaatcattgctattgtaaataaacttgatcatgatgtgagcaaaagcgttacatttaaaaatgtagctccactaaaaggaatcaaggtctgaggaggaaaggtacaagatgagcttggaacattttgtgataccaggtaacaggaagttattgatgactattttggtcatgtcaaaaggacttcacagccaatctaactaagtcctcactggtcaaagatggggtagtttgagcatcaataaagattttaactgcagtgggttgtcatacatcaaataggctaaaatctataagttaattatgatttccaaagattaaaaacttaactgttcagcgttagaggatactagggaaccaccttgtaattttgaaaactagtgaataaatgaaaagagtcaaccgcttataaactagaaactcattttaatattatttacagatcacaagcaaaagaaacaaagatatccattttgagtgtttttatcctcttactttgtctgtggcttcagacagtgagtcaaagccattcactcccaggatcttgagtaccaacgaaagaaattcatttgagtgtgaacagttctcactcctgccccggcacacagctttaccgcatcaccagggagcagcagtgactcttgcctctctctctccctcctgtaccaccagacttttcatttgataagtaaacagttttgaaattctttgttaattttgctaagcattattggcattcatcttttacctataacatagcttattgtttattttcatcacattatctgtttaatgccacataggaggaaacataatctgtagctgatagattcattttctgcacatacacgtatcccctaaataattcattaagaattcaataagtaggtaattggtgtttaaaatgctaaatattatgtagaaattgtggtagactgttacatagcagtttatggggttttttttcctgccattttatcgatttgtggggaaattgattggagcttttgggtgggctaagaataaattactatttttcctatttaaaaatgatgggttctcagtattcaaatatttgcttttcagtggcttttaaaacacagaaaatttattccagaaaccatgatgagcattatctatacattgtctcatactgtccatgagctgaattttagcagtctgtgactgcacctgcagggatctcttcctccttcccattcagcccagtcaccccacaacctccagttatgcacacctgctctgttctgaatctcgatttcctgcctctcactctgcagcatcctaaccttccagttctgttcagacctcactaagtcctcaggtctggggccactcactctcaatcatttccctcttttcctctcttctctcctcacacagcctagatttcatggttctttgtgataatcactttcttacaaatgaccttagctaccttcccactaacctcataggggaattgtaaggattaaatgagtgaatactcttggagtacttgggaggatttacgtagtgttatgtagtatctgctcagtaatgtcaacggttggtattactgagctctctcctctcttcttgtacttgtctggcaaagttccagacccccaccccgatccccccaacccctgccaccagttagctagaaattgctagggatggaaaaaataatcatgctaactcatctcctgatcacacatctcaagtgtgtagttaattttgcccagcaacactgccatacttccctagtatgtttgcttttccactttctgaaatgcatgttcaaatctctttcctccatccatctgtacttcctgatgttcttggtacaaattacaggaaaccctatttcagctggcttaaacaataagaaaatactctgtagcatcacaagcagtcacagagtaaggcgtcttcaggattgataaggtcagcagcctagtgctgtctttctgctgtgccatcttcagtttggagactttgcccttgccaccttccatcatggtcacaaggtggctgccatagctctaagtatcacatttagaggtgacagcatcctggaagaagacctgtgtattcctgaatgtctttatttcagtgaagaatatctttcctagaagacccctgcagacatagctttattgaaggaagggtagggtgaatagtggtagaacaggaacaggtgacttataaaatgtggttggctgcacctgagcagctgaacagcctcagtgagcacctgtccaggtcttgctgacatttgtctaaacagtctccctaagtgatcttattcaggaccttggttttgaatgctacctgtatgatactaatcattggtaaaccttattctctgtgtccagtctcacacatgactgctccactcttatgtgtaaaagataccttatacttaccttggccagagcacagcttccccctcctccattcttgtcagtgttcataatatcggacactcacacactcaggctaaaaatctagccattagattgattttcctttctcccagcatccatttaactagcatttcagacaacacttattccaagtcctccacatctctctccctaccttgcgctgtctcggtccaagctgccatcctgttgtacttgggtgacagcagtagctgcctactgggcaccctgttctgattttgcccctatcatctcttctcccccaatcttacaaatgatctttttaaagtgcagatcaaattatgtcacttgctgctcaaaatcctccagtgcctttgtgtcactttgcctagggtaaaatgtaaacttctactccgcttacccaagctcctgtcctgctcctcctcacatcctttcctatgagccacagtggtctccttcaatgggccatactctgcctcatctttacatctttgtaccagctgagctcatcactgggtgttcttcctgatcttcatttggatgtctggttatatttcagacattggcctcacctttatcaagcaggccttctccaaccacccaatctaaattagtcatctagtgtgctgtctcagaactctcttccctgcctgaaattctctgtgtaacactcctcacagtctcttctctctggcccattgcttcttgccatttgtctttgctctccttctgcagaatggtaaggaatggtctatcttactcagcactgtgggttcagcacctaggacagtgcctggcacttgttaggttaatcaataaattatttattgaacttaaataagctttatttggaaaaagtaaaacggataaactcccattcagtttcatctgacttttttaaagagaaagaaaactaatagctctattattgtatgattcgtctttttggagagtaagcaatagaaattgactctggctaccctaaatgaaaaggaaatttattgtaagtctcctgaaatcaatagatggatagagattgaagcttagagcacaaactggaacccaggagccccagaactagacagtctataccatggcaggtctgcacgtcactgccctgtgctctttgtgagcttggcaaatctccatgccatgaggttgcccattcagactgtcagtcctggaagcagcatccagcaggccagacctgatgtagacgcctgtccagctgtgtcagggcagaggaggcagctctggctcttgggcttcagttgcagggatcctctactgtccaaggctgatacagtggagagaggggtggccaaaggggtctccaaaagcaagaccgggattttaatgggggcagtggatgttgagcagccaaaacatggccaacattcaaatcatttggggaacttgtttagaagtctctctctgagcttgttggagctccaccacaaatagtacaaacatctgcctacccccgtcttcttagttcatgaccataattctccctcaaatctctgaggaatcaaaatggaatcactggtgttaaaaataaccctgacaaatagaattgagaagcccatgaaaagagggttcttatgcttgtatgcctgataactaaaaccatcacaaaacactctgcaaaaaccacaaccttacatgaaggccattgtaaccttatacagaagacacttctgcaaggatgtctgttcaactgcctgtccagcctcaggctggcgttacttgttattgatctttgtagccaaggataattattttgaaacagttacgtaatcttcattttttcctctaaaaacctttgtcttcctttatctccctgaatatacacattgtttatggcatacgcattcctgttgcaatgctttattcccagattccttttagaggccctctccctgttttttatttaggttgacaagctcaaatcttcattagagaatgacagtcccataccactgtttctcagaagatgctctcagatgttcagtggcttcttgtccccctcagagtaaaccccaggtccttttgggcccatgggacccacaggatctgcccctgctgtgcacttcagccacactggacctccttgtgctccacaagtgaatcagttgcaattcccacaaaacctgtgcccttcgtgttcctcctggagatgcattccccagacctgtgtgggaatccttgctacctcctgcctcagctccagtgtcacctgctcagagcccttccctggccatcctgtcttaactgtgcccatccccactccatctccccccgctttcttactctctgtgtgtatttctttctttattgcgaggcttcccatgacagtgttgaacgccaggggccaggggctttgttttgttcatggatgtatccatgtaccaaaacagggtccctccatagtgatgcttcaatgagtgaaaaaatgggttgtcatctgtgaaattagttttaaaggaggaattccaaaatggtcctaaacaacaagtagacagcatgtgaggtgatgattgcaattacttacttggttatgtaaattctgttgctttaatttaagagaattatctctccacctcctgttttagagcagtgggttagtagattctgctgcctcttcagctgaatgttggagcctattagaaatgcagaaccttaggttcacctcatactcactgaatcagaacctccaagttgacacagccaaggcaaaaagccttagaaatccccttgtatattctaagcattcacacattagaaagggaagggcagtggccaaggcgctttctttcttcatagcatagtaatgcagctttggaactcagtttctgcttgctgatctggacatagcgtcatgtaggtacacgaaacttcacatagtacctttggctggtggggtgttgaaatggcagaaatattatagttgcttttctgtggaaggaaaagtgctataaatttactacccctaggaaggtttgaggcacttgttttttaaaatttatttttaactgacaaataattgtatatttatggggcacaatgtgataattttgttttcatttttatatttttagagacagatctcgctctgtcacccaggctggactgcagtggcataatcatagctcactgtagcatccacttcctaggctcaaataatcctcctgcctcagcctccgtagtcagcatgcgatgcctggctgattttgtatctctatgtgtggtagagacagagtcttgttacgttggccaggctggtctcaaactcctgggctcaagctatccccctgccccagcctcctaaagtgctgggattacaggtgtgagccaccaccatgcctggccatagtgtattgatctatgtaaacattgtagaaagagtcaatcaagctaattaacatatccacgacttcaccaacttatctttttttgtgtggtaagaacattcaaaatcatataagtacatactattattaactgtggtcgctgtgagatctttgttttttagtggaagccttgtgagctatcctgtaattttcagcttatcttcacatttctcctcatactctgtagtactatggagtatctgcaggagtgtcctgggaatgtgttacttgctgatgtcgtaatccctgagtatatagctccagcccagggagcctcagagcagatcctgaccaggagtcaggctctgcattggaagctgttgggatggacagtgtgagtttgaatagttttgtagacctctgtcaccttgaatgcattagggctgcttgtgagactgaaacaattataatttcaccaaggacaatcctatttttttaattccactgcttaatgtcatcagtcaccaagactgtttagaagtggcactttagatgaccgaataggaacagctccggtctacagctcccagcctgagctacgcagaagacgggtgatttctgcatttccatctgtggtaccaggttcatctcactagggagtgccagacagtgggcgcaggtcagtgggtgcgcgcaccgtgtgtgagccgaagcagggcgaggcattgcctcacttgggaagtgcaagaggtcagggagttgcctttcctaatcaaagaaaggggtgaccgacggcacctggaaaatcgggtcactcccacccgacccgaatactgcgcttttccgacgggcttaaaaaacggcgcaccacgagattatatcccgcacctggctcggagggtcctaccccatggagtctcgctgattgctagcacagcagtctgagatcaaactgcaaggcagcaccgaggctgggggaggggcacccaccattgcccaggcttgcttaggtaaacaaagcagccgggaagcttgaactgggtagagcccaccacagctcaaggaggcctgcgtgcctctgtaggctccacctctgggggcagggcacagacaaaaagacagcagtaacctctgcagacttaaatgtccctgtctgacagctttgaagagagcagtggttctcccagtaggcagctggagatcggagaacgggcagactgcctcctcaagtgggtccgtgacccctgagccccgagcagcctaactgggaggcaccctccagcaggggcacactgatacctcacactgcagggttctccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaactgaacagaaaaactggaaactctaaaaatcagagtgcctctcctcctccaaaggaacgcagctcctcaccagcaacggaacaaagctggacggagaatgactttgacgagctgagagaagaaggcttcagacgatcagattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgctgcgatcaactggaagaaaaggtatcagcaatggaagatgaaatgaatgaaatgaagcgagaaggaaagtttagagaaaaaagaaaaagaaacgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagacttaacagcgaatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaactggtaccagccgcttgcaaaatcatgccaaaatgtaaagaccatcgagactaggaagaaactgcatcaaccaacgagcaaaataaccagctaacatcataatgacaggatcaaattcacacataacactattaactttaaatgtaaatggactaaatgctccaattaaaagacacagactggcaaattggataaagagtcaagacccatcagtgtgctgtattcaggaagcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagaggacctaatagacatctacagaactctccaccccaaatcaacagaatatacatttttttcagcaccacaccacacctattccaaaattgaccacattcttggaagtaaagctctcctcagcaaatgtaaaataacagaaattaaaacaaactgtctctcagaccacagtgcaatcaaactagaactcaggattaagaatctcactcaaaactgctcaactacatggaaactgaacaacctgctcctaaatgactactgggtacataacgaaatgaaggcagatataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttgaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactcttccaagactaaaccacgaagaagttgaatctctgaatagaccaataacaggatgtgaaattgtggcaataatcaatagcttaccaaccaaaaagagtccaggaccagatggattcacagccgaattctaccagaggtacaaggaggaactggtaccattccttctgaaactatgccaatcaatagaaaaagagggaatcctccctaactcattttctgaggccagcatcattctgataccaaagccgggcagacacacaaccaaaaaagagaattttagaccaatatccttgatgaacatggatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcacataaacagagccaaagacaaaaaccacatgattatctcaatagatgcagaaaaggcctttgacaaaattcaacaatgcttcatgctaaaagctctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaacgacctcttcaaggagaactacaaaccgctgctcaaggaaataaacgaggacacaaacaaatggaagaacattccatgctcatgggtaggaagaatcaatatcgtgaaaatggccatactgcccaaggtaatttacagattcaatgccatccccatcaagctaccaatgcctttctttacagaattgggagaaactactttaaagttcatatggaaccaaaaaagagcccgcattgccaagtcattcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatgtttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccgtcagagaaatgcaaatcagaaccacaatgagataccatcttacaccagttagaatggcgatcattaaaaagtcaggaaacaacaggtgctggagaggatgtggagaaatgggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttagggacatggatgaaattggaaatcgtcattctcagtaaactatcccaagaacaaaaaaccaaacaccgcatattctcactcataggtgggaattgaacaatgagaccacgtggacacaggaaggggaacaatcacactctggggactgtggtgtggtggggggaggggggagggatagcagtgggagatatacctaatgctagatgacgagttagtgggtgcagcacaccagcatggcacatgtatacatacatatgtaactaacctgcacaatgtgcacatgtaccctaaaacttaaagtataataataataataataaaaaaaaagaactggcactttaggaatcctgaattcagatgcctaagggaactagcagattatatcatctaatctaatgaagcaagcctggtgtaaaatagtcaactgacagaaataggatacgctatcttcacttttacccctaactctaagttaatattggagtttgatattcagaattaagaaaaggtgaactgaagtaatttttttctagttctcctctttacatttggagcttacagtctgatgccaggcatggcatgctaactagggaggctgaggcagaaggatcatttgagcctaggaggtggatgctacagtgagctatgattgcaccaagattttggcacatctcatcttttggattgggatgtttttctgcactatttgacttccttaaccagcaagaatactgagtttcatttagtttaattatagaaaatgcgtgttcataaatttaagtactttcaagctggaaaagaatgttggcataaaaagttttgccatttggggtaactattccggagatatttgtaaaaatcttagattccatatcaatcatgtttagttgtccaatattgcattgtaacttccatttgtaaagttctttgctcatagtatcattagtaattgagaaaggcagactgaacagattatatcatttttataaaccttgaaatcatgaattttgtatgcctgaggggtggaggggacagtttactttcagtttcacacatgtaaaaatatatataattcaggccatcagtcttagatttctgcaaactgggataatttcttgccaaacaaatgttctaaaagttaaaatttcagtgggaatgagtgaatgaaatcatgtatttgtgtaatcatttaagaatgtccctttcaggaaatagtgttaggaatactttataccctatgcaaaaattaacacaaaactgatcaaagaccatagcataagaactaaaagtatacaactcttagaagaaagcataaagaaaaagctttataacattggatttggcaataatttcttggatatgacaccagtaacacaggcaacaagagaaaaaagaggtaaattggaccaaaattaaagacttttatgcatcaggcactatcaacagagtgaaaaggcaacccatgggatgggagaaaatatttgcaagtctatatctgataaaggattaatatccagaatatataaagaactcctgtaactcaacaaatgaaacaactcaagacgcaaattaaaaataggcaaataactttaaatagacatttctccaaagacaatatatggatggccaataagcacatgaaaacttaggcgctcagcatgactactcacaatgaaattgctaccaaaacaccaggggttttgtctaggtcctcctgttcactgcacagaaagcccatcactgtcacgacaagtattgccaaggaagaaggctttaatcggctgctgctgctgagatgggagctcagcctcaaattcatctccctaacccactaaaactaggggtttatatagcagggaagaaatgtaacaatgtgtaagaaaacaagaactagggaggggcaaggagtcatctggtctggtgatcagctgagttttggttctttgatactttttttgaaaggcctgaaggtccttttctggggaagaaactcaaaacagatgcaagtttcaaactttaacagcagaagggtcaatttctttgtttatccaaaaagaactgtctatgggactattgggtgggtttcaaaatgctactgcacacccattaggatggctactataaaaaaaaatagtaagtgttggtgagggtgtagagaaattggaattcttgttctctgttggtaggaatgtaaaatggtttggtgactatggaaaacattatggtgatttctcaaaaaattaaactggaattactgtatgatccagcagtcccacgctgtatatattgaaagcagaattgaaagcagggtcttgaagagatatttgtatatccatgttcatagcagcattattcacaatagccaaaaggtagagcaacccaggtatccttccaggggtgaatggataagcaaaatgtggtatatacgtacaatggaatgttattcagccttaaaaaggaatggatttctgacacatgctacaacagaggtgaatcttgaggacattacgctaagtgaaacaggtgaatcacagaaagacaaatactgaacgattccatttatatgaggcaataaagtagatggcttgtgatgtcatccaaaaagatcaagtcctggatgcagtgttagtgggtgagccacgccaagggttttcccctggttcctgtgatgcattgttttcaatgggtcagaaagttagctctcttctgcaccatacctctagcctccaccgcaggcccgccagccatctgttgtgttatgcatccagcttaagaaacaaagcatccagctgtctacccctcagcttaagggactgggtctttttcctagtgttagttaccacctacatgaccattactttgttaagtttctgcaaaaatcctcatacctcaggatcatgctataagtggaacaatatgatgaacgagtttgagcttccgggacttggaaaatgttgtttctgttgaataaaaagtgtgacattaacaatgtgggtcacatttgttaattgtgaccagtctacattaaacttttcatagaacatgagaaagaaccatttcctaatatgcttatcatgaataatatatattcattaagttcttcagtctcatcaaaattctcatcagctccatgagtaaatatagttatctgagttatatttatatctgtgttctaatcagctgccattggaagcaccataaatagcttgtcttttccatgcagcttatcccgtaagttctcagacctatctttactacactgagcaacatcattgtcgaaagttaaatttaaatttgtcaataattcattgtcttcagacacatattttctgccgtatcgagtaaacacttatataaactcaccatctctaacggcttgggcagcttaaacacgtaataactgcattttgcggtagcattattgtatttgtttgaaaacagtctgtattgaaaatattagtccttttacaattcattcagggtttctttttctaagtgttacctgtgttctaaatattaattacggttcttaacatggtttgcttaataatggcatcttaagctctgttcttccaactgaggcatactttgttaaacatgtgccttcttgtggtctttaatttttttccacttttcatagaggtgtgaacaaaaaatgattttgctttcctttaaaggaaaaatactggaggtaaattggttttttttttaagataaaatcactcatctagttttaaatgttgctaactaatgcagaaagaaaagttttaaattttgtaggtcaagtaaaacccagtgaacttgtgtagatggtgggcgtcagtttgcttttcctgctctgcaagggggcagtctgctgctcctctgcctcttggcacagccattgatagggtgagatttaggtgaatgctgatgttgaagctgttttcatttcttcttggtagacattgaggctagacctgtgttacctgcttttgcccaactttgtatttaatgagatcccgtcctcatcactggaagatactgaagtgaatacatagatggatctagtgagttaggctatcttcaacaaaataagcatcttttgctgtagaactattctgacctacatttaccctaaatcatgctaatatacccactgttttcccttggagttgaagagttaatgaactcccgaagtccctaaagtagtaagtgacaacgtcaaaaccaaatgcatggcttctgactccacacacagtggattttcctcaccagctggaaaaggggtgtgtttgtgtgagagagcgtctccgagagaagagctaacggagatgaccaggacttgcactgagaaaataccaccaggacaaagcctgttttcatgagtcattgtctggttttatttctagattaaaatgtgtttacaatgtattcgccataaaggattctttaaaagaacaggagttgaatgtctcacaatgtgttaagatttatttaagctgaaagaagaatgccaagcttggtggaactctgcctttctagtcagtggacttactggctggtactgcctatccactgctgttcacctgatggttactgatggggtgatgactgtggattggactcagtgtataccagagaggttgcaggtgatactcagtgccaaaatcacttaataaggatgtaaggttctcaagtccttttttggtgttattagttttataggggaattaagaaattagattctgttctgaagtagttttccagctactaattttaacatataaacttctggccctggtttatttttataaatgaagatatgaaacactgaagtgttaaaactaacaggtgtcaaatcattgccttttctctctctttcacccctcaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcaggtatttctcattaaatgagtttattttttctcattttaggaaacattataacactttgactaaaacagcagtcatcttgcctatggaagaagtccctggcttgcttccaagtaaagggatgcgtgggctctgtaaaactagagcagttacacaaaataaacactatgatcctgtggaattctgatgacgctttgaagatgctccaagggtcttattgtagccacactttgataaaatatcccttgacaatgcttgtcacatgtgcacaacttcctagcaaggtgttttaatttgctcaccagctgagcactctaatggaagccatagccatggaaagaaagagtgatagggctggctgtcacactgggccaccccaagtcaaaatacattgaaatatgctgttttctagtaagggactgtagtctgttgtgccagagtggacttccattgcagtggcttcacttgaaaagtgaaaagcctgcttgaaaagcagcagttgtttgtctttctgtgtgtttgcctatggtggtgtaggcgttgttttgactccattgtgcttcctcacaactacactttcaaatctagaacatgatgcgtatggctgactcaggagtgatatcagtggccgtgcactgacagtcctgctttaagcaattctttttgtcacccgttcagatatatttttcaaatatgcctttggtctgaaatcacaagattaaagggctttaaattgagagaaagagtcttcttttgctgtgtaagcagtagtgatcttctttattcctagtggagtttgaagttttataaccccctaaccatttctagagtcaaaataatttttctctctaactcagggttgcttaactcaaacaggtttcataaccttttttgtgggctgtggatctttttgggaatgccatgagattccaaattcatgcatttgattctttttaaaaatgcatgaatgctcacatttgttcagagtcttgcatccagtttcagaaagtgttcttggcactcagcacaggagcctttgctgacaaaccagtccccactctgctggtatgcacctgctgaatcggtttttaaaaccacactgcctggcattgatgcttctggtccttcttaattaacttaggagctgttagctcttttagggaaggaccattatataatttattccccacataaggtagtgcagagccatacattcagtagatgctcaataagtatttgttggattgatggaaacagagcaaataaaaaaagatttttgccttaaaaagataagattctcactacaaacttatttattcttcccaaatatgagagaagtctctacctaaagacaaattaaaggtacaagtatcaggagagtataatctgactgaatattggtgttataacttaccttggcttaaaactttatgaccagaatatacctcagttgaaagaaaggggtgtgtttaagaaaggttatgacacagttccaattctgatgatctgcagagcccgctcctggcctcctgacatggatgttcagctctctacttcagagctccctataggcagcttattagccccttagggcctgacttgctctctctcccatgatgcttctgtggccaccatgcagcaaatgccaccaccgtccacacaccgccccgcctgagaacgtgagcactgtcctctcctctgctccctccttccactgccagtgtgtcgagccgcatcccattgtgtggttacccagccgtcatcacagtccctgtgcatgtgcctttgtcacctttcattggaaggacactccttcagaatgttgattgttaaaattaattttcctccaggtcaaacaaataagaagatgttgatgtataagaagatgttgagttacttcagaaaatatgtgactgcaaaattacatgcacgagtcaccaaatgaagtttgagtggaatcacctttatttttatgtttgttactttgttgccaaatgattagtcctccagataactgaaagcttttgtaaaatcagtatttctaggtgatatctgtattatatattacttccatttatctgagaaaaaaaggcttgtaaagaagaaaaggcactggaaatgttttaaggaggaaacaaattaaatcaagcactatttctaatagcattttgaattttcctgtttttctcatggctttctaaactttacttcccaaagtgtggtctgtggaccagcagcctgggcatttcctggcagcttgttagacgtgcagaatctcaggcccatctcagacccactgagtccacatctgcattttaacaaggaggatggggatttgtgtgcatctaggagtttgacaagcaccttttcttggtcagttgacaatgaaaatggaaaaattagaggagcacaccatttaataaaatggattgattatcatgaaaaaaatggtggtggtgtctatgatatatacaaatcacagtgggaagaattatcaataagatatttgtctaacaactatagccttggaaattgtggcctttgaaaaagatttgtaaacatgatttggaagaaaatttagataggtcaaatttaataatagaaactccttgataggaaaacatgtcttttcatgcatttatccatgtcaccatccaagagtcctttgctgtgcctgttgtttagagcctaccttgtgttttaattcaaaagagcattcagttcaaaatatagcattgaattcacatttattacccataaatggtattttaggactttaaaatgtgatccaataatgaaattccatctgagggattctggtttttctgcttggtaagagtttggcttctgcaagacacaggtaacattctccttctcacaacagatatccagttcattccttgtgactcttctgcatcctgaaagacttatgtagacttcatatttatgtgtgctgtgggagcactgcttagaggacactgttgattaatccaccatcattgctgttagttgtcaaggcgaatggaggaaatatagccagtgtctgaaggagatgatatcagaaccctaccttaatcaatagcaacagcctcatccccagcccaagcttctttcaaaacccctaattggtgtggtactgaggcaaagactacctccttttccttcctctacttaacttctaggaagtgttgctgaagaacagcaagctcacagctggacatgcactacctgctcacctttaaggatccggagtttgcagcataacaaaacatgtggaatctaaataatgtgctgatgtggttgttgcagttgctctttaattacagccttgcaaggctcagaaaattttccatctagtatctgacagccattgctggctgtgcaatggatccagtggtgggaattctgaattttactgagatatacgacataatttgcataaaaaataattgaagtctgtttctttaatttgaattttagggacctgttgcaatgagagtggcaaaattagcaattaatcaagggatggaggtaggttccttaatgcttgagtttgttttgggaatggagagtggagatttaatttaaatgaaccatgtttagacttctacattttttttaaagttctaaaatatggttgtttaaatgctactattactgaaagctactgaagttccttgcaagtacgtcatttatttcattcttacagttattgctaattcagtatcacaagcacagaattcagtaattttaccagtgccctgaagcttatgacatgctcattattcttgccatccagttaacagacagatttattggctagtagttcatagaaaaccaaaataacagggcattctgtgcatttttagcatcagtattatattatacaaaacattccaagaacagctagctctttccacctttagcttctcagtgtgccttctacaaggaggcacacgcaatgcaggtataaggtgaatccattgtgtgtcctgggggtaccccagggagatgactccaaaagagtgaaggccccaggcctgggaggagggggtggtgcacatacccatttattggacttttcatggcagttattatattttgggtaacttatgggtattttgaagaaaagtgcttccttcttggtagactaaggaacctccgcatcttcctgggctgtatagcagtaaaaagagattgactttatacagtcaatactgtataacagtaaatacagtttcataaatttgcaaaagtatttgattggtttatttaaatatttacataatggtaacaataccaatagcaaataccttatatagcccttactatgtattaagcatcgtgtgtgtgtgtgtgtgtgtgtgtcgcgacataaaggcctcacctagattaactcatttaatcctcacaatactcccatttggtgagcattataattagccccttgttcagacatgcctctttgaagcacagagaggttaaataacttccccaaggtaactcagctcccaagtgagggagtcaggacgaacccaggaagcctggttctgtgtctcatgttggtcacactctgatctgctgtactatatcaaaggattgggtgctttggggataaggttattcaatttgaatttctgttgaatataccacatttcgcaaagttatttctgctgaaatggattatgtttttattctcaggtcgatttagtaacagggttagccatagaagaagcttgttatgctcaggtatgtaatgcaatcacaaattcaatgaggatgacccttacaaattatatttaccttctgtataattcaaatgaatttcactgagcaagattacccttgcgcccattccaaaatcatacaaatgggttgaaattagttgtttctgctatttgttaccagctcttatgactgattctgttccacaggaatgcctcttgtctatataatctagaaaactcttagagtaactgagtcagtcctgggtgtgcaggagctgtctctctaggcttatgctttcttttgtgggattggtcctggcctcccactgcaatgtagagaggtagaggagagtggtgatgagcgtgtgcctgccatgcaacctggggtgagactgcttggcttttcctgaacctctgatctgtctctcctgaccactgaaagttcactaatgaaattatagttttattttttacacagtcggcccttttcatctgtaagttttgcatttgtggattcaaccaagtgtaaattgaaaatattcaggaaaaaaaaagatggttgcatctgtactgaacatgtactgacttttttccttattattccctgaacaatatagtataagaactgtgtacatgccatttacattatattaggtattataaataatctagagatgatttaaagtatacaggaggatgtgcgtaggtaatatgatatgcaattttattaatatataagggacttgagcatctgcagattttggcatctgcaggaggtcctgtaaccaatcccctgcagataactgagggatgactgcatacaaattattaggtcttcctggagaggaaaaaaaaaatgttttcccttttttgtctttctctgaaagatagaactttgttttagggcatctgaaatagcaaaaaagttttgttctacctttcctgggagttggaaactgcatgagcactcgtttaaaggagcagtatctagagtgtgactctgtgcccagcttgtatatataaatcaccacctgtcattgatgagtacgtgccatgaggaaagtgaattacaaacgtcttagaaatagcctcagagcccaaagaaaaattttaaaagcacatttggccataaattacaacttactaaatgtaaacaccagaaattattcaaggtattcttcagaccacaatggaattaaactagaaatcaataaaagaaagactgctggaaaaacccaaaatattgggtgattaaacaacatccttctaaataatgttatatgtcagagatgtcttgaggaattataaagtattttgaattaaaatgaaaatacaacttctcaaagtttgtgggatatactgaaagcagtgcttagatagaaatagcattggatgtatataatagaaaagagaaaatatctaaatcgataataaccttccaccttattaggaaactagaaaaagaagagcaaaatggggtagaggaccacttggagtaagaaggatgagtttggttacataattaggagaattgttcaggtgactgatttcaaaattttagaatgtggttctaagtagttttcttagatagtgcttgataaacttttacagttgttttaacatttttgacatatttaatattttgtttttcttagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaatttttctcttaccccattctttttgaattgactaaatcattgcatgctggactttagaagaaacaaccctttcattgctgcttctatcaggcaacctctttacatggtcagtcctgtaatacagtattgaaggtgaagaatgaatccaaagactgaagccaaagaaccaaagcggacaggagacctagtgcagtgggacttgctgggacctcctcccagcaagtggtgtggtcgccgactggcctaggaaaggcgatgtttgcacacaaaggaggaaagaaaatggggcagccaggattggagcatggaaatggcttggggtcatggattaaagtggagactgttctctgcttccctaccctctgctatttgcctccaatttctgtaagggaaagaggtgaacttaacaaccctttgtcctaacaaacacctgccttcctacccaggccaggtcaagaagctgtaaacggcctccaggttgcatgcctgagtagccacacctggggagtaggcactggtgggagttgtgtgggacattgggaactggagaattcgctgtggaaaaaaggagaacattctgatgcctttaagtaatttgagatagctctactttacattcattttatcaaaccaccctgccttcctagtttgtgtcaggtctgagtctggtcatgccagagacaacgtccccgggagtgcccctgcagcaagcttcactgtggtacagcccagctgtgtccctaaggtgtcctcctttcacatttccatgtatcagataaacacccattttactgtggatttacatcctcattgtggcgacttcattgctatttgaaggcatgtaggcttcatttttttaattctgaaacttacattttttaacttaggaatttgaactcaacctcaattctaaaattcttataagaggcaaatgtggactggctggctgctgatgtctgtcctgacaaaggtaggcggtgtcttcactcatgtttggacactaaggtgagcgctattttctttatgacctttggtgctgaggctctgcggatttatgatgattgctcagctgatcatcatactataaagagggcttactaaaattcacatttggcactctctgtggtggtcgtatcgggtggcatgcatactaaacttgctgggctattcgttttgtgcgtgataatttgcacctaaaatgctggtggtggttttcatagccttttaaaggttgcagggccagtttgtcctatccatgacatgctaaataccactttctcttgaactgagcaggaaataattatgtcgttagggaaaaatattaagagtgtgctgtgtgagtcgtttctcttggattcatactctagtctactgtcactgatcgagcaccatttaatttcctaacaagttctgatgaagtcactggaatgtatctgaaagtaaagtcctgtagtgacttaaggtattgcagacttcatgtattatggcagagaaaagtgcctgtccaattctctgaataaatgtttgcctttctcttgattttactttcagtatcggtcttgctgctaagcagtcctgatcctcccccaagtcaagctcacagggctctggatagggccgtgctacctagggagggtcccctgcatgggctgctcctcttttctccagcacaccgcctgttggtgcacagagttggaaatgcagtagacgtatccatgtgttcagactaggttagagaaggctctcaaggaggatgagtgatcaagcacagatagaattcagaagatgaaagcaaaataaagaaaaaattttccgttatctcagagcatgaggcctactggttttgaagtaatttagtgctggttaatttctaacttgtctatgaaaggaaaggaaaagaggtctccaagtttctgaagttctgaggcaagagaaaagttctagtaatggccaaaataagagtcagattttctgagactgatttctgtaatgtaaaggatcatttcacgtttgctttgttcttaataatgatggatctggttttcctgttaatcattttttttgttgtttttctagcaatcaaaaattggcttgtcacaaagtgttacttttctgatagcacttttctaagtgtgaataggccaaagtagtggagtgtcgattcatggatcagcacttagaaaaagtgtgtacctgcacatgggtgtgttgctggcccgccatcggcccttttcctcacttgacctgaacttctacctctggtgatatgccctacatttgctcttattcgggctccaaggatcctggcacacacattcagaaatagttaatcatgccattatttgtctaccgatctagtaaaatattaactaatacttacatcagtacgtattgaactttatcagaatagcaatagaagttattttctcatagtatattaataactatacatgtttcacaaaaaataaaacattttaaagttagttgctaatattctggtaacacaacataagaggtacttttctgcataaatgaagcaggatacagattgtgatttggggtattttgggaggtggaaggtggctgaatcctctgttcaattgtatttgtgtctcaggctccaaaaatatcactgtttcaaatgcttgcctttggattttcacagtcttctttgggacctccagaaattcagctaccccttagagggttagcacctaataagcaacccaaaataattctcagggcagcatgagagatctggggacctggtggggaaaataaaggatgtcaaggacagaccaagacatgcacccatgtggctcaggagcagcccaggagacgcgcctgtgtggcaagacatgagatggccccttttccgggagctggcagttccctcaggggccccaaagtgagctcctaggaaccaacatgtaaggtcctttttaaaggcctaatatagaaacagtactgtgtggtgttttgatttaaggaaacattttgacaagatcactgaaaataccctctaaataagatgagtgaataagagctgggtattatggtaatactgagtaacatttatgaagccattcatacctaccagatgctttacagacactacatccccgaaaggataggcactttggttattctgtggcacagaggaagagaaaaccatagagggatcacttacccacagccccacggcatgtacatgctggagtcaggaattacacccagggctactggcccttttgtcactgttgagcttgaaaacagccaaacagcataacagaaggctgctgatacgtgtgttttcgtcaaccaagagggagtagtgtcctttgctctgatttggtcaacaattttctcattacttggaaagataccaaaagtgtgcttatcagcagatctgatgacacaggcaagtaatgtaacaattagagctaatgcccactcagcgcctcctctatcagacactgtgcgttttcacacctaataccaaaatcttatgaaatgggtttgctgatttatagtttaagaaactgaggcagcaggattcatgctgggcattctgtgttctgggttccaatgtttaacggctataccatcaagggcacggagccagtcttggtagatgtgaatgatgcttggatctgtcaagatgctagtagtgattggtgtatgtcctcacaactcagttccccctaaaaccagcaactggagtataagtgtgaagactcatggtttgatagcaatgcttgtcaaaaagggggcaagatggcctgtaatcccagcactttgggaggccgaggtgggcagatcacgaggtcaggagatcgagaccatcctggctaacatggtgaaaccccgcctctactaaaaatacaaaaattagccgggcatggtggcgggcccctgtagtcccagctactcgggaggctgaggcaggagaatggcgtgaacccaggaggtggagcttgcagtgagccgagatcgcgccaccgcattccagcctgggcgacagagcaagactccatctctaaaataaaataaaaaacaaaaagggggcaagatgtgctccctgtgggtcaagagtgtcccagacagcttttgggaagggtgacaggtgtgttgctctatttggccctggtcagactcatctggattgttgtattcagtactcagcattgcaatttcaggtggtcatagattcactctgtagttttctgtaaagcacacaggagctctttggccaagtttcagctccaccgaagtcagcgatgagaccgtggacaaagtgcctcatgtccctgagcccatttcttcatttgtagaagaatccagtagttcaggatggttttgaagacccagtcacattggatgtgatctgtataaaagtgctttatgtggtggtcgtgttttatttgtttcatatttcagaagacgggaaggtgggtctcgcaaccatggctggtttggaggcatgtacaagaacctgggctcttcactcaggaaaagagaagtctagggaaacatggtagctgcctccagtagaactgcaatatgaaacaggtcttcagaggcttccagggcgaggggaaaccatgcagggctcctccccacctccccacttctgcttgttgctctgcgcttgtccagagacaagagatgttgactaaagtctatgcagggaagttacttacaccctcctaggtccaaaagctgcccactgcctctggagtgttagagcagaaagtgggcaggcatgggcagggccattgctgcgggaagttaagaggcaccagaggacagttcttccaacttagacggtttttgtgaagtgaaagcagactgcaggcctccagcactggcgcagactctgactggtgcaggcctctaacactggcatggatttagcagatgagaaagatgggtctccttacaaatactggtcactagtgagttgggccttgagagacagagaaaacaggtatctgcctaaggtgtgtctggttaactatattggcccttgaggtaatctacaatttaaggagttttagttcctctaacattttaagaaatcattctcatgtttgagtgccatgtttatagtaccaattttgggggccagggtgggaagattgccctgagcaaagctgtccattttcccatcatctagttggttttcatggagcggcccacctgctccccacctcaggagatactggaggactctagccctgcggtggctgtggtcaggccaagggcaggccaggcttccttcctaggcttcagttcattcccccatcttgctgccaaggtacctttagatgttttggtcccctaaagcatttaaacagactgtcgtgtaaaatgctgtctgaacaaagtctcccatgaacccacggcacagtgtgtacctgaacctcccaagagaaatagtaaaatcaccacatcatcaagttgcagctcagggactacgtagctttagtggtgatgtttgcaggaaaaggtttcagagaaatttgaaaattggcaggtgcactttcttgacctttccaaaaatagtctgagtcactttcactttcagccttcaaactgtgttgaatgaaacctttgtgcagtttacagaaagtgaagaactgtttggcaagagagagaagttcgagctcctaatagcctcggctgcattgagtaacatttcttttgagttgtctattaacactttcctgaaacatgctttttatgacgcctagaacttgtgtaagagtgactgtaatttgagttatttaaaaatgtaagtacaagaaatgtgtcacacgccataagagctaggaaatgacagctcacattcatcttggtggaaggaaactctaattattggaagatgtgattggagtatttgttcttaatacctacggtggctctgttatatgcttgcctaacaccagtattggcttgcaaataacactgaaaagctcctttcttttcctctggtctttgtgggaaggcatggtatgagtcgagattgctaaaccactcttctgagaggactcagagagagtgtttatcctagactatccatggccctggtacttctgagttcagttgtggtgtgatctcattagtccaggctcagaatggctcggtaacctcaaaactccaagccctcggtgcttgctttgcttccctagacttgcagcttatgtacgcccacatgtgcttcatgcgtattaaaaatgcttgcatgtgtagataggaagatatatgttgactgtcctgaaaaacttgacatacctaacatttaaaattgttttgagtttcccccggggataaactagtcttcaaatgtaaacgtgatgagcagcgtaggggctatggtaccagagaaaagagccgaatctcggccctggtccagccctacctctcgtgctctgtcacctgcagcagaggtggagtgggggccatgtctgtgagcgggacctcatcttgtctattcctcagacccacccaagggcagggattcccaaaactgctggtacctgtaagaggtattgtattcttggactccattccataacctctcatcaggattctgggtttggaactctagaatcaatgttgaggaaaaatagaacttggcgattttatttttctagatataattcacataccataaaagccactctttaaattgtacaattcagtggttttttagtatattcagagttgtacagccatgaccactagctaattcagaatattttcattgcctcccaacaagcctagtactcatgagtagtcactcccttgcccattccctccacccccaagcccctggcaaccactaatctactttctgtctctatggatttgcctatttgagacattcatatgaatggaattatataatatgtagacttttgtatctgtttttttttcatttagcataaaaattttcaagatttgtccacagtgtagtgtgtctcagtacttctttcctttttatcactgaaaatacttcattgtatgtatatgtcatattttgttatctactcatcaattgatgaatacttgtattgtttccactttggctgttacaaataatgctgttatgaacatgtgtgtacaagtatttgtgtgggtacatgttatttctcttgggcatacctacagatggaattactggatcatatgacaactttatgtttaactttttgaaaaactacaaaaccaacaagctgtaccattttgtaatcccaccagcaatgaatagggttctaatttttccacatcttcatcaatatttgttattgatctttttgattatagccaatctagtgagtgtgaactggtatcttattgtaattgtgattttgatttgcaattccctaatgatgttgaacagatgttcatataattgttggccatttatatagtctttagagatatatctgttttgcccatttctaactgagcaaaacagacaaaaattgagttgtgaatgttctttatgtatactgtatacaagccccttaacagatatatgatttgcaaatcttttctgttctgtaggttgtttctccatgttcttgttggtatgcttggaagcataaaagtttttattctggtggagtccagtttattgtttcctttattgcttgtacttttggtgtcgtatctaagaaaccactgcctgatccaaggtgataaaaagttttcatcaaagagttttatagttttaacttttatatttatgtttttgataaattttttatatatggtgtgaggtaagcatccagcttcactcttttgcacattgatatccagctattccagcaccatttgttgaaaagactgttttcccccatttattgtcttggtacccttgtcaaaaaaaaaaagttaactataaatgtaagagtttatttccaaactctcaattttaccccattgatcttctgtctgtcctatgccagtaccacactatcttgattactagagctttgtagtaagttttgaagttagaaagtgagagtctgtcaactttttcaagagtattttggctattctggttcccttgtgttttcatatgaattataggattagcttgttgatttctaccccgaaaaacgcatctaggattttgaaaggcattatgttaaatctgtagatcagtttggggacagatgtaccctcaacaatattgtcttatctatgaacataaaatgtttttttctatttagttcattgatttctttcatctgttttgtagttgcctctgtatgtcttgtatgtcttcaacttcttttgttagatttattcctgaatattttattctttttttttttttttttttttttgagatggagtctcactctgtcacccaggctggagtacagtgatgtgatctctgtttactgcaacctctgcctcctgggttcaagcaattctccttcctcagcctcccaagcagctgggactacaggcacttgccaccacacccagctaatttttgtatttttagtagaaacggggtttcaccatgttggccagactggtctcaaactcctgatctcaagtgatcctcccgcctcagcctcccaaagtgctgggattacaggcatgagccaccatgcccagctagagtattttattctttttgatgctactgtaaatgggattgttttttctttttttttttatactttaagttttagggtacatgtgcacaacgtgcaggtttgttacatatgtatacatgtgccatgttggtgtgctgcacccattaactcgtcatttaacattaggtatatctcctaatgctatccctcccccctccccccaccctgcaacaggccccagtgtgtgatgttccccttcctgtgtccctgtgttctcattgttcaattcccacctatgagtgagaacatgcggtgtttggttttttgtccttgcgatagtttgctgagaatgatggtttccagcttcatccatgtccctatgggattgttttcttgattttatttttggattgttcattgctagttcatagaattacaacagatttttatatcttgatgtctggcagaagcacagttatttactctgaactgattttttagttctaatcttcttttagtggtttccttaggagtttctataggatcctgtcatttgcaaagagatagttttacttgttcctttccaatctggacgcctttatatttttttcttgtgttatttccctggctaaaacctccagtgtaatgttgaatagaaatggcaagagcagacatcttgtcttatccctgaccttattcctgactattacttataatgtgaacagtggattttttttttatggaggcccttcatcaggttgagaaaattcctttctatttgtactttcttgagtgtttgtttttttttttaaatcaagaatgggtgttatgggtgttggattttgtaaaaatgccttttctgcatctattgaaaggagcatgttgtggtggatttgtcttctattgataattgttaccacactgattaactttcagatattgcaccaacttgcatttcttggataaatctcttggtcatggtgtatactcttttttttatgttgctggatgtggcttgctggcatttggttcagaattttggggtctgtcttcataaaaatattagtctgcagttcccttgtgatgtctttcactggtttgggtctctgggtaatactgatttcatagaatgatttaggaagcatttccttctctatttttagaagcgtttgtgtaggattggtgctaattctaatgtaaacagttgatagaggccgggtacaatggctcacgcctgtaatcctagtactttgggaggccgaggtgggcggatcacgaggtcaggagatcaagctcatcctggccaacatggtgaaaccccgcctctactaaaaatacaaaacttagctgggcatggtggcaggcacc

SEQ ID NO: 77 - DNA, 1289 bp, Homo sapiens
aactaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaa

SEQ ID NO: 78 - protein, 252 aa, Homo sapiens
GIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 79 - DNA, 44770 bp, Mus musculus
  misc_feature (1)...(44770): n = A,T,C or G
agcatttgtgggtgttattaccacccagcagcatttgtggttttgtatttattaataatttatgataatgaattagggttttctagagtcacagaacttatggaacaaacctctctttgtatatatctatgttatatatacataatttataagtatatataaatataaaatatataaagtaaatctattatatataaataaactataaataaataaataaatattttttccagtaatctagctcagtctcacaatgctgggcatctcagctggtcttctgtatgttggaagcccccaaaataggctgtaatgccagtgaaggaatggatgtgctagtaagtcaagggctagtaggcaaagagcaaaactttacttcttccaagtccttctataggtgtggcccagattaaaagtttgtcttcccacctcaagaaatggatcaaaagtgtgtgtcttcctatctcaaaggtccggactagaagtggattcacccacttcaaaccaagcagacaaagctctcacaggtttaccctccatttccggattgtagttcattccagatgcaatcaagttgacaaccaagaatggccgtcacaagtaaatcactacttcggtctgttaaatggtggcctccagttgctttttatggccaactacaaataattttaaaacccttatttaaataacaatgatcatctataaacaaaatgtcacaatgtttttagtggtcacagtggaacagaatagagcctaatgccagtgggaccatttccagtgaaaagaaaagaaaaatgagtcgccgggcgtggtggcgcacgcctttaatcccagcactcgggaggcagaggcaggcggatttctgagttcgaggccagcctggtctacaaagtgagttccaggacagccagagctataaagagaaaccctgtctcaaaaagccaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctccctctctccctcctcctcttccctcctcctcctcttcctcctcctcctcctcctcctcctcctcctcccccttcttcttcttcttctttttgtttgagacatggtttttttgtgtagtcctggatattctggaacttactttgtaagttagagatctgccagcctctgctaaagtcatgcaccactaagccccatttgtgccttccttttcaattaaaggatttaatctttttagttggattcaatctacactgcttatagtctatcatccacttattttacttatttgtatatatatagtgtgatgatatttctttccttcaaaacaagaatatgaacagccttacacttaagaaaaccttgtcagaaattactactgtgaggtattgggaaagttctaggctcacagacaaagcaaatcccaagttgtctcttcaaaatttgttggcttgagatgagctcagctggggcagggtgtggtttgtaaatacaaaatcaagttttcaaacacaagttgttcctctcatgccccaggggaagacagagggaggggccagagcactgcaaattatctgtaaatactctttaaagcccttaatttctagtctgtaaggaaagaaactgaagtgttcctaggaattcttatttgtggcaggccccacagagtatttctcttcttattccttctcctcctttttctcttttataaagtttataatgcttatgtaataaaaagaaatatctaaggcctgacatggtagtacatacctgcaatcttagcacttgggaggttgaggcaggaggatagacccaagttcaagatcagcttggtctacttggtgagttccaaattataattctgaaaacaaaaaacaaaaaaaccagcctctcaaagcagcccccaactagggcggggggatggctcagatgataaaacccttgccttgcaagcatgaggacctgagttcaatccccagaattcagacaagaggccaggcataggaatggagggttggctcagtagttaagagcattgctgttcctccagaggggtggggttctgtgattcccagcacccacatggcaatacccatgccaaggtttcaatcaccctcttcgggatgcattcggtaccaagtagatacatggttcacatccacatacatgtgggcaaaacactcaaacacataaaagtaaatctaaaaagaagggaaggggaggaagaagaggaggaagaggaagaagaggaagaggaggaagggggaggaggggggaggagggggaagaggaggaggagcagtaacagctgccagcattatggcatggtcttgtaatcctagcactaggaaagtggaaacagcaggnnnnnnnnnnnnnnnnnnnntcactggcagccagtctggctggattggcgaattctaggcccatgagagaccctggtggaagttggccctgaggttgtcatctgatctctgcatgaacatgcatagatgggtagtgggatagaccttgtgcattgtgaagacactgtggaagtcatttctttccttttgtcatcatgtggggtctggggattgaactcagtttgtcaggcttggtagcaagcatctttacctgctgagacatcgagtttacctcagttgtgagtgtaaagtcagaaaatcacaacagacagcatgcttgcctggttttctccagtctactgtagccaagtctccttaagtttaagaatatctcatagagctgccaccaaggtattgatcggatcagaggcttcttatctttgaggctgtaccagagtcaagtgcatcaccaaactgtttcctatttcagaattgaaaactacaggcttgttgtttctattttcactggtagtattgtagtcttgagttaccatcctactatgtccctcaggctgtaactgagtcctctgatcttgccttctgtgtgctggggtgacagccatgagacagcttgcctgcactttatttcatttttgttgtctggagtcaactctcagcatctagatgctacaagcagttctttgccttggagttcagtccacagccattggcacgatggcagtttgtttcttcaaggccagcttagtaatgatggtcagtccactcgaacacagtctcgagtgggacatcctgtcctctttggcctagaacataaaattttattcattttctattgttgtaagtgaacattacagtctgtaagtattttatgtttatataaatagagatttgttttgctcagttccaggaggtctaaggtcaatgattgggaatgctgctgagtccataggcaacaggggcatcatacagcaagaagtatgtacacaagagcagagcccaagctttttataatagacctgttctaaaactaatccattaagccataaaactagctcatgaaaccattcaggagtcctcgtgatctaatcaactcttcgacgacccatttattctgtttcttaataatactttaccctgggggttaaagttcagtgagttttgatgggaacatttaaaccctagtaatagctcatcactttttgcaaactgtcctatttacaaaagcgtctctacccaaactcaagggcagtggaataaacaaactctccaaactcatatcctattttctgacacttagttgaattcagcaactactatgttcaagcaaagatctgcagggttcttattctgttagaaattattattcagtattgcagagacacatagtagccctaataggtaggtcttattatccctggtggggcccaaagataccaagtaacttgttaatgacattaaactagcgattacagatagaggaacagttcaaacacatgctgtctggagtccaagctgtcatctgtgggaagagtaacctcatgctgcggggacacggaaaccaattagatgatgagtctgcacatccaagaagtcttcctccctcccagtgtctccagattctgtttatgtggccagcctggtatggagctgagatactcctgagtcctgagattctctttcatttcttttttcttttctctctccccccaacccccagggtttctctgtgtagccctggctttcctggaacttgctggcctcaaactcagtgatccacctacctctgcctcccaagtattggaattaaaggtgtgtgccactatgcctagcgctgagattataatcatacacaacacactacctccaagttttaagatcttccttccatactttaactgtgatgcaaagccaactggcattgctggagactgtcattgtaccatgggtcctttcttccttaactaatggtaagtggcaaaccaagggaagacatgggcctaggacgaaaaatgcttgtcgagggtagaacagatttttaagaagttcttcccttatttagagatattacctgtaggggctagagagatgacttggcagtaagaacatagaccatccttctaaaaggccagtgttcaattcttagcacctaaacagcagctcacacctgtaactccaattccagggcatctgatgccctcttctggcttctgcaggtaccaggcatgaaggtgctacatagacatacatgcagacaaaaagcactcacacacagaaaatagttaatttaaagggataccacctgaaaaatataaagcaaattaaatatatggggattctaaaagtcaaaatataaggccaaaagatatctccagcaaaaatgacttggcataaccttatgcacatcatttatgttgagttgagaagcatccaaggtaaaatgcacaataaatctaaactacatttcgaggaacatttacatctgagagacagtattatggaaagttgtatagtaaagtagaggtgggtggctcagtgtccctacatacgtggagaggcaggtttgaaaaacaaacaaacaaacacgtttttctctattccagtttcatctgtaagtcaaatgtcctgccctggagacttcactgtgagacgtctgcattagatattccagacaagcagcttcccaggcataagcattcaacatttgacctaggattcacagtggtcgtcgttacctgtctcactgttgagatgaaacccttgctaccagcagctttaagaaagaagggtctattttggctcacggttggagggatgcagtccttcatggcagggaaggcgtggtagcagcagtgtcaggcagcctgtcttactgtgtgtccacagtccggaagcagagacagataaatgccgtgttttggctcccttgtcctttttcattcaggtgacaccccagtttataagatgctgctgcctacatttagtgcgagtcttccaacctaatctaaaaaatctcctcacaaaaatgcccagagatttgtttccatggtgattctaaatcttgtcaagttgacactgtaaaataactatcacagtatgaaccacttagtttttgttttttttaattgtttttgttttgttttgttttgttttcatttttgtttttcgagacagggtttctctgtgtagccctggctgtcctggaactcactctgtagaccaggctggccttgaactcagaaatctgcctcccaagtgctgggattaaaggcgtgcaccaccaccgcccagagaaccacttagttttaagaaaaaaaaaatgagagtaatttattatctggattgaactttttaatttcttttagagatttatttatttaatgaatgtgagtacagatggttggtaaccttcatgtggttgttgggaattgaatttttaggacctctgctaactctggtcaactctgctctctctggtcaactccactctggttggccctgctctctccggcccaaagatttatttttattatacttaagtatactgtagctgacttcagatgcaccagaagagggcatcagatctcatggatagttgtgagccaccaagtggttgctgggatttgaactcagaatctttggaagagcagtcagtgttcttacttgctgagccatctcgccagcctgaacttcgtaattcttggattattttcatactcatcatctgcagagaatccctttgatcttaaatcttgcttttacatcttcctatcaattttgtgcttaagtgactcacttcacttttgtcaaatccgtgtctttattaaggggcagactagatgatgtttagctaacaccaagggatgagattcaaagtcttttcttctaccacacacagcctcacctctatgaggagtcctccatctttgcagacccaggaactaccacacactggcgttctttataacctagtttatttcattccgtgagtcgcgtgcttcttaggttagagtcggttgcattttctcctttgtatgtatctttctcggcatcccacacattttagatccactgtctatcccagaacccccggagaactgcgtaaatgttaggaaggtgtagaaacatctgacattgaagagggagttttcttcatttcacaatatttcaaaacacaccctaacctaagaaaatgtaagtgttgggaagagtggtgagctaaggcagtatcatctcccaagagaacaaagtcctcccatcctagggaactgtcggcagaaagggaaagtgctagtcagcgcaccacccacttgtctgcaccctttggaacagtgatgtcatgagtgctcaggccttgccatgacccaggctgagaagagcctcactgccctggtgctttgtgcctcttgctggcaaaaacctccttgaaccaactgaggccatcatgttcaggacagaaccctttggtgtggcagccccaaggacccacacacttttcaaaaaaaaaaaatctaggtgggttataacggattctgagaaacaagcaacgtgggcagactggcacaggtctgacaagtcactcagaaaaaaccagtcaagccaagctgttaagtaagtaatgtatttcacaaagttaaaataatttataacttagccaaatatatctacctaaaaccatagaacctattattaatatatgatattttcaaattttaaattatctcacaataatggctcatttaaagcatcttttctcaaaagggagtagagaagggtgattactgtttcattcatatatatacatacacacatacatatatacatatatgtatacatacatacacacacatatatacacacatacatatatatatatatatatacatatatatggaaatccagtgaaactcattaatatgtataatacatattatgataaaaagaaagcatctcatactctgatataacgttttttgtctgtgtgtttctgggggttgagcttatatatcctacgcaagtgctcttatctttgagctgcatagccagccttatctgtagctttagcacacgtgactattcttatcattgagctgtatccccagccttatccgtagctttatcacatcatgtgactcttctgcttctcctttcattttccccagatctgttttcagttaatactcctcatcgactactgtacacgagtactctgtcctttccctttccctctgtcaactgtaccgtgtccttgtgctgttgtgttttgtgtatttctcagtgttggtgatcatttctttccaggtctcataatatccatctaagtatctgtccgcccattcacctgtccacctatccagctaatagacaaaactgttacccatttatttttttaaactgagttgagctcacaccactaagaatctgtaccttttggcaggtactcccttttggcacttcaaatttccaagtgtgtgtgtgtatatatatatatcaaaagccttggaggcggagaactaaagggcagccttcagaagtgttaggtggtccctcactcctttctgaagctaaggcctctgctttctctgagctctaatgctcatctgagcctttgctgctgcactcacggccgtcccttaggaagaaggagcacgtctctcccctgcctctctcattgtactggaatcccttgaagaaacagacttcttgattcccctgtagagtctatcgtaagttctactgtagaataactcaataaataaatacgttctggacaatatgctctttattgactgctgtagccgccaatttctttctaagagaatgcttctaccccagggacttgcacacgtaaaggtcaagagattctgggcaaccccattgtgggcaggctctgaattcttcacttaagactcggtactttccaagctggaagtatgaaaactagagaacacacccgtgttgttagtcttgctccaggaaggcacacctaccactatcaacagcactgtgggtgccatttacagcttctcaggcgacgtggcgttctgacaggattccagagagcatgcaaggctaaggccaagcaaatactgctaataatatatcatgtccttccttgatcctgttccaccaagctgtttatctatccatctaatctctcaaagccacaaaggtgccttaacagatgggcaactacgtttttatttacaaatgataccccttgttaaatgatatttctaaatgacataaattgatagtaaagtctgaatgaaaaatgaatacgcaagaatgactaagaaaacactgaaaatgtaaaatgaggaagcctatccacctgatggaaaacatcctgatatgttaaatttagttgcttttgacatctcaacaaattggactctagtttcaaaacctgcaaaaacccaacataataactctaaatataaatgcaactttgtaacactgagattatagcctgcacatgcacatccgctgcctattgctgtaacaggacagttgaattttagctctcctctcccagctaagtcctgctccttgggccggttctccctgactggcacattttgcatggcctcgggtcatctaatcccttttgattgcatttcgttcactagtcgctgtgcaaaaggcaacctggctgtgtcgacacccaagagactccgaagacaatggcagaggaagcccgggtcactggcaaacaggtatgtggagaattagagacaaaatcagctagcttaaggtcacaggcctgccttggagggatctctgcctagaaaccggcgggtctttcccaaccacacccgtgggcgttcggaaatccgtcacttgaagactcactgccagcgccgcgctccctaccaggagctctgatccgccccgggtgaccgagaggacccgccctgcagtttgtccttaaggtggcgcctggcctcacctccccgcgaagccgcgcgcgtagccggccccgcccccgctagtgcgtgagggggtggtgccacagactgacaggatccttggccatcctattgggcaaaagtctgagtgacgtaaagaggctcctccttcctgtcaccggctcccgcccctttggctgctccggtcgctgacgtgtcgggccggcaggcttccgctccgcccctgggccgcagccactcaccgcggcgggaggggccgggtggccggggcccgcgctcccctcggccgctgctcgtggcccgccccgccgccccggcccctcggatgacagtatatattccaggcgggcgcgggacacgggcgagtagccgagccgaaggagccgcgggattgtcgagggaggtagggacccccttcacgcgcgcgctcccatgcctagcgcggggacccggctacgcgttgccgcaccttgctcggcgtccgctgctcggagctccggagaggcgtgggctgtgtcgcggcggggcggggatgcgcgcgcggagggtcttgggggagacctgagggaggaggcttgggtgatgatggagttcccggcgcttgtcagcgctgtttttgagtgaggggaagaggagccaggagggtttcaggctagggcccgggcatagttgtgcnnnnnnnnnnnnnnnnnnnnnnnnnnnnnnnnnnnnnnnnnnnnnnnnnnnnnnnccaatgggggatgtgactagcacaggtaaccgcttgccttcgcttgatactgatagtgagagaggttcagatttcagggttttcccctcaattggactggtagaacggtgaggctgagagcacacatatgctctagaagatttttaaaaagtttggtgtgaaggctgactggccttcatcggcatactatgagatctgaaatccgatggtaatgatcatgcatttatgagaggcacaagtttaaggacttggaggtgaagttcactgggcttggatccaagagtttgcagcaaaccaaaagcatttatccatttcgttattagttgactcacttggctgagggaaaagacttcatagtctgtcctgttagttagtggttaggactcaagtcagtctcagtaccattcctccccacccccacccccagcccctcccctcttttttcctgttttgtttgtttgtttgtttccgagacagggtttctctgtatagctttggttgtcctggaactcactctgtagaccaggctggcccagaattcagagatccatttaccttaaagatatgtaccgccactgcctggctccatgtgtccgtccccccccccccccaccgccccccaaagcgatttactaacccaccctgaggacatatagcagcagaggtgggggtggaattgggaaatactggacgtccttaatgtggcatttaaattctaataaaggcatgtttgatttgtcgggtatgttgatccaggtgtgttaggttgtaggcacacaccaaatttagtcataatttctagtgcagacttttgttcttagtataaaaatccgcgtctttttaattctcttctctattgctgtataccatttgaatttagttacacacacacaactctcaagaaaaatgagtaggagatgcagtactatggttataactgtgtcaggtaaatataaaccgtttttattatgaatgttacacaacacataaatggacagattcgattttggtaataagatttgtggattgctggtgttctgggaccagatatcaaagtttacaatgagttgttttatttgcatgagtatgtttttctccaagcacccaaagtactacccagtacttactgaatgagctagctagctaggttgcgctctctctctctctctttctcctttttctgagacagggtttctctgtgtagctctggctgccctaaaactcattctgtagatcaatcaggcctcaaactcagagatccaccagcctcagcctctgcctctgcccagaccaccctggccgggaactcacagagatttgtctacctcttcagtgctgggattagcggagtgagcctcctctgcccagctttgaatgacttttaaaggaacagttctacctaatatttaccatagtatgtgtgcgtgtacttttagtagaagaggcctctttgctttttaatcttcaggatatatgaaaaaggccgggtcgtcttcatgaggaaatacatacaccagggaagtgaaattatttgcacagtgtcaaatgatgggcaggggacaactggagcaaggaaccacaaactaggggcacttctttggttgcatgtgtccctagtgatctgactacaacatgcttcctccagtgctcacaaaaacagtgctgaacatgagaccccgggaatcattccttggaaaataatacaaatctacctctccctactgtcttattttttgagaattttgtacatgttcttattaaatgcttttttaaaaagtgatataacaagcctttaatcccagcactcgggaggcagaggcaggtggatttctgagttcgaggccagcttggtctacaaagtgagctccaggacagctagggctataaagagaaaccctgcctcgaaaaaccaaaaaaaaaaaaaaaaaaaagaaaaaagaaaaaaaaaagtgatataactcttgaaacctagatgtcaactgaaattttttttttcttttggttttttgagacggtttctctgtgtagccctggctgtcctggaactctctctgtagatcaggctggcattgaactcagagatgtgtctgtctttgcctcctgagtgctgggattaaaggcaagcatcagcaccacccagctgaaataccttgtaacagcctagaaagtgtccaagctcggactcctggcttcctcacctttgggtctccctctggttggaggagttcatttcgaccgtgattgatttgtccccgttgattaccatgagagtttgatcacataaccctagggttatgaactagtgctttgctgtctagtcagtagtttctctctggatgtttgatacgtggatgaagttgacccaaagtaaagaatggagtctctaatcaccatgtgttcctaaatctgtcctgtcaaccttttcttgacacttggtgaatagtatcatgttaccgtattgggctgtttcgcttggacctaagcttggtttgtgtcttcatgtgtattcttaagagttagccagataaacaccccgcctccccaaggggtgctgcttctcaccgagtttcccactaccgagcctcttaggacttagtcctttcgcccactttatgtttcttcgtagccgtagctcatgtccttttacacactcggctcctactgtggaatgtgagtatgaacttgttcttcatcttatccctgccaccctgatcacacttggtgggcagtaagtgctcattaaatatttggtgaatgaattaataaccacatacaagttaattttcctccttaaattctctgtaatcacaggtgctcaagaaagggtaacttttatgggtagcctagtcacattgtgaggagggcgactggggaccaatcacaactcactgtagttttgtgacctaaaaaagcaagccatgttgggcctgtaggttatgctggaagtgaaaattccctaatgaagtcgttgcccgtgtaatgtagcagggcacattactacatacttggtgatggctgcaggtaaacttgtaaaggtttactgggaagctgggtgttactccagcagcagcccttttatcctgtgtttcccgtgggtcttggttccatcaagaagccacactgagtggttagcttatccatgtctgtactcactgctctctatgatggaatcacagaagcaccccattctcggagtctgtcccttgtacaagactacagctgccttcagacacctgctgccaccatgtcctgatctctgaacagaggactctgggaggcattttcctcattgctcccattgaggaaattttcttttcttgtatctttgataaactttttggctttgtccatagtagctctttcatggtcaaaaggttgttacttagaactgtagagtgcagatttcacgtctttaatagtagctttttatagaggcctctcaatgtcctaggcgctttcaaaattgcttttcatcatagtaaggatacccttagctttagaggtaagtgctcctttgttgttgttgttgttgtttgtatgcctttgagacagggctgtgttctgtagcttggacacagtcttagtctgtagcctaaatgatcctcagaggctccatctcgcttcatccacgcaaatgctaatattgtggcattcaccattccgcccggctaaggactgtctttgctccattttgcagacatgaaaaattagggtgagctgggcattggtggcgcacgcctttaatcccagcgcttgggagacagaggcaggcggatttctgagttcgaggccagcctgttctacagagtgagttccaggacagccaggaaccctgtctcaaaaaacaacaaaacaaaacaaaacaaattgaaaaattagggcattgaaaggttaaataactagatgagaatcacaagcttggagcgcggtagaattgaggtagacctagtgagtctgactctaaagctcagtcatggttgtcaccaaatgattctgcctgggtttaagtgagacctctctcattgcattctttgtatttcctctgcttttgcgagagaggagagagaaagaggatagacttggagtcacatacatctgagttaaaaattcccgtctttctaggtactagtgatgtagccaaaggcaaattacataactcctctgagcttccttttctcattgattgtgaaagattatttgttaggcctcagccttggatgaaaattttattcccattgtagagacactgaggttgaaagtatttatgacttggtataggcaataagattaggaatgcccgtctgttcccacgtctgacatgtgatgggctcctggtgagcctccagggatgttgaggacaagaggaggctctgtgttgcagcatgatttgttttcttcacgtggcaaaacttctcgaggaagtgcgggcgccctgagtctccaggatgcctgctacctactttctgtgtctgctacctacttgacgccttttgaagttttgtgtctggtgttgcagcgggtgagcctgcacatgctgcctttgctgcaagagccagagtgctgttctcatccttgccgtgatgggcacaaggtgcagaactccctctgcagtgtggaaacagtgtttgatgctgaatggttgtgatgaggtagaagctgtcgggcatctcatcataggtgcgggacctgaggccggggacagctgagtgatgcatatggactgctgatgctctgtacccctggtcaccatgctgtgacaggaggagaggttggtaccgccatccctttaactgccaaagctaagcagttggaatgcaggacaatggggatttttttatagtgagcctcaaagttaagttatccctttcattcagatccttgcagccagcctgggtcatacccatggggttttttgtttgtttgtttgtttgttttgtttctttcttccaatatttttctcttttagttagcatacaaagtaatggatttcattatagcatttttagacatatatcagacatagctcatatttgtttttcctgctgctttcttaaatagtctctcttctgcttttgtgtcacacatatgcatacatgggtatctctagtgaagtttagattctgcatataaagggaaacctatctctggtgtgttcattctccattctactccctggggcctttcccccttgtagtggctattcctggttgtcaacttgactatatttggaacgaactacaatccagaattggaaggctcaccagtcacccttatctggaggcttgggatagaagattctgatctggatcttggtatggagatcttgaggcatagtggctatggattccagaagattaaatctctgagttcaaggtcacccgggattaaaggtgtggtagaacacacctttaatctgggctacaccttctgctggggacaatataaggacattggaagaagggagtcttgctcttgctccttcgcctgcttgctgtgtgagactgaataactgttagatccttggacttccattcacagctgcgactgaaccattgttgggaattgggctgcagactgtaagtcatcaataaattcttttactatatagagactacccataagttctgtgactctagagaacccctttacttcctcttttacttttctggtgcatgcacatgatgcatgtatgttttaagtctaggttctgcatatgagagaaaaaatgcaatatttgtctgaatgtggttttcttcactgatggctctagttccatgaatttttcagaaaatgacatttcagtctttatggctgaataaaatcccattacgatagacatcctatgttcctttatcagtttgcatgttgatgggtatgtaggatggttctgtgtcttggctattaagaacagtgcagcaagaactgtggatgtacagggatatacctctgcaagctgacttagataaccagaagcggttatagctagatccggctgtagttctacttttagattttgagcagcctccatcctgactcctatagcagataatacaattcacgtttctattagcatcatacaagggtcctttcccccacatagttagctacatgtggtgtcactctgttttcttttttaagttttactttttacaagtgtgtgtgtgtgtgtttgaacatcttatggaacttggttctctcttttcatcatgtgggttctgggaatagacatcgtgtgctcagacttggagacctgctgagccaccttacctgtgtttgtttgcttttttgatgataaccattccccttggcttttcatatgcacagttgtgtgttagcttgctttccttcagctgtctttctttacagtgtatttggtaccctggcttctttcctgtcttctttttttttttttttttttttttttttggggtttttgagacagggtttctctgtgtagctctggctgtcctggaactcactttgtagaccaggctggcctcgaactcagaaatccgcctgcctctgcctcccaagtgctgggattaaaggtgtgcgccaccacacccggcatcctatcttctttttaaagcacatggtgatagcaccctgtgtatcaatccatagttggctagctatctcttactctttgatctacagtcagttgtgtggttttcatgggctaaccctgccctacaccatatcctgtcattgtatgccttcactttctgactgattcctatcttcacgctcctttaccagtgccatcaaggtctccttgtttcctgctcttatctatgtagtctgtttgaccccctgcagggtcaaatagctagattgtgaacatttcccagctggtgcctgtgtagatcttgcgttcatcagtactaggtaggtggtagacccacctatatgtttaatttcttcattccctaaatatttaatttcttcattcccttactttttagcactatgcagtttaagagttgactttgtgatcatagaatactcatgcttgtggctaacacggtcttcttccctgattgttatatgtgtatcacctttccttccagttagggctcaggtttttagcgagtagataatgggtatgattcccctgtttccctgtggaagttgaaatattgttttcatagttataggtggcgctgaactctgaatacaacagaagttatcttcattagaggcaaagggagaacagttgaactatgacgtcgtagcgtagtgttcagaggtgtagggcagcagcagcagatgtggagagaggcagtggagagatggagggggtgaggtgccactctactgcctgcactgctgagcctcctcagtgtgaatactgataacagttacaagtgatggagaggtaggaacttagatgagacttgcaagtaaagtgctttgtatagtgccggcacatagtgctaattattgttgaagtttgagctctcacaaatattgagtcagtgtcagaaaggcagaaggtcatttctaaatattgagattttaaaaacagtgtcatacatagctcaatgatggggctatgttctgagaagtatgtcattaggctgtgtactgtgcaaaaaacatcatacatgtataacctaaggtagcttagatgggaccactgctagataagtgatcttggccaccatgtcaggacatctgtctgtcctttcttaattccttttctttttggttcacagctctccctactctgtttttaccaagcttcactaccagagcactatgaatgtcaatgacctcaaacaaaggctgtcccaagctgggcaagagcacctgctgcagttctggaatgagctgtccgaagcccagcaggtagaactttatatggagctccaggccatgaactttgaagagctgaactcctttttccggaaggccattggtgaatttgatcgatcctctcaccaagaaaaggtggacgcacgaatggagcctgtgccccggcaggttttgggcagtgctaccagagatcaagagcagctgcaggcctgggaaagtgaaggtacttactgagcgtgctcacgtcttacccagcgtgttgtgagtgagatatgctgacattattcaagttgctggatcatgtagcaaacactgtgctgatcatactagaaatcagatgacccactagcaatggcaaacattcttgccaaggtagctgcagtgcctgctatggctgatctacacttcgcttgaattgccgctgcctgctttcaaagctcttctctagtcttattctgcctcggtctccttttgtctttaaattctatactcttgctgggtcactttccctgaaattttgtggcctgagataaatgttccaatgtaagctgctttgacctgaaaatctgccttgaattggttttctacacctgttttccagctctgttttcttctgtgttaccacgtctcattcctgttgctgcacatattgtagctgaggcaagcggttcaccttgcctaggtgttctgttatgcatttcctcctgtgtttatatttatctttagcttggtctggcctgtgccctttctctgcttagcgtcaccttgaaggccagggagctgtgcaggccgtggttctgctgctgtggactgacattctttgttttgtttgggaggtgctagagatcaagcccagggccttgtgcaggtaagaaaagcactctgccgctgagcctgatctcttgacagctgcctgctgggtttgacctctccatgaaggccaggaaagctttgaacttgcagccctcctgcctcagcctcctcagtagccagttataggtccagttcttacactcattcttctttaaacatttttttcttttttaaaaaatgaatatgtgtagaatattttgccttcatgtttgcctgtacctcacatgtgtgcaatgctcacagaggccgggaagagggtatcagatcccttcagagtgaagttagaggaggttgtgagttattctgtaggtactgggaattgaacttggactctttaaatcagtgctctaaacctctgagccatgatcctagcttccttacactcattctttaagattctccagatctgctgttttcaatgctttcctcactgtacagagttagacttagttgtttatgcttgcagttgatgctacctttagtgacagttgtttgcatttgtcttcctaattacgtcatacacttttgaagaacagcacatgtcctgattgtctgtgtatgttagacatcatttaggaggaaaatttttagttatatattgatcaatatcatgtgttgaatttgtccacagatttcttgttcaaaacatatactataatgtagtcttatgtctagtactaatttatacttttgagaatggcagaatagttccactatagcttgtcggtagagttgctttttgtaatctagtcctcctgtaaataaaaaggttgctaaatactataccctaggcctgtgcattagtcatttttgcatagctctgatgaaataccagacaaatagtttaaagggagaagtgtatatatattttgggtcacagtttcagagagttccctccatcctgatggggagggcttgcctcactgactccttccccctttgactgtcagagcgtctacccgtgggatggtgtgatcctcatgcagagcgggtctcttcccctttacttaatcttccctagaaacaccctcacatgtacacccaggaatgtgcctcaccaggctcctaggtgaatgtagaactagtcaggttgacagtgaagacagaccaacataacctttgagtctttgcctacatttctcgataagtctctgccttgttttcttaacggaatgaacaagtgagactaatatactttattataaaatctatcttcaaaatacccaaaattacctgtaactatatcagatttatttttttatattacctacttgtatacatgcttactttcatagatgtaaataatatcatagctacattattatcttggtggctatttttgtcttccaccttttgacatcccacctctccatgaaataagaagacagctggtgtcattggcattctctataccttacctcccctaggccgacaggtttattgatttttaacttgtgttccaaagagccccagagagttcacttgtgggaaagctgtttcatatagggaagaagaagctgactctagccaggcaggtctctaacctttcacatctgtcacagtggttctacttccttctgttctgtgtatttcattgttatatgagcctttctttattcaggagcattcaaaaggacttattcataaggatgttaaagagcagcttagaaagattggttaatcattcagaggatgactttcagatctgaaatgcacatgcatggctgacctagcctcttggagagagtatggctaacctggcttcttatggagggagccctggctaacctgccctcttactgagatctgggcagggccactcagaatcaagagaatgactttcagaggaaccttgtgaatggagagttttggtgatatggtgactcgttctgactttggaatcatgaatcctgtcttcctgctctgggtttcaaaaaggctactgctccaaatcaaaagtcaaatgagcctctctcctttatcccagctgccatgtttctccttagggtaagggggtggagtcgtagctttaacatttaaggaatctggtataatggctggaagcagcaacaagcaggcctcctttggagtgtttagctttgactctgtagaactaatctacatttataatttttcatttaaagtttaatccacagttgttagaaccaagtatggcccaagaaggagcaaagcaaacttccttttggctcggtgtcaggaaacagtacttatttgtggcttaacagtagggtggaggggggttagtaactgattttatatccttctcacttagccagaaattgctgtgtgtttgcacagtcatatcaatagaaagtttctgcagtggtgaagattatatcattgtattttatatgctgcaaggagtctcataactgtttcaaggacaattttgttttcttcatgataggggaataagtattgtgcagtactttccaagcatctgttattgaaatgataatagacatttgaaactgagggtagaaagttatttcttaggggctaagtaacgtccttgttgaagagacgtcttactttaatttgagttttacagttttctggctacacataaatagtgtaacatagactagcaactgggaactcttgaggtcttgaaagagaagcaattagaagctttgagaagaatgccattttagtaaagatacactgggaaagtctaattgtttagtaaatgttgtcctttatttaaaaatgcatatttagttaagtgcaagttaatctcccacttaaactaataagtattcggcgatacccattttctttcctgtgagacattttcctaacaagtatagagttctgggaatggatgctggccttgtgtggctgggtggtaagcggcccaccactgagctgcatccccaggacctgaactggtgtctcttctctttctgtgacaacatgctaggaaggtgactgtcttgtggagaagaaatgtgctcaacgttaccctttcttaggtctagtatagtaatgctttgatagatttgttttattttaaaggtaatacatacttagctaaaagaagttagaaaatactaaaaatgtcaaagaaaaaagaaattttctgccatctcacactccagacaaaaatacttactagtaatgttttttagtattttcttctgcatagggtatcattgtgtagaaatttatatggatttattatgaaatagttcaagtatattatgaacaagtattttgagacaaatatgatatagtaaatgcctacatatgctactttgactaaaagttactttttttggcttcatgtattctcccttttgttctcttttttcctttgttgctgtattccaaataccatgccgttcttatcatcatagttcaatatatgacttgaaatatgtatacagtgccaaaatatctcttcccaacccataggaatcacaatgccttttgttgaatgcctagtggaattcacagtaagtagtgcactagtttataaagtgagttcagacagagcagcccttgagtagtctgctctttgtgtttaacattttgggaagcagtttcagttgtgacatgtgattgcaacgtaaagacttaggatgggcatggcagtacctgctgtagtcagaacgcacgggtgtggaagcagggggtcactagttcaagtccatgtttggctgcatggaaagtttgaggctagaagtatgtgagactttatctaaaacacaaaacaaaacaacaacaaaaggccagacaaagcttttgtgcttcagtatttgttctgactggctttcttggatagctttcattcttgtgtcctagctgaagcgcctgctgatgccccttgacttgtcctgaggtgtctacagtttacatggaagttcttgtgctctgctttagcagcgcccatgaaaccgcccgtgtttcaggcacctgtccaagttaaagctcagggaggaagcagtccaaccaggaagttacccaggaagggtttgacctttcacaggccactggaaactaacagccttgtttcttgtaatgttatcaaggaagagtgctcagaaccttctgggctcacagtgcctgggtctccaaagagagaagttctctagatctataattctctctctctggcttaatttttgttgttgttttattttattcttttctttgtgtcttaaaatccatcctgtaagaaagtcttaactcagttggagttggtgctacagggcagttgtgagccagctggtaactgaacttggtccctcttgaagagcagctcttaacagctgaggcctagaaagatattttaatgtgttcattgaagtctctcactggtttttggtgggttgcctaagcttaagtttgtatgttgaattttggaggttttgtgatacaagtgttttcttttctaggactttctcagatttctcaaaacaaagtagcagttcttcttctagctggtgggcaggggacaagacttggagtctcatatcccaagggcatgtatgatgttggcttgccatcccacaagacgctttttcagattcaagcagaacgtattctgaaactccagcagttagctgaaaaacaccatggcaacaagtgcaccatcccatggtaagctgtgtctcgcgctggagcatctgctctgcagcattcaaatgtatataaacttgctgacaagagggcacacttcctgtgctcggcgatctgtggagagataattctatatatgctggaagtagtatatcttatagctatctagctggctttactgggagtgtctacgcacttttctacccttaaccgagcaccttaagaatacctttcagtatccaacaaaccctcggtgcagaaatttcttcctgactgatggatagtgtctaaaataggccttctggttgaaacttaatttcctcctgaaatctgaaggtgttgctttattgttcccaatgttgctgccaggtgtccagtgtcattttgatccctaaccattttgtttcctctctcacgcatttgggtctcttccttatagtgtctgaaacttcatgataagatggaatggcccattaggccttttcagtctagcagtgcaggtcctaagcaccaggttaggtagttcttacttcccccgccccacctcttccatacattcccccagatgaaagccactttgacctctctgctatgggtcacatttgttttctcagcccctactggagtgctgcatagggcactgtcttggccactgcctcctaagcactgagagtgacactcagctggatggctgcctttcacttttgttttccttttctctttagctctctgattagtttcccagagcgggttttaaggggggagccagctgtgtatttgacatccctcagggccttgatcttatcacttcagtcccataggaccaatcaaaactgctggttttctgtctcccagcaacagcctctggtcctcgtgcaggttccctagcctgtaccagcatcagaaaagactgtgaagaagtagcagctgcttttcttaatgccctttggaagatgctccccctctggggctcccgggctcaaccatgctgctctggggctctctggttcctttgaagacgtggtttttggaataagttttcaagatgttcaagttctgtttcaatacaaaagtattgggatgctgccaacttttctttcttccatttctttcttttcttgattcctgtgggggtttggagggacatctgtgttctctgtggtcagcgggttatttacagccctgctctgttgtcatgttggacttccttctctcttccctctactttttagtgctctgcgtctgtatgcagaacagtttcccacctcttttttatttctataaaacaaagagttgtggctcaccttattacaaaggttcaaatgccccaaataatttcattggcatacatatttactgtggcaggagatcatgccattttctaaatcaatttaaataattatttttgttttatgttctgccttgtatgtctgcactacatgcttgcagtatctgcagagatcagaagagggcatcagaccctctagaaatgggcctacagtggtcattaactaccaaatgggagccaacctgagtcctctgtaagagcagtgctcttaactgcgagccctctctccagctctgtgcttcatcagttgatttatgtaatgattattagttgagttactgtttctaagtcctaagtattgatcactaaccagagcaagaattccaacttttatgtagcttaaattctggtaaggccctgaaccacttcagtttctaattatagtcttaggcaggatctttgtaatcttttgctattctgtcatgaattcaatttttttttgaaaatgaaagatttgttttaatttttcatgtgtatacatgcttacgtctgaacacccttatgtgtgcctgatacccagggagaccagaagcggtgctggtttcctaggactggagttagaggcagttgggagccacatgctgatgttggggatggaatagtgacctctggaagagcacacagtggtcttaactgccgagccatccctcgagatcctgagttaaggctctgtggcaacagaacgtacactttcacttctgtggttctcactgggtggcgagcagagtctgggcttcgtttcagattttaataagaagcacaagatgatattagcctgcattactgttatcttttttcctctatttacaatgagagacttaatgttagtgtacacagtttacgggcttgcttatgcctctaggcatgggttctctgctgctggaatcaggtttgatattttcataggcttattttagacataaggaccagtaaaatcctggaagaaatacgactgctaattagtgtgtctgagccagaaaaaaagatgaagtcagtcacatataaagcaagcgctctttagagtctctgcagcttgggagatatattgagtgtactttcttttgccttaattcttgcaatatcattgcttataaaatggactctctcttgcaggtatataatgaccagcggcagaacaatggaatcaacgaaggagttcttcacaaagcacaagttctttggtttaaaaaaggagaacgtggtgtttttccagcagggaatgctgcctgctatgagttttgatgggaaaattatcttggaagagaaaaacaaagtgtctatggctccaggtttgtatcatcctcacgcagtggtgacaccctcgatagtacggaacagctcactaactgttgactttcttctgaatgctggtgatttggatattaataaaacaggtttctttccccttcaacttttttctttcaaattgtcaatggtctaaaaagttgaaaatgtccgttagtgaaacgaatggattgatttttatccttcgtgtggatgtttgtcctagagagctttctggatgttcactctcctcccgtactgttttatacatacagcagtgcccctggcacactatttactgtgatgaagaacagtgaggcatcactgtgtagtaggcgggaggcttagctcagtggtagattgattacctggcacgcacaggctctgggttcacatcaccactgggaaaaaaaccaaaacaacaaagtagtgagaggctaaacgataatttccaagtggctttaaaccttaaatcatacagagataattgcttagggacattacatggcaaagagaaatcttcttacagtgagagagcacaaggcagaactgtatacatgtgagtagggaccccggcttgtgtgtctgcagtcagcatgtgcacactgcagtttgctagtggcatttactggaactggatggtagtgcttgcagaaccacacacagtgacctggagagcgagcgagctcagccggtgaaacctgcgtgagtttctctgagtctgtacttggagggaagactgagaggaatagacagtaaactagaccttcatcatgtatcggcctgctttgatctggatttctgtttgcagaagactgtttttgtttgtttgttttgaggtgaggtctaatatcaggctggtctgcaactcactgtagagctgaagcgattttagacttcagatgtgccttcctgggactgcacgtgtgtgccaccacactctgtttagaaagtggtggagatcaaacccagggtgtcatgcatgctaggcgggtgctctatcaattgaactgtagtcccagtatctctctctctctctctctctctttcaccctcttttcctttctccctcccttccttcctttcttccttgtagaagagtttactactattattagttctgttttggggtgctatctagtttttcattattgtttaagtaaggtcaagattgttagaaggaatatactaagagcaatgaagatagagaaaaacttttacttatagttagtttaaatctcaggttttcatgtctgtcttcttaacaagtgaattagtgtaaaatgcttaaatatttttgagtgaggtaagtctgttgggatatgaatatagggctcatttgaatcataaatgttaatataaatcaaaatgttctgaagtaatcattgcttgataagtgttatattgtaccctatattttaggataaattattgttttgagatttcctggatttccattaatgatgttattctgggcttaattatgctaaagagacttcaaagctatgtgtgcatgattacctcgtgacacctgaaattttgtgtttattcagtatttttgactttgtaatgaaagccatcccagtttgaaatgttaaacagtcttttagttgccttcacagtgggtcatggaatactactagtggcttgtttattttccagatgggaatggtggtctctaccgggctcttgcagcccaaaacattgtggaggacatggagcaaagaggcatctgcagtattcatgtctattgtgtggacaacatattggtaaaagtggcggacccacggttcattggattctgcattcagaaaggagcagactgtggggcaaaggtaataccttcccagctctgacgaggctttgtctgttagtctttttaaggctatctgaataatttagaaccatccgtccagctagagtatctgaaccattccgtttggttctagagggtctcaagttcttgcttcacacaagaatttcaacaatgtgaggatggtttgtgactccttgagacagtgaatggtggtcattgttaatgggtttgttactactctcaaggcatgttcaagcactttaagctgttgttcctcctgctggagtagtcgggcaagggggtgtggtagaaacagcaggtgtaaacttcagtaaggcatttaattaacaaggggtctcacgatattctgtgaataagacagaaatgtggagattacgaataaagacactaaaaggaattcagttactgttggaatgactaaacgcactgatagcagggtagagggaggttatggtgtgtataggaacagttaaatagttgtgtgtgtgtgtgtgtgtgtgtgtgtgtgtgtgtgtgtgagagagagagatagataaagctaggaataaaatagaagagaccttaacatttcagaagatttaaaaatatacaaatattgatttttctgaaagttttttaaagcttctattctcaacaaataaattataacacagtcatgttagatcccatggagactaatggagagatatcaatgaaatgatctcaaggtttagaataaactgggaagatggccaagaaataacacaggctcccttgatgccgacagagccatctgttttggtataaatgataggagaccttctagttttgtatgcggattactaatagcatggtgtgtttatgtgttgcatttggtttacttacgcactgaaagacatctaggtagatcctctgtcttagctctcgagagcaggacagcagcgatgcagggacagagctcttgatttgctgacttcagttcttttcaacctgtactgagtagtggggatagctggctcacgtgataaatatattttttggaatttcatgttgcttttatagcttctatgtagaactaatattcccaccaacagtgtgtaagagtttctttttttagggctttgaaagatagcttgcagttatgagcacttcttccagaggatctgggtcagttctcagggcccacataacagctcacaactatctgtggctccagttctggggaccccacgccctcttctggcctctgtgggcaatgcatacatacatgcaggcaaaacatttctaaacatgagattaagaaaatctttttcagaaaagttgccttttctacatttcttcactgacactttctccttttttgattacattcattctaactggagtaaccattaggtaataataaagaggtagaaatgctaatgaccccaatttgatcatcacatatgtatatttttattgaattatgcagtatcatataagcataattataatgatttaaaaatgaaaaatagagtatttcaaattgtaaaaatgaatgagaaaataggcgaagtaaaacacatctcttcttcaaagcgcatgccaaatcactccaaaatggacacacatttaaatataaacgtgaaaccataaagatgtagaatgcttgtatgtgtttggtgtaaaagtcgagaccatgtgtgctctgaccaaaacaaggtgggccatatgtgatgtgaaatgtctgttaaaaatgagacctcaaaggctagagagatggctcagatgtgtgtgggttttttaaagatttatttattattatatgtaagtacactgtagctgacttcagacacaccagaagaggtcgtcagatactcattatggatggttgtgagccaccaagtagttgctgggatttgnnnnnnnnnnnnnnnnnnnntatatataataaatctttaaaaaaaaaaaagagagagacctcgagagacacacccataatctttgttagagattttctattataaattaatttctttccacattagtctaaaaaatagttatattcagaagctgaagccctaaatttagcaattcaggttttgagagattaaagtattgggtctagtaagactttatcttctttgagacggggtgttgctgttagcctaggctgacttgaaactcatggcagccctcctgcctcggcttcctaaggggctggaattatgggtatgaaccatcacatacaacataagacgctctgactctgaagagaatcattgatttaatcatctaattaaggcattggtctaatcaaatactcgatagcacatgccctgtgtttaatcgctattgaattgcagtggaaacagcacattgagctgtaagtagctagcaagctgaaaaatcatcgaagcatagcagtgtgtttctgccttgttttatttggtgtcactcttccttttgagacagggccttaatctttacagatgtaagcttcagagtcagtgtaaagactgagatcagaggatctggccaccccatttgatctaagatattgacattcttcattcagatagttcgttcattcagatagttcgttcattcagatagttcgtaagtcccacattttgggtcgttaattgtatcttcgaagcagggctggaattcatgttcccaactcttactctcttcccttatgcatctggagaatagccctgcttgctggaagctggtgtgctgacgtgtgtgcactgctcacagagacatgagtcttcatttctcctaagtcgggctgaggctcccttctgcagcctaaccacttagtcctgggtctggcatttaagattgtagtcattccgaatgaataagaattcagatggaacccagctaagattagattgacataggtaacatttttacaaaagttagttagcaatatttctctccccctagctttgttttttgggacttgacttaagttcacctctgctttccaggtgctgggatcacagatatatgccacttggctagactttttttttttaataagtcaattaagatactaaaaatatatttgacacattcttttcaattatacttttattatttaaaacatttttagatttgatcatattcttcccctctacaagcctttcagatcatctccctcacccaacttttaagttctttctcaaaaaataaaaataaataaaataaaaatagattacaacagcaaagccccttaaaaatcaagaaaacaaaataaaacattatccaaagagaagcaacagaacaaaacatcaagttctaagcaatcgttaattgtgttatcttggattcttgcttttcaaaacattataaactattgatcagctctcttaactttattccgtaaaattttctttataatacaactgacttccaatgatatgcagttgggaaattcttttgtaatttagacttttatactatgtaaatgtcaatagttatggaagcaaatcctttgcatatagattaaatgaaagcagtgcaaatggatataattattttttatttctcgtggctatttggttgtgggggtgcatagtggtgactggaaaataaatctcatgtgcattgtaaaaactggaaactctctgcctaggaaggcacctactggagagctagggagggagagcttgactggcagcgtcatgaacagcccctgactggtttaaatcttctctgtttcctctcattttattctgcttccttggttaaaagtttctctccaggtagtactgtgcccctttcagggtgacaactgttgactacacaggcactaagatgtgtaggaatccctggtcagccagcttgtgtctgtacctctaagtgctatatgtaaatgaagtacctactggttgctatgcttgctggcaggagactgggactgtcccagccctgcatattttaagaagtcagtcgcttaagcagagatgcaagctgactggtccacatagatttacgttatacttttcagattggaatagatttttgaaaacactctgctacacactgcattataaaacagtgccttcaagtattccttttacttatttgattgcttaaattggctattcacttcatactgaacatttaattaattaaataattaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagccttgattttatgttggtgcaatgtgtagctagtccccggtttccttcccggtatttgactcatgatattaagagattatggtagtaacaggttaggctcacctgagggatggtaagaattccatgtttttattttttgccctcagacctttttctttctgggtttttttttttttttttttttttttttttttttttttgagacagggtttttctctctctagcctgactgtcctggaacttgctctgtagaccaagctggccttgaactcagagatccatctgcctctgactcctgagtgctaggattaaaggtgggcaccactacccttctgcccttgaatttgatagacactccccatttctcctgtcagcccagagccattattaagtgagcaaatcactggttttcataaaatgtaagggcacagactcttttactttcgattgaaatccagcatgaaatggctaactttgggtagataatccagcatgtaacggatacatttattcctctgaataaagctgagagggagctggctgacctgcctgccttacccttatccatttaggtttctgaaaaatgacgaaaacacttaagtgttgcctgaaaagtcaaacaatttaaatggagcaatgatctgggcatgagagagaaagagagagacagagagacagagagagagaggcagagagcgagacagacagagagacagacagacagagaatgccttctgtgcagcttttgtgttaggatgctcagagaaattaatcttctaagtacttaagtgtggttaataagttaaattagaaatgcaaggtattggggagtgggtgggtagggggagtgggagtgggtgggtatgggggactttttggtatagcattggaaatgtaaatgagctaaatacctaataaaaatggggaaaaaaaaaagaaatgcaaggtatttggggaagactcttcatctagttatcccctgtccccaggtttcctctgggttgtgtgttagtagtggtatgtttgctctggtttgctttgtaatatggaggaaggacaccatgtccctcatttctgattggaaagaagtctgtcaaaaaatataattaatttttattaaaaattaagttaacaccctatcttggattgaagttaaagatgacagaagcaaaatgtataggtggcttttatatggcatgtttccaaaagagcctttaattaaatttctttccttgccattgtctgtttgatgggcaggtggtagagaaaacgaatcccacagagccagttggagtggtttgccgggtggatggagtataccaggtggtagaatacagcgagatctctctggcaacagctcaaaggcgaagttcagatggacggctgctgttcaatgcagggaacattgccaatcacttcttcactgtcccgttcctgaaagatgttgtcaagtatgaacaaaatagggaccctatttattattattattattattattattattattattattgctaattagaaatgtaaccttttagggagctgggtagaattcctaaacctgctccatagaactcatgtgttgtcttgaggatcgatgctctcagagggaaaactcacatcgtgattgctttacctgagctgtgtcgttttgtcaggtgctgggtctgcgaggcaggctttccctggtgcttggtgcttggtcttcctgcctccaagtgctagacgtatgctgctatgtctagaattgttttcttaatatagaaatcattatttacattttctaggaggaatctagatatataatatttacacatggactgaaactcttcactcggatagcttcagaggtgcttgttgatacacatgtgcttgagtgttttcattttttttacattttgaattgaaaagtgattatatctttcccccctttatttcttagtgtttatgaacctcagttgcagcaccatgtggctcaaaagaagattccatatgtggactcccaggggtactttattaagccagacaagccaaatggaataaagatggaaaaatttgtctttgacatcttccagtttgcaaagtatgatttcaatggcatcagtaagatcaaatatatgctgtgaagtgctgcattttcctgttagccaagaagccgtgctaggagtcacatgagagtctgtttcagccagacattgtgaccacgagagtcattctctaggctgaagccactccagagctgtggtctgtgtggcctgaaagtataattagaaaacaaaagtcaattggcgttatctaggccttttgcaaaactgttcaagtcatttgttttttactgagacactaaaaagattattataaatagttggccaattttgcttagcataactgacctgttcatgttcagtgaactgcaaagatcacattgcatgctgagatagatatttcagattttggccaatgtgaaaatgcagagagcaggctagttgtgtannnnnnnnnnnnnnnnnnnntattgttgtgacaagaccacgtcaaccaaaagaaagttggggaggaaagggttaatatggctcacacatccataccactgttcatcatcaaaggcagtgaggacaggaacttaagcagggcaggaacctggagtcaggagctgatgcagaggccatggaggggtgatcctaactggcttgctgcaatcccatggcttgcccagcctgccttcttattgaacccaggcaggaccaccagcccagggatggcaccacccacaatgggttgggtcttcctcccttgatcactaattgaaaaaatgccttacagctggatctcatgggggcttttcatctctgggatgactgtagcttgtctcaagttgacacacaaaaccagcccgttcaatctgatccgttggagcaagttagagctccctgggttggcttatggcttatgaacactctgtgagacgatctggtgtctgaaacactgtgttagtcatcagaaggcttggtgagcatagaaaaacggtctgcaaggaaggtctgatatggtggaaatctgggtaagggctggagagggcatgctcaagtggcccaaaagagcagtagtaaattggtaattcgcctattgtcccaggtttaaatctgccctctgtactctgttctgtgatgacagagctgggattttgcaaaccagacccaggggttcccctttatgggattcctcttaggttttgactgcaggagacaagaggcgcagtcaaaaggcagaacaagacaaagtcatttttctgttccttgatattaacgtcactgctgcagatatggcaccttcccccagcggtggcatttcacaccacggtgccagtctgctccagctcctttcctatttgcagaacctcaatgtgccaactcatattgtgccagaagaaaccccgtgtgaactgcctcaagtgtcaagctctaatttcctgatgtcccctccccgcagcacttcagtctgatctgtccacttttgttctccgaggcatagggtggtaactactgtttgaagtttgtctttctcccagttagccttccaagagccgtgtgaccaattcttcataatgacgctcttcaatttctgttgaaatattcagggtggggcgggtggtgtctgctttcttctgactaattttttttgtgtgtgtgtgcaatgtgtatgggtgttttgtctgtacgtatgtgtatgtagcatttgcttgatgcctgctggccacagaggtcacaagagggccttggataatctagaactggagttacagatgtttgtgaagtacgggaatcaaacctgggtcctctggaagagcaggaagtgcttttaaccatggagccagctctctgccccctcccccactgacaacatttctttaaaatatttgttatttttattatttctgcatgtgtgtgtgttatatctctctctgtgtctctctgtctccgtctctgtctctgtctctgtctctgtctctgtctctctctctctgtgtgtgtgtgtgtgtgtgtgtgtgtgtgtttgagatatgtgtgctggtgcctatggaggccagaagagggcactggagcccctggagctgggacacccaacatgagttctggggatgaacatttgtcccctgagtgagtagcaatcacccttaacttcagatgtgtctctttatgcattctgacttatccagaagtagagtgaacttaaaagaaaaacagtcaggactctaggcaacaggtagccaaagacttaccagggacagcagcatgagtcttctagctatcttccttaactgggatagtgacatacatctaccttccattcttgttgggatgttaggaaacacaccagagtagagatttagaaggacgctggttgcacattacctaagtttacttgtcacagttttagtcgtaagagggagcatactgatgttacaaggatgcagtgtgttgtatgggtcctggggcagggattgctgctctatcttgggaggagtgtaggactgggaactggaagaccaccaggatctttactggtatcattttcttgcaggttactgcattccttctcctgggaattttcttcctctgtctgatcccataggctatatgatgcagagaacatttctgcctatggctttagggttgatatctccttgaaaatgagaactgggtagaatttttctctgcttcattttcaaattttttgtaagacagcatccaaagaacagcttggtttagatttctattcacagtcttgtcagctatgaccctggaagcagagattccctaatgaaagcatagattcaggtggcccgccctacgtgagagcgagaacagcataattgtgcactgagaagacattcaggcctcggcctgtcaggcttggtcttagtaatggcgatgatgaagcttggagttggagtgaagaccagcttttggtatcagtgtttgtttcagattgattctataaagatatgggggagtggtgagaaccgagccttcagataaggatccaggacctgcagggctgaagactcagatccaggacctgcagggctgaagactcagatccaggacctgcagggctgaagactcagatccaggacctgcagggctgaagactcaggacatgtcctacccttcatctgccttagatctctcaagcatagcctggatttctcatgaaaaatttcactctagctctaatcttcaatcaattgaagaaataaaggttgcccattcactcagcaacaatgtgagcactcctatctctccagtgctgctgacacaccatgggaagactttctccagactccattccttttatactagtcaggcttctctagagaaagagaatggatataatgactctgaattaaatgaggattagttagagtgacttacaggctgtggcccagttggtctaacaatggctctctctccatggaaaggtcaagagtccactagttgctcagtccacaaggctgagtgctcgactgctctttggtcattgttggaacaccaaagaagtaggtgctaataacagtgaaggaatgcctcggtagcaggattggggaagttgccaatgaaactgggggcaagtaggcaaacagcaaactcttccttcttccttgtccctgggtagtctgccatcagaaggtgtggcccagatttaggatgggtcatctgacctctaataatacaatcacaggagtgcccaactctgttggttttagatgattccagatgcagtcaagttgacaacaagatgtcccaggatgcagtcaagttgacaacaagatgtcccaagcccctgcccaagtcactcccacaattcctcactggtccagggatactttgctgattttcctatttattttgttagcacaaatctcttcagtggttcaaaagaaagcattttgtgtaactggacaaaatgtcttggacatgaagggccttggagaataaagactccatctgtcagtgtaacatctgagccttccttgaagcacaggaccaggaactgtctgggaatttgagtgctactgaccattccacactggacatgcacacagaaaattaacacagatgctataaattcttttctgctgtgaagaacgttgaatattagaagcaaggaggtggtgttctggtggtaactctgggcaacgtgatggactgacctgcaaagaggaagatggtatgaaatccttgaattgagattctgtagaggacaacatgatttttttatacttatttagaagctccccaacccaagtgacaatcacagatactatccctgcatgcatcccagtgccccttggacatagatgaggagagtcatgcaaatctctaaaggtaagcctcaaaaagtaaaaataatttgaccttatgaaattggattcaagtagatcaattggagactgttgttcctcccaacacactggaaaaaccccatccaggaagagtggcagctgagggtcttcacacttcacaaagagggttatggttgtttatgcaacaagtacaccaaactgtgacagagtcaggaagacactgctgttcctcagactctattttgctgtgacagataaatgtgtgagatgctgggagataggtgttgctgagtgcaggataaagtacaaatgtcaggagggaagggaatcaggatacatacaaagctgaccatgagtgttgataaacagccaagttgttgaaaatggtgttccctgaagacgttttaaaataagctggtctcttagccaagggtagtgcagcgctccagccttatagccagaagaaaggtcatagtctttaggataatgctgcaaagcaaactgttccagcactttttgtaaccatcattttgttcaggagcccacagccaagttaaggttccgtgtttcttggttttgttttatttcacccttcatctctggaggtctgctaggcgagaaaagacaaagcagaaagcaaggaaagcaactggtgtggtcactagaatcagatgactgtccagtctagaggctctgggaaggtttgccattgtcacccaatgggcagagggagtattgaacagtgtaagaactgtgacataagctcagatgctgccattccctggacaaaatcttcaaatgagctactgcttctcaggcccccctttccttatgtgaaacatgaggatattaatatctgcattgagtgaatattggggctgtctgaggactggatgaagtcatgtctgcgaaggcactctttaaactgtcatatactatatgtggcattgttctaaacgaaggcgaaaaggagtcttactctcaccattaaccctaacttggtctgaactcagaacagtcagaagatagtctgatgtgaaatactttctcaattctcatcccattctctgggagaagagcttgggaaaagacagtcaatgatggggtttcaggggtggaaaggatgggaaaggaaaatgagtttccacatggataacacgcatctttgaaaagctaagaaatagatttcctaagggctcggcaatctttgctattcaccatgtagacacactttcctgttagcaaagcatatgtgtgcacacacatattctagctccataaggcatagagttgggcagattggtatcttgtacattagttcctcctactgatgcagggatgtctgagtactctcccaacaaaatcttgtatgcatcacacaaaggaataaaagtgagggttttttttttaaaaggggtgcctgacacatacattgtacactcaatacattttgttttatgtactatatactactatatatgatatacaatacttaatttattatcttatcagaccgtcacagcccagtaacttgtctcctcaccttgttctctattttatgaccagttaaggacttgcccatggtgaagcttccctccagatgtctgaattcaaatcatttcccacgaaggagaagaacatctgtcagcacacagagctaaggcgcaggccagaaagggaacaatttcacagctagatcaatctctgaagaacttcaacttaggcagatggtatccatgctttgatgcatgcaggtctatagataatccttcagcctctgaaggtttgctagccatgagcaaactccccccgaggaaactgaaaacagtctatgtagctgtttagatatttagaccatcctggctttaagaaaaccagtgtttcctttggtctttctcacctgattctactgtatgcagtgttctctgtctccatgttggtataatgttttcacagggtaggcgttgtcggtctttacgaattatcggtatagttcacagtttggtggtctgcttactctgtctaatatttcctggcaattgatttacttgcgagtgtggagccttgcagcaggatccccagtgcattgcccatcacctctgacttcaaatgcagatgatggacacatgaagcgtgcctgactgcagaagcaagttcttctcgcttaggttctggaattgggcttcaaatactcatctggccatgtctaagtggcgtgaagaggtatacattttacaactaagggacaatgtgagggtttccacctttaaatgtgtgtggaaaggaacaccattggtttgctgcaggggaggggaagaaatgaatgtatgtagataaagggaaaagacggcagagagaaggcacggactcggccaccagcagacaatttccgtgaaaactcatttccttttaaggacatctgaactgtccagcttctctttctgcggcatcagagcgtcccatcctactacgtattgccaggtgaaatgctacagttaccatagctatttcagtctcaatagtcctgcttactcgggtctcagatacaggctaagttcttgaaaaatcatttgtcatttgcatgtttccttaattggtgctctttgggggggggtgttgaacccagggtcttgcctatacttgggcaagtgctctacactgacttacacccactcctggaccaccgcatcctcaccttcccacagagagagattctatttttagtaagaccctactaatggaattccgtagtgcttctcagttaattcattttcagtgtaaaaaagcactcacaactaagatgtattaccttctacggaatatgaataatccggattgcagtgactcatgttgcccaggccaaacaaaccagggggtaaaatttgcatacaaaagagtaataaaacattatttctccacatctgttcccacagcattagggattctagacttgctcaaaactgtctaacggttcacaagtcctggggaattttctttcctgttctgtgagttggtgcttttaagtaacagttgctatctctgttcttccccgtccagcaaggactctccaaatgccaaagaggcccagatctcactgctccacctgagagttcttgggaaatcgaggctcaaatatcattccttttgtgatgggagagctggttctgtgttcagagcgcttgttcttccagagaactcagtcaggttcagttcccagcgcagttcccggggttcaatcaccgtctcctgatgcctgagagtaccaggcactcatgtggctcacaggcaaacagcaggtaaaacactcatatgtataaaaaaaaaatcgttaaaacaagtaaatgtgccgtaaatgacacttaagtatttcagtgaaatcttacttttagcttttccttgctctggttccagtagcatccaatttttagagttcacaattggacctgccatatggctcaaaccaaccagaacaatagggaatttggggtgacataataacagatcgggtattttttttccccctctgagctactcctaacctttggcaaagcttggctgggcttacatttcttcatcgtgtgtgtgtgtgtgtgtgtgtgtgtgtgtgtgtgtgtgtttatacatgtgcataggtatgtgtgattgcctatgcatgtgtgtaggctagttgggatggaggccagagattgctgtctagatctgttctcaataacgcttccattccccccaccccctgagttatggtctttcactatacccgggacttgctgattcagctagactggcttgcccccgagccccagggatccttctgtctgcacatgccttactgcactgcctataggcagttccagctcttttcttttaaatatgggtatagacctgtaaactcagtctttatgctcatgtggcaaggactttacctattggctcagttctcctggtcctggactttcccctttcaaagccccttggttcttcctagtctgtctactattccccagaagtcctcttgatctgtagacaaataaacttctgatggggatgtccatccatcctcagacagattcagagggtctgggttttgaaggcaatgctgttggctcaagaataattctatatagccctaagcaaacagcccagcttgtgaagcagcatcatgtagattctgatgttggaggacacatatccctgtcttttgttaggctcagtctttgcaaagtgattcccttgcttctcagctttaacctgtgacctcaccaaacaccgttcatccacacggggcagcagattctaagcatatgtctttggccagatgtccgtggatgtcacgggcaagcacccagtgaaacgtctgaacaagtgtttataggtatttatgaagccgagctaactatctcggcttcggtcatcctcacacctgacatcatatgccctatgttgtttgaaggatcctctcaggagagtcatctctgttctaccatcctctttgtaaaataaccttcattctagtttccttctccccacttgtatttgccgtgcactgttgtctgtgtggttggtccccggcagagccgcctcattcccggtgccctctccacggtgaagcatgaccctcacagctgctttctaatcctccggcctgtggtgggcttatgacccttgggtgactcaccgctgacggtcaagaccttaatttcatggccagcccaactggggctttccatgtgtcaccagcctcctgagggaagcgggccaagtgccacactcactgaggtatgctggaccgttccccagaagctccacctctcccgctgctcttctccgaggctgtctactcaaaggcaggcagggaagagttggcagagattgctcagaagcccacaggaagaggtgtcactgtgaggaggctagctctcaaaagaagactgtcttcctaactaatctgtgccacctgcctcgctctactgccccgctcacccagtggtcactaaccacacagggaatcagggcttccaggtcccaggcttcgtcaagagtgacccgggatctgaagggttaagagcagaatctgggtggatggacaggattcttagttatcatttggagagcccagcaggagtgcctcccctgttgcctacatattactttcacatgatgtctctttcactttggccacagaaaggagggtgggggtagggggattagaagagattttttttttttaaaacaaaatatttagaaagtccttgtgttttcatttatcagcaggaatccagggtagaaacagactctgagcagtagccaattgaggactgaatctaaaaaaagtagaaattctggacactagaagcatctaggttcttcttccttttcttcctctctctctctctctctctctctctctctctctctctctctctctctcgcagtgagggaaagagagtaaaacaaactttctggaggagggctcagcgctcagctctcatggccaaaatacgaaagatcagctcccatgtgtgtgactcaactgtccaggaaatgagaatcgcaagagactccaaacctgacgttgtgcttatagcttcagctcgagtaagaaaaatgaggtggggggagtaccccatgacgggactcgagtctcagatgcaggagaaaggcaccgagaggcatggtggcaagaaggcaaaggagagctgcagctttaagtcctcctatggttatacatatttttct

SEQ ID NO: 80 - DNA, 1363 bp, Mus musculus
cgcgctcccctcggccgctgctcgtggcccgccccgccgccccggcccctcggatgacagtatatattccaggcgggcgcgggacacgggcgagtagccgagccgaaggagccgcgggattgtcgagggagctctccctactctgtttttaccaagcttcactaccagagcactatgaatgtcaatgacctcaaacaaaggctgtcccaagctgggcaagagcacctgctgcagttctggaatgagctgtccgaagcccagcaggtagaactttatatggagctccaggccatgaactttgaagagctgaactcctttttccggaaggccattggtgaatttgatcgatcctctcaccaagaaaaggtggacgcacgaatggagcctgtgccccggcaggttttgggcagtgctaccagagatcaagagcagctgcaggcctgggaaagtgaaggactttctcagatttctcaaaacaaagtagcagttcttcttctagctggtgggcaggggacaagacttggagtctcatatcccaagggcatgtatgatgttggcttgccatcccacaagacgctttttcagattcaagcagaacgtattctgaaactccagcagttagctgaaaaacaccatggcaacaagtgcaccatcccatggtatataatgaccagcggcagaacaatggaatcaacgaaggagttcttcacaaagcacaagttctttggtttaaaaaaggagaacgtggtgtttttccagcagggaatgctgcctgctatgagttttgatgggaaaattatcttggaagagaaaaacaaagtgtctatggctccagatgggaatggtggtctctaccgggctcttgcagcccaaaacattgtggaggacatggagcaaagaggcatctgcagtattcatgtctattgtgtggacaacatattggtaaaagtggcggacccacggttcattggattctgcattcagaaaggagcagactgtggggcaaaggtggtagagaaaacgaatcccacagagccagttggagtggtttgccgggtggatggagtataccaggtggtagaatacagcgagatctctctggcaacagctcaaaggcgaagttcagatggacggctgctgttcaatgcagggaacattgccaatcacttcttcactgtcccgttcctgaaagatgttgtcaatgtttatgaacctcagttgcagcaccatgtggctcaaaagaagattccatatgtggactcccaggggtactttattaagccagacaagccaaatggaataaagatggaaaaatttgtctttgacatcttccagtttgcaaagtatgatttcaatggcatca

SEQ ID NO: 81 - protein, 436 aa, Mus musculus
  VARIANT (1)...(436): Xaa = Any Amino Acid
QYIFQAGAGHGRVAEPKEPRDCRGSSPYSVFTKLHYQSTMNVNDLKQRLSQAGQEHLLQFWNELSEAQQVELYMELQAMNFEELNSFFRKAIGEFDRSSHQEKVDARMEPVPRQVLGSATRDQEQLQAWESEGLSQISQNKVAVLLLAGGQGTRLGVSYPKGMYDVGLPSHKTLFQIQAERILKLQQLAEKHHGNKCTIPWYIMTSGRTMESTKEFFTKHKFFGLKKENVVFFQQGMLPAMSFDGKIILEEKNKVSMAPDGNGGLYRALAAQNIVEDMEQRGICSIHVYCVDNILVKVADPRFIGFCIQKGADCGAKVVEKTNPTEPVGVVCRVDGVYQVVEYSEISLATAQRRSSDGRLLFNAGNIANHFFTVPFLKDVVNVYEPQLQHHVAQKKIPYVDSQGYFIKPDKPNGIKMEKFVFDIFQFAKYDFNGIX

SEQ ID NO: 82 - DNA, 58329 bp, Homo sapiens
  misc_feature (1)...(58329): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatcatccccagcatcctacacactgtagatgcacaaatatttttctgacaacttaaccctctgaaggacagcatatacttttggagggtgtgggaaacactgggtaaaaaaaataaatttgtcatttaatagagtgtactcatcattccacagaatttcacaacacactttgaagtacagaaaatttatagggtggaagaagtggtaagctaagtcaggatgatctcttgggagaatgaagtaatgtcctaggaaactgtcaaaaggaaagtcaaaaccctaatcccaccccacccatttatttgaaggctctcagaaacagtgacctcatgaatgctcaggccttgccttgaacagagccttgagttgagccagactttctcctggtgtgttgtctatactgctgggaaataatacggacatttgcagaagttcagtggactagctgaggccattgcactcaggacaatggagggaaggctcctctagtgtatacttgctaataccagcctactgttaaaaaatcttggtggggcaaggcacagtggctcacgcctgtaatcccagcactttggaaggcagaggtgagtgaattacttgaggccaggagttcgtggccagccggacaacatggcaaaacgcacgttttctactaaaaatacaaaaattagccatacatggtggcacatgtctgtaaccccagttacttgggaggctgaggcatgagaatcacttgaacccgggaggtggaggttgcagtgagctgagatcatgccactgcactccagcctgggcaagagatggagaccctgtctcaaaaacaaaacaaaacaaaacaaaaacaaaaaaccctgggtgatggatcattactggttgtactaagcaagagagtgtggccagactggcacatatctgtcatgacttcagagaagaacaatcaaggaagcagctttttaagttgttagcatgcctgctcttctgaaattaaaaaaaaattctcctaattataaaacaatttcctctgtagcatatttagaaaataacccctcaaaatcatccaaaagaatataaaaatcaccataattctatcatccctaaaagacaaaacacaaaacctactcttgtatgtcttgaattttttaatttgtttgtagtaatggcccacttaaaacatctctcctgtaatcgtggtatgattgtttgtttgtttgtttgtttgtttgtttgagacagagtttcactcttgttgcccaggctggagtgcaatggtgcaatcttggctcactgcaacctccgcctcctgggttcaagcaactctcctgcctcagcctcctaagtagctggtattacaggtgctcaccaccactcctggctaattttttgtatttagtagagacggggtttcaccatgttggtcgggttggtcttgaactcctgacctcaggtgatccacccaccttggcctcccaaagtgctggattacaagtgtgagccatctagcccagcctgattctatatttttaatagaggactattctatttcacttttttctttctttccttctgtctttcatttattcacctaacatttatttattatttattttattttattttattttattatttttagacagagtctcgctctgtcacctgggctagagtgcaatggcaccatctcagctcactgcaacctccacctcccgagttcaagtgattctcctgcctcagcctcctgattagctgggattacaggcgtgcaccaccatgcccagctaatttttgtatttttagtagagacagggtttcaccatgttggtcaggctggtctcgaactcctgaccttgaattcacctaatatttattgaatagctactgtgtgctaggctttttctcttttaattctctttccaactccatatttcaattttgtagatgaggaaactgaagttcagggaatttaggtgatttttttccaggtctcaccacttctatatacctgttttattttattttattttatttttgagatgtgggtctcactctgccgtccaggctggagtgccgtggtgtaatctgggctcactgcaacctctgcctcccagcctcaagtgattctcctgcctcagcctcgcaagtagctgggaccagaggtgcacaccagcacaccagctaagtttttgtatttttggtagagacagggtttctccatgttgcttaggctggtcttgacctcctgggctctggcaatccacctgcctcggccttccaaagtgcttggattacaggtgtgagtcaccgtgcccggctctatctatctatctctctgtctatctatctatctagcagatgaaatattatcttttggaaaaccaagctgagatcataatacactgctaaaaatacatacattttggtaaatattccattttggtgtttcaaattttacagtttatttaatagcaacccttaagtagatatctcacttttttttttttgagacagagttttgctcttgttgcccaggctggagtgcaatggcgccatctcagctcactgccacctctgcctcccgggttcaagtgattctcctgcctcagcctccaaaatagctgggattacaggcatgtgccaccatacccggctaattttgtatttgtagtagagacagggtttctccacgttggtaggctggtctcaaactcctgacctcacgtgatctgcccgcctccgcctcccaaagtgctgggattacaggcctgagccaccgcgcctggccagatgtcttactttctaagttctcaacctgagtacaaattccttggtctttttcattaaggaggcagcaggagttagagaaggtgatggtgttacaaggggggaaacacatgaaggcctctatccccaaggctgcttataaaagggcagcctcccatgaggagtgaggctgtcccttgcctcctgcctctttcccaaaccttctggctgtccttttgggaaacctcttcattccttcatactttccctcctctgagctctgaaatcctttatttgtgcattcactatggcgcttatgactctctgcattgaaaaagaaacctcttctatctctattattgcactataagccattaaggacacagaatcttttgattccctagaatgtctatcacaaagtctagcacagagcagccaaataaacatattttgagcaaacatcagtttgttcttttttgaatgctgaaaacacgccagtttgcgcttaagagaatagttcaacttcagagacatccatatataaacatggagggatttcaggcaatgcccgctctgtacaggtttctgtgctcttcatctaagcctccactgtatccaactagaaggctgagaatcacagaaaaacattttcctatcattattcccgtactaaggaggcacagttgccaccataaacagcacttaccggtggcatttacagcttctcaggtgatgtggcattctgaccagatgccagaaggcttgtgacatggtacagatatgctgttctgtacactgtcacacctttcctggatcattttccttcagagctgtgtgctctgtgggttaaagattttcttttgtgttggactggtaatgaacaactccactgttggttgtattttaaaattttatgtaatttcaatcttacttgaagaacagtataaagaagttctaaataccctttaaattaactgtgttttcctccatttactttactattatttactttgcctcccaaatttctttcttgcctacccccatgtatttatgcacatatatttctttctgagccttttatttatttattttttgagacagggtctcactctgtcacccatactgcagtgtagtggcatgatcacagctcactgcagcctcaacctcctggactaaagcgatcctcctgtttcagccttgggagtagctgggtccacaggcacatactaccatgcccggttaatttttatgttttttaataaagatggggttttgccatgttgcccaggctagtctcaaattcctaggctcaagtgatcctctcgccttggcctcccaaagtgttgggcttacaggcgtaagccattgctcctcatctttctgagccatttaagaattacagacatcatattcttttacccctaaatattttagtatgtctttcctaggaacataaacattcttttacataaccacagcacaatgaccaaaatcaatttatttagtcatttgttcatatccgcaacacacatgaaatagctccagaattttttcatttgatcaaatatcttgtgtggcttttaggcatcttttataactctccttacacagattttgcacattttgcgctaaatttatacttaattttttttgttgctgttataaatgggattttctccaccatcgtgtcttctaaatgttataatgtgtgtatatgagagctattgatttctatatgttcattttataacttgctaccttactgatatggtttgtctctgtgtccccacccaaatctcaccttgaattgtaataatcttcatgtgtcaagggccagaccaggtggagataattgaatcactggcgtggtttctgccatagtgttctcgtgatagtgagttctcattagatctgtttttttttttttttttttgagacagtctcgctctgtcatccaggctggagtgcagtggtgaaatctaggctcactgcaacctccgcctcccaggtttaagcgattctcctgcctcaacctcctaagtagctgggactacaggtgcgtgccaccacacccagctaatttttgtatttttaatagagacagggtttcactatgttggccaggctgatctcaaactcttgacctcgtgatttgcccgcctcagcctccaaagtgctgggattacaggcgtgagccaccgcgcctggcagatatgatggttttgtaaggggcttccccctttgctcagcactcattctctctcctgctgccctgtgaagaggtgccttccaccaggatagtaagttgcctgaggcctctgcagccatgcagaactgtgagtcaattaaacctcttttctttataaattacccagtcttgggtatctcttgatagcagtgtgaaaacggactaatacactaaccaaaatttttctgtggtttgttagtcttattgttgactctcaagggctttccaggtattctctcttgtcatttgcaagtcgaagtagttttatgactttttaaaattcttaaaaaataattttttaattcttatatattttttctaatttataagcctcttaggatttctgttgtctaacttcattagctgatacctttggtgtaatgtcaaaaaatcataggtagtgtgaacatcgttgccttgttttcttcaatcagctcttaaaagaccatgtatataaaaagtatttcgaaggacagaaataactctagtgttagacatttctggacatttagctggcaagatgagattatggcccctcttatgcctagtaaccagaataacaaacaaatgaaacttcagcaaaaaagggtaaaagtacaaatgtgattttatagtagttcattaaaaacattgagctggacctcagttctatcttttttctttaaaggattgctaactaataattttgctctttactcagtcattcatctatgacttatagaatgcctataatattccagacattatcttaggttctttctcattttttactatacccatgtgaaataggtattagcttcatttcataaaaggacattggagtttggagtggttaaatgacttacccaaagtcacacagttagtaagcgtagactgattttgaatctgggtctcctagtttgaattaataagtgctcaataataaataataactaaaggttatttagtgtttactgttttacatacttcatttatatcgattggtttaatacaaccaccaaatggcattttcatctttattgtctgttttttatagatgagaaaactgatagcacaagtagcttgccaaagatcacaagcaataaagctgaaattgtcttcagatcccatgattaagaaaccaatcactacactataaaccaatcactacactattcttctttcaaagaaacgaaggaagttctaggatcatgagagatggagagtattcaatctcctgaatgtaaatctaccagcattacttaccaagtttaagtttttctgttgttacttgaggcagtgggtgattatgcaattggtaaagggaatgaaaaggcctttgcacccaagaaagtagaagaaaggcgcctgaatctctttatgataggtggtatgttaaatctaggtattttcgtatttcaacatattccacttcttgcaaaagctgcaaaatgcaacacaactttaaatgtaaacatagcttccaagggcacagtgctgaacatataataacctgtgtgtgcacacccacactaggttatgtaacaggactgtaaacactggtcctggaatggcctgggaggtcatctaggtcctccaccatctttctgcagagtactgaggcctagcgacgttaagtctgcaaactcacaaagatgaccccgggcttatactaccttaggttacctactacctttgcttgcatttcctctctcctttcctgtctgtttgtgcaaaagaaaaaaggcctggcttcgccttcttgggagccaaaacacaaccaaacagagagcgagtttggagcccggccaggcatcttgtgaactgcacacaaaataactagcccaaggtcagagagcgcgccaggcccgccctgaaagtttctccgcaggaaaatccaccgccctttcccaaccacccgcgtgggtggctcggaaatccgccaccctggggacacagctccctgcccatctctgtggcccgcttgtgccccgtgccgctgggccgactaagagcctcgggctcgcacctcccagtacaacctagggacgtcaggggtcctgggacccacgagccgctctctgccggccggctcctggcccctcctagcagacccaaccgacatccttcaccctcagttagtgcgcaggagggaccgggacgccagccgactgcgctccagaactattcccattgggccagagaatgagtgacgcactaggccccgccccggcccggtgggttactcctttcatgcccggcccccatccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccgcatgagggtatatattcggagcgagcgcgggacgccgatgagtggccgcgcggaaggagctggagacggtcgtagctgcggtcgcgccgagaaaggtgaggggctcccagcccagcgaggagacggcggggctcgggacccgggcgggcggagggcctggccccaccgcacacacggccacgcgctcagacgtggacacgcgtcgcacgaacgtgcacagcgcgggcagccgagcacacgccgaggagcctcccgctcgcccgcagacacacaccccagcccgtgcgccccgcagtcgcaccccatcctccgccaccccgcgagagggtgtgtgggctgggcagccgggtggatggcggggccagggatggaatgagcgcgccccagatggactgggggcgttgtgggaggaggtctgggccagtgtctgagtccgagggggtcgtgtaggcgtgtggggttgggagtggggcctctcccgggtgggcagtagagacctcgaggctctcaggctagggccttgtggacagttataccaagtgtgggggcctgtagtgggacaggagatcgttggcactgtcaggtggaagcgagttggtgtgtcttgaatatatgaggaaaagatttgagaggtctgacaaagacaggggatacatttggaggacaggacagtgggacaaaacctgtttgcttgccacttttttctttcttttttttggtttggtttgccatgatactggtagtgagagagaattgaaatttctgggtttcccctctcttggccaagcagaaggatggtattggagggctgagcacacgtatgctgaacatatggctgcttgaactttggcctgtcgctgtgctacacttacttctacatggtttatgaaatctgaaatcaggtaataggattatgatcatatgtgtgtgtcatttggtattgcaaaagtttaaggacttttaggtgaaattcactgggtgtggatccaagagttcgccggaaactcaaggcagttgtctattccttcacggttagtcagttggctcacttagctggagcaaagaaagacttcataggctgtgctgccaagcatttataggattcagttggtggttatgtctcaactctgatactgtttttcaaaagctttaagaggtttacttattcatttcgagggcatacgtataccagcagagataggggctgggtgggggaagccagaaaaggagggagaaatactggatttctttaatactggtatttaaattctaataaaaatatatttgataatggtagattattaccaaatttttcatatattttgatgcagatggattaggctgtgggcatgtaccaagttttgtcataatttctcgagcagattttcaactttttcagatttcggttgtcaaaataaaaatccatatcttttaactcttctgttaattgctgcttaccattacacgtgcctctaaacatcgttaatgggaaacatgctactatttttgtggcatgaaggtgcttatatctgcctcaaataaatataatagatgaattgtgcttgtccaaaactcaagtatggtcgttacattatgaacattatacaacatgtagatgaacacatgttaccagtggtttacgcccagatatcaaagtttaacctatgaggtaccctttttttttttatttttattttttgagacggagagtctcactctgtcgccaggctggagttcagtggcgtgatgtcggcttactacaacctccgcctccccggttcaggcgattctcctgcctcagcctcctgagtagctgggactacaggcgcgtgccaccatgcccagctaatttttgtatttttagtggagatggggtttcaccatgttggccagaatggtctccatctcttgacctcatgatccgcccgcctcggcctcccaaagtactggaattacaggcgtgagccaccgcgcccggccctatgaggtatcttatttgcatggattcattttcccaagtgtctgaaggtggaggagtatctaatgatcttttaggaaaagtttggtttatatcttaaaatgttatagtaatatgtttgtgtatgccttttatcagacagagcactctttactcttgactatcttgaaggcatgtgagaaaggttggttgtcttatattcatgaggaaatctatgcacagggaggtaaaatgattgcatagaatcaaatgatagagaaggaccaagaacagggacttcctattctttggttatctggttccttgctgatcttcctactacaatgtactcccttaaatcagaggcaaagcagcagcataaataaggtcttgggaaagactacattccttggaaaataatttaatataaatctgttcctctcaagtgtcttttttaatgtgattttttaaaattaaaaaataatagcatcatgactcttgaaacctatataaatcaataggaatgccttttaataccataatgaacattgaaagctgagtgttgttattaccacctcagggaacacacagatgtaggttctctagacctgagcttgtaaatggagtttgatgtttaatgatcctggtgaggtagatactattattaatctcattttacagataaggtaaccgaggcatggggaaattaagtggctcagcttagcctagaattgtgctctgaactaccatgtgtattacttttcactgttcttataggaagagaagataagtgtctttagaacctacttttaacctctgtctctcacatcgaagcaattataatgcagtgatgattctttacagtgaccctcaaatttattcctttcactctcattttctctgccactaatctggttcagacctttggtatttcatacctgcagttgtcttttaacttcttttcctgcttctagttgtccctccttacaatctattgtatccattgctcctttctctcatctctttaaagcatggtaacactgccctgtttgagaatctactgttcgctttctattacttattctctgaagtctaaattcttttggttagttttcaggcttttcatgatctagccctaccccaggccattttatatcatttgtcatacgttaaccttcttactgctttccatcccacacgtgcttgctcatcatggccaccaggctctgcttgtttcctaatcttttatttttttgagatagaatttcctgttgctgaggctggagtgacatgattacgcctcattgtagcctcgaccttccgaattcaggtgttcctcccacctcagccttccaagtagctgggactacaggcatatgttaccacatctggctaatttttgtgttttttgtaggggtggggttttgccatgttgcccaggttggtcttgaactcctgagcccaggcctgtgctgggattacaggtgtgagctaccatgcctggcctctaatcttatctatgtagtctgcccaacccttaacacatggctagattgtgcctgtttgtgaactttctagacagcacctatctcctgttgcatttgtctgtattgggcaagtagattaaatatttccccattttcttattttttagcactatgaagtttaacattttactatattatcacagaatatagctctttagaaaacatttgtcttattcactgattgttatatgtgtattgcttgtctctttaaggaggatccaagtttttaatgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcaccggttaggttacttagcctctctgcctgtcttctcagctgtaaaagagtggtaataatagtgcctatgccatagtgttgttgaaaattaaacaagaccatgaaggtaaagtacttagaagtgcctggtacatattattgtcttacaggtttgatctcttacaaatattgagtgatggaaaagcagaagttaatttttttaacatcgttttgaaatattcttatttttagaggggaaaaaagccctcaattttggaggttggattttgacatgccattaattacttttctcttttaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggtactgggcatgtacatatttcttactgaagtttatttgagatatactaaaattgttcaggtagctggatcatgtcactaatattttgattcatactacattaaaccaggtgacctagcagaaagtgacaaaattgtctttttatttttgatgctccatttaaggcttctctcattcaagtcttaatttgcctccagtctctttccctcctcaatttccatacttctgctagatttcttttcctgaagcacaagttaaatacttaagtttaagctggcttaattttttttttttttaagacagagtctcactctgttgcccaggctggagtgcagtggggcgatctctgcttactgcaacctccacctcctgggctcaagtgattctcctgcctcagcctcccaagtagctgggattataggcatgcactaccacgcctggctaatttttgtatttttagtatagatagggtttcgccatgttggccagcatggtcttgaactcctgacctcaagtgatttcgcctgccttggcctcccaaagtgttggggttacaggtgtgagccactgcacccagcccagctggcttaatctttaaacctgccctaacctgatcctaacccatatttccaatcaacattttagctgaaccaaataattcacctttccctgaacatgataccatgccttccctgcttttgctcatgtttatccttagcttgatgtgccctttgccctttctctacctagctaggtcaccttgtaaggtcatttcttgcagttgtgcagtgcagtagttctgccagttggggaacttacactcattcattaaggtttaccacacataatattttatctatgaccttttcttttgtgtcccaagttagaattagttgttcatgcttttatttcattctagcttatcataagagttcttcctcaataaattgtaaattcttgaagaacagcccatgtactagttgtctctgcatgttacgtagcatttagaacaagagttttatagttataagttgatcaataagtgtttgttgaattgccccaatgcttttcattctaaagcatgtaaaaaaatctttccccttaacctaatactaatttgtgcttttgagaatggcaaaatagctcaactgtagcttttggtggagttgaaagctgtgttttttataatctattactcctctgtaagtaaaatgttgactaaatattgtagctgattccctcagtgttggtacatgatccttgtcaaatctgggcctcattttctcaactgtgaatgagaacttgggcaaatactttccttagctttttaagacattattttattgcaaaaataatattgaaataacagattgcccataatctcatcaaagctatatttttatttgctcacattaccacccagtacttgattgtgtacatatttttttgtttctttgtggttttttttgagacagcctcgctttgttgcccaggctggagtgcagtggtgtgatcctcactcactgcaacttcgcctcttaggcttaagcaatactcctgcctcagcttcccgagtagctgggattacaggttcgtaccaccatgcccggctaagtttttggtatttttagtagagatggggtttcaccatgttggccagactggtctcgaactcctgacctcaagtgatccgcccacctgggcttctccaagtactgcgattacaggtatgagccaccgtgcccgggcagattgtatatatatttgatttcatagatgtgtagtaatactatacatacaatcttatagtctatatttacaacatggctatttttattttgttttccactctttggcatccccttaccccctgtaaaaagaaagattactggcattatcaacctgctgtatacctctctctgtctttctccaggctgacaaatttactgattttcaaagggtgttccaaagaacccaagggttttcactgttggggaagctgcctcttatagggagggagggagcagatactaaactggtaggtctccaacccctttatcctctactatgagtagttctgcctttttctgttctgtgtgtttgatctttacatgaggttttatttaaaagagtttagaagtttaaaaacagtttgaaaataattggatcttcttcaaggaggtgcttttcagatgtaaaatgcttggtagtagctaacctagctttttacttaggatagggctctgccactaagatgtgagagaatgatgcctaggtatgtccttgtgaatgaagagtttgataccatgacttctattactttggattcactaatccttcccttcttccctgggtttcaaaaaggctactattccaaaccaaaagccacacaggcctttctttaccctctagtatcccagttgcctatatttttcctggggattttaaggggatgaagtcttagtagtaactcttatggaaagtcaacactttgaccttgttggggaacataagccacaattaaggtatcctataatttgagtcttctttatgtcctttttgttggactatgtggagctagtctacatttatgacttttcatgtaaactaaaatccggaactattagaaccaagtatagcataacacggtgcaaacttccttttggcttagtgtcaaaggaaagatatttatctgtagcttaaacagtaagggtggagaaggagactttatgttgacattatatccttttcacttagccagaaactaccgtgtgtctgcaaattcataacaaaatgaagtttctgcagtaagttatcaaagcgaagagaagccattgtgaagatcatggcattgtatttcaggtagtaggaagatcctggtaattgtatcagggacagtttttacttccccacacccccacctcctcagaatgggggaatgaaagcattgtccagtaattgcaaagtatctggtggttattcagatgataatggacatttttacaactggagtggaaaattatttatttctgaaggtcgaatataagtgaccactgtactccttgttgaagagagatcttgctttatttcttgaagttttctgggcagttgtagaaaatggaatgtaaaggagcaactagaaaatctttattttacaaagctgagatcttgaaagagaagtaattataagctttgagaatgctgtattagtaaagatacactgggaaaacctgtttgcttgataaaaattcccattctttattaaaacaaatgcatgcttatttgaacacagatctaccaattttatattacaatatctaattagtattcagtcttagctttttttgcctatgagacattttcctattaatcataatggtgcttctctaccatatagcactatagtaaagtaagtggattatttagaagaaatgcattcttaacattatctcctctacattttttgaaatctagggtactgatgtttttaatagatttgttttattttaaaagtaatacagccgggcatggtggctcatgcctgtaatcccagcactttgggaggccaaggcaggaggatcatgaggtcaggagatcgagaccatcctggctaacacgatgaaaccccgtctgtactaaaaatacaaaaaattagccaggtgtggtggcaggtgcttgtagtcccagctactcgggaggctgaggcaggaggatggtgtaaacccaggaggcggagcttgcagtgagccaagatcgtgccactgtactccagcctggttgacagagcgagactccgtctcaaaaaaaaaaaaaaaatacttattttagagaaattggaaaatactaaaaattacaaaggaaaaaatactaatctctctgattccaccatacagagatactcactagtaatattttacagtcttttctttcacacacacacatatgcatatattgggattgtgtatagttttgtagcctgcacaagaatttatcatgaaaaatgtcaaggatattttgaaacaaatatttagtggcaaatttagtatagtgaacccccacataagcccccttgattaaaaattatgaaagttttgctccttttgctttctctctccctcttttttttcccctttgctgcagtattttaaggcaaatcccaaacatcatgttatttttatcctcatatagtttggtatctatgtctaaatatatgggtgttttcttactaatcacatgccattattatacctaatgaaattcatctaatgtaatctctgctatcaaaaactggttcagatagagattttcctgattagtctgctttttgtgcttactattttggggaaatattgtagtttctttcagctataacgtgattaaaaattaaagacttaaattattctctctaactttcttggatagctttcctttattcctaccagttgagtagcctgtttacccaactccactcatcctggagttctgataatttaaatgaaagttctgacagtgctttacttcaaaaggacctgtgctatcttccttgttaaagtgtataggaggaactagtctaagtaggaagttatccaggaagcatttgacctctgacaggccactgtaaacttttctctctgtttcttgtgaatgttatcagaaaaagtgcttagattctcttgggcccacaatgcatgactctccaaggagagagatactccagccctagaaatgtgtcagtctggctttctttttttttttttttttctaacttctgatttttttgtttgtttgtttgttttttgaggcggagtctcactccgttgcccaggctggagtgcaatggcatgatctcggctcactgcaacctctgcctcccaggttcaagccattctcctgtctcagcctccccagtagctgagattataggcgcctgccaccacacccagccaatttttgtatttttagtagagacgggggtttcaacatgttggcccggctggtcttgaactcctgacctcaagtgatttgcctgccttggcctcccaagtgctggaattacaggtgtgagccactgcacctggccgctttttaaaatttcaatttcagttttgcctgtgttgagttcccttgtgtaggaaaattattaacccttatgtcttatcatggagagatagaaagggtgatacagtgttgaacttttcagtgtttttcagtatttctgcagaggtagctttaggatagaaatttataatttcctaattgtcacatgggtttaaatacatttatatttagttaacatttttcaggtaggtgctgtgctgcccatataaaatttatgttatgacaaaagcagtcccaaaaagcttattgaattttattgggccacttaattcaaaacagcattttatctgtcatcataagacagatactaatttatgtgttacatacttttgataaacattgcaactttatcgtagtaacagctgaagtagatgagtactgagtacttcagccagtgtacacacaatttgatactgtgaacaatagctgtagctgcatttcatttgtgaattacagctggccttgattctccaggaactgctgccttttctcttgtttttcactgtttgctcataagtgagatgtgtaaacaggaagaagttaatgaaaagcctttttattgcaaatatatgtggattgtgttataattcattataatagttgtggttaaatagagatgagatgtaaatggatatctacctggtagtgtacatctgattggcatcatctcagtgccactgttaattggtgacttgactggttatcaggttcggagatggaaagaagcactaaagagcgaacaggagtttaggaaacaaacacatgccatttatctgaataaagaatgaggccactgtgagctgctggttagcaaaactttaaatgtgaaacaactggagagtaggaatgaagcagtaatttagggaacccatctaaggaagagaaaagtttatacagggctattttcatacctggttagacctatagaaagcactgaattgatgttgaatgccatcaggtgagcaggagctgagacatggagctggctctgggagtgtagcttttacctttttcaggtcagttagctgagggaaataactttcctgggactgagagtgaaagtaagaagtcaggaagaaggttggcaccatgttaagagtaaaacaacttaaaacacatgtgccatatgaagaaaatgtactgtataaaaagaacagagatctctgtgtccaaaatgtaggtatttggcacttcttttgaagatgttcagaaatattttttattataacacctttgatggtatgcaagtgtccagacaggagttctttatctgcatttcgaaaatggtacaaaacctgacctgaatagacatgactatttgtcaactttatttatcccacttaatgtgattatagggtgctgtttcatatctgctggggacatatataattataatatagcattttatatatgtactatagtccttttataaattttgaagagttctgcgttctgaaacaaatctgacccatgggtttaggtaagagattgtggactcatattttaaaacaatgctttgtaggtgacagcagaattaaatttattttctagaaaccatagtttatttgatataattcagggaataaccaaatataaaacagttttcaaatgtcttgaaaggttccctgttccctttaaatttcttcatctcagtttttgttatatagtggtttatgggtcttgcttaaggcacatacaaactcagaatggctgttaaaaatttcagtgtttgggaagttttggagaatgttggctcttcttgctcaacagttttttcatttaggatggtgggtaagacagactaaaaaaaaaaggcagcacaacctctggtggcagggtggtgtggtggtgaagaggccctggagtcaggtcctaatcctgattcacatttactagctatgtgaccctgggcgagactcttaacttctctgagttcattatctctaaagtggtgaaaattacacagtaactgcctcttagattatagttactattttgggttctattttggtacacctgattttatgttcttattttcaaactctgatgaggtacaattaaatgctatggagttaatgaggacaattctggttttagggaaggaagaaagaagatttaactctcaggtagctaaggtcagcttcatatcaaaggtgaaaattatgaaaatacataatgtgctgttgggtttttaaattgaaaaaatagcaggaataggctgggcagggtggctcatatctgtaatcccagcactttgggaggctgaggtgggcagatcacttgagcccaggagttcgagaccagcctgggcaacatggtgagacccctgtctactaaaaatacaaaaattagctaagtgcgctggtgtgcacctgtagtctcagctgcataggaggctggggtgggaggatcactcgaacccaggaggcagaggttgcagtaagccaaggttgtgccactgcactccagcctgggtgacagtgtgagactctgtctcaaaaaaaaaaagaagaaatagctggaatgattgctgaataatgttcttggactatacttactaataaaggaaaaatagagtcagaactggctctaaatttataatggagttatttttttcttttcttttctttttttttttttttttgagacggagtctcactttgttgcccaagctggaatgcagtggcacgatctcagctcactgcagcctccgcctcctgggttcaagcagttcatctgcctcagcctcctgagcagctgggattacaggcatgcaccaccacacccagctaatttttgtattttcagtagagacggggtttcaccatgttggccaggctggtcttgaactcctgacctcaggtgatttacccaccttggccttccaaagtgttgagattacaggtgtgagccactgcacctggccgggtttatttttctttatgttgttgacctactagtgtattagctttaagaaaacccaatatgtcaaaaacaaagcacaaagttggtaaatgaaataaacccacattacctaaggattttaaaataattgatagttgccatcactgactgcgtcgtctggcttagcctataattgtggccagtggccaggtttgttcacagaatttctaagaattctaatgaaagtatgaaactcagaaaacaagaacgaaactgtttaccatggttttaattttatagtttttctagcttgccagagacccaatttccacatagcctcttctcacaagctactctgccttatggtactgagactgtccacttttgaataataagatgggtcttaggaatggattatggcaagatttttttttttttaattcagactgagagctcttttgtagcttttatagttacatttatttgcatttggatctcaaatcatcttgaatttattttggtttgaagaataacatttttattcaaacattatgcttgatgactatttattgctgaatattcaactggcaaaaattgacaggcttccagaccaaagaaataaatcagtaatgaagatagtctgagtcttacattcttcttagctggtatagatggcccattttttaaaaaggcattttatttatttatttatttttgagacagagtcccgctgtgttgcccaggctagggtgcagtggcacgatctcagctcactgcagcctccgtctcccaggttcaagtgattctcctgcctcagcctcctgagtagctgggattacaggtgcttgccaccgtgcctggctaatttttgtatttttagtagagatgggatttcgccatgttggtcaggctggtcttgaactcctgacctcgggtaatcctcccgccttggccttccaaagtgctgggattacaggcgtgagccactgtgcccagcctacaaaaggcgttttaataaattaatatatatttacatataataaaatgcattagttgtaccttttgattttgttttgtttttgagaaagagttttactgtcacccaggctggagtgcagtggtgcagtcttagctcactgcaacctctgcctcctaggttcaagcaattctcatgcctcagcctcctgagtagctgggattacaggcatgcaccaccatgcctggctaatttttgtatttttagtagagatggagtttcgccatgttggccagcctggtgtggtctggaactcctggcttcatgtgatctgcctgtctcgtagttttatgtttttgtattttgttttttttttttgagtctcgctctgtcacccaggctggagtgcagtggcgcgatctcggctcactgcaacctccgccttctgggttcaagcaattctcctgtttcagcctacaggtgtgtgccaccatgcctggctaatttttatatttttagtagagacaggtttcgctatgttggccagactgctctcaaactcctgacctcaggtgatccacctgccgcggcctcccaaagtgctggagtgagccactgtccagccaattttatgttttaacaaatgtatactcatgtaactaccatcccaatcaacataagcacatttccatcaccatacaaagacttctgatgccctttgcaggtgataccccaagcgcattctgttgagttgggtttcaaaccagaaatcctaacttcagagcctgagttctcgcccattatactttactactttcctaactgaagatttattttctttatgtagcttacctgctatatttgcatgctcattgattatttattataggctggaggtaatttgatagtgtcatcattcatcccgaaactttggtattttctttactctgtcttttttttgacttgccacatcaattagtcatcaaatttttgcgaaacatttattatatctctcggttcttacctcctgacattatcagcaaaaaatatttagttcactaaaatgcatcgttcattgtttggtgttcggttgggttatataaatttaattgttttaataatagaaatgtttttattagcaaggtagtcatccacgattctatgtagattctgtattctctgtgccttacgttgataagcccctatcttgttatttcagtcccatgtgatcaataaaagcagcaagcaggctttggtccaagccagattctccaccactagcctgtacccaaaatcagcaaatggcctcaggacaagacagctgtatagccttacttcctttttgatgagtctttgctgctacctatgtatatttaatactaaagtgttgaattgtagaggttttgtgatacaagtgttttcttttctaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtaagatacgtctcattattggagtgtgtctgaacatatattgttttataatattcaaaatgcatatatactttatgcactcacagacatatttcttgttactgttgattttcttgggaggtataatttactatatatgttaaaagtgctatatattattgcttgatagatgaccactattgacttaataagcaatatatactcaccgccaacttttacattcctgactgagtaccttaaagtactcagtgagctctctgcatctagaaactcatattttcaggtaccaggttatttagctctcccacacccatgcgcctcttccgcatacacaccaggtgaaagctgcactgacttctgtgctatgggccatacttgtgtcctcagcctctactagtatgctgtattctcaggttctcaggggctccaccttggtcagtgttagttccttccctttttttttttttttttttttttttttttttgagacagggtctgtctcggtcacccaggctggagtgcagtagtgcagtcttagctgaccgtcacctttgccttctggtctcaagccatcctcctacctcagcctccccagtagctgggaatacaggcacctgccaccatgcctggctaatttttttttctttttgagagggagtcttactttgtccccaggctggagtgcagtggcgcgatttcggcccactgcaacccctgcctcccgggttcaagcggttctcctgcctcagcctcctgagtagctggcattacaggcacacaccaccacacctggctaatttttgtatttttagtagagatggagtttcaccatgttggtcaagctggtcttgaactcctgaccttgtgatctgcccgtctcagcatctcaaagtgctgagattacaggcatgagccaccgcacccggctatttttttttgttttttttatagagacagggttctggtctcaaattcctgagctcaagtgagctgcccccctcgacctcccaaaatgctgagattacaggtgtgagccactatgtccagccagtgttagtttcctaaggaccaagagattacagaagatcctgctctgctttttataagtttttggttcagctctttagtctctttccccgagcagttttggaagttagcatgttttgaggggaaaatcagctgtgtgtttgaggtcccccaagtccctatcttgttatttcagtcccatgtgatcaacaaaagctctactagtttctgtccccgagcagcagcctttggtccaagccatattcaccactagcctgtaccccaagtcagcaggtgccctcaggacaaggcagctgtatagcctcagttcccttttgaaagattctgtctctggacttacaatctattttgcctctgaagttctctgatgcctttaaaaaactgctttttgtaattttcgtagctcttctagctcttctcaccacgagtactggcctgctgtgaactgttttgttcatcttgatgcctgtggggaatttggaggaacatctgtgttctaagtggccaacattctacttacagccctggcctcctactatcatgttgaattttcttctctctctttcttccatctcttcacaactcaatttctgttcttatgcagagaagtttagccacttcttctgtcatcttctaaatatatccaaaccttttgtacctaaagttcaaaatatccaggataatttgttaaacagacagatacctcctgtggtatgaaattataccattttgtttattcatttaacaaatattaattgagtgtctttttctaggtattgaggataaatcagtaacccaaacaggcaaaaatcccttcttatatgtagtttacattctagtaagggcaaaagctaccacagtcactaattatagttttagaaataatttttttcttttttgccacactagcatgggttggatttttgtgacaacagaaagtataattatacttttatgatttttaaatggagggttagcagagcccagactgcatttcagatttcaataaaaagaaccccaagagatcattaaactgtattgcagttacccttttcttcctgtttattcagaataggcatttcaaatttaaaatacactttcacagagttctaaaatgtttacttaagccattttataggttctcttgaaggaggtgtgtttagtatgtttaatattgtaagtagatttatttcatacgtaagagttgatgaaattactgaaagaaattccccttgggtaacagctaatgaatgtgtcttacccaggaaaaatatgaaggaagtcaaaataataagcaagtgctttcaaagatatctttagcttaggaaatagacgaaactttattttgccctagtccacctagcacggttgcttagaagatctgattttctcttgtaaggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccaggtttgtaatcatccttatttaatggtgactagaaaggataacaacataaatcatcaaatgttgattttctttttaacatggtgattttgatatttaaacattaatatatatgtgttttttgcagcttggaaatgatttaaaaagatgaaaatgcccgttggtgtaatggatacacttttatgcttgttgtgggtgtctgctctatggagcaatttgaggagcattcagggtattctttctctataacaagtattttattttttattttttacaatttttgagacagagtctcactctgttgcccaggctggagtacagtggcgcaatctcggctcactgcaacctctgcctactgggttcaagtgattctcctgcctcagcctcctgagtagctgggattacaggcacgcgccaccatgcccagctaagtttttgtatttttttgtagagaagggctttcgccatgttggctaggctggtctcaaactcctgacctcaaatgatgtacctgccttggcctcccaaagtgctggaattacagccgtgagccaccgcgcccagccatatagcaaatattttatgtatactgcaatgttcatggctacattgtttattatagtgaaaacttggaaaccatatgctatttaataaatgagaggctaaattatagtttaaaaatagcattaattcttaaatagcattaaaataattggtggcattaaattctaaacattatttcagcaagttaagtaagagaatgcaaaatgaaaaactgcatacagtctatgattagggccactgctttgcacaattccaggtagtgcatacacatcatggtttgttaatgggacccactagaattggacagtgtattgcctgtgtagccacattcagtgaccctgagtacaacctcagtctataaaaatagacctactgacagatttatgtttatgagaatctgtacttggaggaaaggctgaaaagaaattaatagtattaacagtggtgctctctagatgtaggcttttatttcatcttaattattttggttaatggaagagttactattcttagctgtattttgtgaagttgtctaatttttcatcacttaagctatggttaaggttgttattggacaaagtacattaaagcagcattataaatagatggagaaagaagaggctttatttatatctcgtttaaatcaccttaggcctccatatcaatctgtttttttaacaaatgatttgatacaaaatacttacgtatttttgagatgggtgaaattgtcagcattggggttataaatacagagctaacttgaatcatacaaatgttaatgaaacttgaaatgttatgaaataatcattgcctgataaaggattttatatcatacaatatattactaaaaggggctgagttaaaaagaaagatatggtttttggggttgcctgatcttacattgatagtgttattctctggatagttaatgctaagtaaccttcaaaatcctatagttcaatttttttgacacctgattccttccttatggatattcagttttcttgcctttgtaaagcgaattttgttttttagggatcttaaccctagtttggaaacaatctttgtgttacctttatgatggattttgatatgctactaatgggctattttgttttccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtaatgcctttctcaactatggtgaggcttttgatggtcttgctctgtcatatacgcattccagaagtcaaaccaagtttattagggtgatttgaatattttagaaccatttatctctctaaagtaactaaacggtcccacacccactttttttcttaaattggcaagacttgattctagatgtaatgttgtatacttatcacaggtaagagtttaaactatgtgaggaggatttgtaagtacttcggaaagtggtcatcactagacctgggttggattcattaatatcaaattgtgttcaatcagattaacccaacttttttcctgtgacaaagttattggagtaggtaaggaaaatgtggtagaaataacagatttagacttcctaagtcaggtgacaaggtatcttacgatgttctttcgaataagatagaaatatgcaagttgggcataaggacaattaaagaggtgaataactgcttgaatgaccacacacagactgatactaagttggagggaggtttgtaatgatatgtaatgagtctgttcttggcattgtacttttcaacacgtttttagttgtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaaaggtggccaggaaaatgttgaaaaaggatgaagataagggaggaaagggggccgaagaccatctatcaagcattaaaaggaattgtaaattaaaagagtgtggtactggaaccagaatagaatgacagattaatgaaaatagagtaggtcagtcagaaacacatctgtgtatgtataagaagaacacattttataaaatatggcattttgactcagtggaggaaatgaatgaaataactggctaacaataaagtaagatctctctgtcaaagctcatacaaatatcagttttaggtggattacacagttaaatatttaaaaatgaaatcataaaggtattagaagaaaattagaagaattttataattgtgatgcaaaaggaagacctttctactgaaagcagtaaccatataggcttctgacaaaaacaaattcgatttcaaattattttgaaatatctgtatttaaaaagaagatctgccaaagaagttatttctctcaaagttaatctagaaattttatgcaaagtctcattggaagccgaaatcttaaatttactgatacaagttttgagagattaagctgatagacctaataagcctcctctggactctgaaaataagtgttggtttagttcagttatttaagacttctatctgttccaatactctgtgagtatctgaactgtatttttttttttttagccacagactcactatgtcatctaggctggtgtgcagtggcaggatctcggctcactgcaacctttgcctcctgggttcagtgattctcctgcctcaccctccccagtagctgggattataggcacacgccttccacttggtgtcactcttttttttttttttttttttttttgagacgcagtcttgcactgtcgcctgggccagagtgcagtggcatgatcttggctcactgcaacctccgtctcccaggttcaagcaattctcctgcctcagcctcctgagtagctgggattataggcacccaccaccaggcccagataatttttttgtatttttagtacagacggggtttcactatgttggccaggctggtctcgaacgcctgacctcatgatccacacacctcagcctcccaaagtgctgggattacaggcgtgagccaccgtgcccagctggtgtcactcttttttcctaaaatagaaacttaaaattgtactgttacgagcttcagaaccaatttaaactttatgcaatcagagagtgttcaacctggaagggaccccagagatcatctggtcaacccctttgatctcagaaatgagaatcctgagttctagtactttgtttgtttatttatttatttatttatttgacagggtctggctctgttgcctaggctggattgcagtgatgtgatcttggctcactgcaacttctgcctccaggctcagcaattctcctgcctcagcctctggagtagctggtaccacaggcgtgcaccaccacacctggttaatttttctgggtctttttgtatttttagtagagacagggtttcactgtgttgcctaggctggtcttgaacttctgacctcaggtgatctacctgctttggcctcccaaagtgctgggattacaggcgtgagccactgcacccggccagagttctagtactttataagactcaggctcaaggttctttatcacattaacagagccaggattagagttcatgtttcccaacttcctagtcttatattatattacattatagaaccatactcttcagattagtttttgctgacagttcaaaaatctttaaactggtgtgctaacttttgtgagtacactaatcatgcaaagatgcaagtgttaagtcactcctctccattacctgtgggctctgtaggataaatccagactcagtcttccttgcaaagacactcactgtttagtcctgtgtctggcatgtaatgtagtagtcattcagtgaatgaataagtaaatattcagatggaaccaaaacatgactagactggcatatattaaaatcttttagaaatgttagaagccgtttacataattgctcccctgcccttttaaaataagaaaatcaaagcattaaaatatgtatcttaaagcacctaagttaggggatgattcatactgtggtagtagaattatttgcagtactttatttttattgtatttatttattctgagacaggatctcactctgccacccaggctggatatgcagtggcattatcatggcttcactgcagcctcgacctcctgggttcaggtgatcctctcacctcagcctcctgagtagctgagactacaggcacccagcaccatgcctggctaatttttgtattttttgtagaggtggggttttgctacattgcccaggctggtcttgaaatcctgggctcaggtgatctgcctgcctgagccttccaaagtgctgggattacaggtgtgaaccactatgcctggcctgcagtactttaataggcccctgtcttggtgcattaagtattttttatggagtgaagaacatgagaaaagactgaaagagtgaggtagtttgcaaaagtacaaagttaaaaaggtaggaaccattgttaactgaagatcattttgtaaagcaattatagtaactctgaggttaaagtgttattttggactcagcttttctctcagctcactgcaacctctgcctactgggttcaagtgatcctcctgctcagcctcccaagtagctgggattacaggcatgtgccaccacacctggctaatttaccatgttggccaggctggtctcttaactcctgacctcaagtgatccacctgccttggcctcccggagtgctgggattataggtgtaagctactgtgcctggccctggactcagtttttctggattaaacttatgaaatattgagtacaccttttaagtttatactgtatatctttttttttttttctgagataagagtctttctcttgttgccccagctggagcgcaatggcgcaatcttggctcactgcaatctctgcctcccaggttcaagtgattctgctgcctcagcctcctgaatcgctgggattacagtgcctaccaccatgcctggctaatttttttttttaattttcagtagagatggggtttcaccatgttggccaggctggtcttgaactcctgacctcagatgatacacccacctcagcctcccaaagtgctgagattataggtgtgagctaccacgcccgttctatactttatatcttttctgtataatataaatggattcccacttcattcagtttacaaatgctttcttctgtaatgtagacttttaaaatatttagaggttaatagttgccatagaagtaaacctttgggaaatgtaaaatgtgaatatgtatatttttatttttatggctggttgggagtaggagtatatagtggtgactggaaaataaacctgtgtgcgttaaaaaaaaaaagagagagaataaggggaatctatcccaaattccctgcctagtaagatacccactgtaggtagagtacatgaagtaagagatggtgatgggttggtagataagaattgtaaataggcccatgattgatttaaataatttgctgcataatgttccccttcagtttaatctacttcctcggtagaaagtttcttttcattaagaactgtgttcctttcagggtggcaaacagtgaaccacacaacaggcttacttatccagcagtcctgcctcactgagctggactcagtgcctatatctctaattgctgtgtaaatgaagttctcaatagtggctttagttttctggatgagactgttactgactgtatttattttaagaaatcagttgttgaagaaaagtcttaactttattaatataatttcatgtctacttaggatagacttgtcaaattggggacagagttttaaacatattttgaagcatgctgaattgataattagactggacaaacaaaacaataccttcaaatagatagggatttttgagacagggtcttactctgttgcccaggctcgagtggagtgcagtggtgcaatcacgtttcactgtagcctcaacctccccagactcaggtgatcctctttcctcagtctccctagtagctgagactccagcatgccaccacgcctggctaatttttttattttttaaatagaagccagggtttcaccttgttgcctaggttgacaaatattttttattgtttgtttcttcggttggatatttatcttatctgaaccttgattttatattagtgcattgcatatagttcttttataattttcttctaaacacttaagtcagtgatgtgtgggattagtgtggtggcataccaaaatcacttgtgaggtttttaaaaattacatattcttaattttccctctgattttagtataccctcttttctcagctccccatcagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatcgggcaatagaaaatgagagacaaaatgcctaacttaggtcttttgtcttgtgaatcccagagaaatttcattttatttattatgaaagtaattgaggtggttaaggataaattaaataaaaagtacaagatacatgggggatgttgactcctgatgtaattattcccactccaatgtgatttactctgtgctagatatatgtatatgatggaatttctagcccaaggtttagttaggtgataaataggaaggaaataatatacctcatttccagttggaaagtgcctgtcaaggtatataaagatggatagttgattgtctaaagttaaagattcttcttggctttataccttttagtgtaagcaaagttgtaaatgtcatctttgacaatggcaaatctccaaagaaacatttaattcaatttcctcctctactgtttttctctggtggacaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttgtgattgtttttagtaagatgtattgtaaggtgggaatcatcggagcccattccccagcgcattaatgggaggccaaagcatttctcccttctcaccctcccacccccaactatgtgctaggttctgttgaagcaaagcataagaaatgaaactttctttaccacagctgtgagctttttaaaaatacagatgttcaccttacaccaactgaattagaatttcaggaggtgggttcggggcatctatatttttagaaagctgcccacaaagttctaattcagctgattcccaggctggcatttagaaactagtgtgctaaagagtgaagaaattacttgacacctgcatgaaaattagcgggtagtgctacaaaggataaaataagagctattttatcccaccatagttttaaatgaaggacattctcactatcgatttcacttagcttttagacattcaagatgacttgtctactttttaaaaagttaatatgcattactttagaatatcaactccagttccaaaatatttcccattctatgccatttgtagctgtgttactgtttcatccatagtaacttaatgcgttttttaatgtacatatatacagttttaaggcatttgtaatgaatacagttttaatgcacacgtacacagttttagtggagactgttatttgatttttttttaaatataaagagatgattgggggaaagctattcatttactatttaaatatgaactgaaacttaaatgctcttcactttgaaaatcttagtattggttgttgacacatttgctcctgaatgttgtaagattttctggcattttaaatctggaacgtgattatatcttttctcctcctgcttcttagtgtttatgaacctcagttgcagcaccatgtggctcaaaagaagattccttatgtggatacccaaggacagttaattaagccagacaaacccaatggaataaagatggaaaaatttgtctttgacatcttccagtttgcaaagtatgctttgaatagtaccaataaggttaaataaatgtcttaaaatgctgcttttcactctcttaggcatgaaactgttttcaggaaacatttgatagcacatatctcacatggcattttgattgtgagtatgtagtctagattcattatagttctctggaataaaaccaggagtgtgatctgagttgcctatgagtacaactttttttttttttaaatcaactagtttctggctcctataaagtttttttcatatgtatattaaatatatatattatatatatattttatatatataatttatatatttatataatatatattatatataatatataaatattatatataatatatattatatattatatttaaatatattatatataatatttatatattatatataaatttatagttatatataaatatatatttatttataatatatataaatatatattgtttatattatatatataaataaatatatatttatttattaaatgtgatggggtcttgctatgttgagcaggcgggtctcaaacttgtggcctcaagcgatcttcccatctcggccgcccaaagtgctgggattataggcttgagccactacgccccgccttggtctcctgtaaagttgttaaagtcatttattttggatgagaaactgaaaaggttaagataaagagttgtctcgttttgtatttaggatatcttcttactgccctgtgaatagatgtttcagtaaacatgtttttagattatatagctctctataaagatcacatttgatgttgagatgcttgtctcagaatttgacgagtgcaaaaatgagaaagacaaataagctgtataaagttaatgcgtggtggctcatgcctgtaattccagcagtttgggaggctgaggcgggtggatgacttgaggccaaggagttggataccagcctggccaacatggtgaaaccctgtctctactaacagtacaaaaattaggtgggcgtggtggtgcatgcctgaagtcccagctactcaggaggctgaggtgagagaatctcttgaacccaggaggagaggttgcagtgagctgagattgtgccactgcactccagcctgggtgacagagtgagactccgtctcaaaaaaataaataaataaaatgaaattaatctttccatttctaaatcattttttttgcctgttttttttttttttccagaacagatactaatgtgatctttgtacattaagatttctaatctttccgacttaagatgaactgttctatagttgaggggggaaatgatttctcattttgcattgaaaaagaaaatttcagctttctttagtccaagggtgagcaatattttattcatcattcagattggaataggaaagcctattgttgagaccaaagccttagctatgttaaagggttagaagctgtgtatgcagtttcataataaagaggtctttatatggtttcgctctaggaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccggtaagtcagtatcttttctcttttgtatgaatcctttcttggacttttcctcttggacttctctctctctctctctctctgtattcctagatcttttttaaaaagcaaagttttgatgtgtgaacagttcctgatgtgaaataacagtagctttgcctattataaagagaatgattgttttactttcttgtgaagaggagtctttcagatctctctttttttaatttttattttttggaaacattgccaccatgacagcaaaaagacttctactaaataatgatcagaagatttttttttttttggtgtgccatatggttaaagcccatcagtaacacactataccacagggcaagtccttcagccacagaggattgtttgttgttgcccatatatctgtggcctcaccactattttttttttttttttttgagacagagtcttgctttgtcaccaggttggagtgcagtggcacagtctcagctcactgcagcctccacctcccgtgttcaaatcgattctcctacctcagcctcccaagtagcagggactatacaggcacatgccaccacacccagctaatttttatatttttagtagagatgggctttcactatgttgaccagagtgctctcgatctcctgaccttgtgatccacccgccttggcctcccaaaatgctgggattacaggtgtgagccactgggcccggctgacctcactactgttaatagtactgtctgtgagacccactcatagctccaccacccccaggctacctacaaattgtagtccaatggcagttttcactgtagcactttcaggtcactgaggaaggtgtctagaagagaagtaaatgtcagttacattcactgatacttagaaatggctttggttttgagaagttaaaaaaagaaggtattgtagttatttaaatccaagataaagtacttttcagctaaatctgtttttttgtttgtttgtttgttttttggagacagtttcactcttgtcacccaggctggagtgcaatggcacaatctctgcccactgcaacctctgcctcctgggttcatgtgattctcctgcctcagcctcccaagtagctggggttacactcgcctgccataaagcccagctaatttttgtatttttagtagagacaggatttcaccatgttggtcaggctagtcccgaaatcctgacctcaggtgatccgcccgctttggcctcccaaagtgctgggattacaggcgtgagccgccatgtctggccaatctttttttttttttaagacaaggtcttgctctgtcacccaggctggagtgcagtggcgcgatcttggctcactgcaaccttcacttcctgggcttaaacaatacacccgccttggccacccaaagtgctgggattacaggtgtgagctattgtgctcagcctaaatcttgtattttatgatgaaaccttcactggcacctagaatttccctttctgaatcatctggtatatccgtacttatgtaaaaagcattctggcatttaatttatattcctaacggataagatggctggctgcaagaatgcctcaataaatggtaaaatattgggctggacacggtggtttgtgcctgtaatcccagtattttgggagactgaggcaggcagattacctgaggttcaagaccagcctggccaacatggtgaaaccctgtctctactaaatatacaaaattagctgggcatggtagcgcatgcctgtatcccagctacttgggtggctgaggcaggagaattgcttgaacccgggagggagaagtttcagtgagctgagactgtaccactgcactccggcctgggtgacagagtgagactccatctcaagaaaaataataaaatgttagagaacactgaacattggaatttactggtacataactggttttacaagaagcagcagtggtagctttcatctcccagtccaaggccacttttgggctctgtattgtcaacaagcttgctcttggcatgtcacattgtcctcatgtttcatctttggccattgagttttatttttatttttttacccccttttggtctcttgggacgaatttatgatttaccataaatacataccattcaatcaagtatattttgcaactccatttcattgttattgtttgatttgcttccattcccattaatccttatttattcccacatagcagtgctacaaatgggaagtcagagaccatcacagctgatgtcaatcacaagtaaatataccagcctgcctacagtgcatggtgatggggctgtgcttccctccatactaactggcatcgtagtttagtgctctgccttttgggggtctggagggaggatggttgaaactttggtgtgggtgcactgcttacttggtggcaggtatctctctggatgacactaactcagaatcttgttgcatgctggaaatggggagcatgctttactaaagaatctgaccacaggtgttagagctggaactgacagattttcagatgataggtaagatccagagcaggttacaggtcagggagaacacattttgcacctttaacataagcttatacggggttaaaaataccattctgaagatgtgtcttgtggaattgggtgtatgctctcagtatacaggctgattgttcctgtcatatttgatggcccttaatatggagaaaactgttctgttgatttattctcacactaacagctctcctttttggtcactgcattaattttagtcagttactttcttgcttctaaagaatctttttatcttaatggcagatcatttttagttagaagtaacacatatcctctcccatctgggtactgacagagtttggaaaagccattatctttatagtttaagagacagcttgatgttattgttacactttgaaagttaaagtttttaaggttgggtgcggtggctcacacctgtaatcccagcactttgggaggccaaggcaggcagattacctgaggtcaggagttcgagactagcctggcaaacatggcgaaacctcatctgtactaaaaatacaaaaattagctggtgtggtcatgcacgcttgtagtcccagctactcaggaggctcaggtgggagaatcacttgagcctgggaggcagaggttgcagtgagctgagatcgcaccattgcactccagccttggtgacagagcaagactccatctcaaaaaaaaaaaaaagaaagaaagaaaaagtttttaaggtaatttgggaaatatatgcagggcaaaagatctggagatggaagttatctcagaaatagagtagcaccttcatcagtgtcacccacgtgctttttcctgtctgtgccattcctctgcccagacaaattcctgtgagtgtcagtgtttctgggatgtgattctgtaaacaaggaagtggactcaaagatctgatcaatttcttataggtgctgtagatcagcggtctccaacctattttggcaccagggactggctttgtggaagacaatttttccacagacttggggtggtgagggtggtttcaggatgattcaagcatgttacatttatagtacactttatttctattattattacattgtaatgaaataattatacaactcactgtaatgtatagaatcagtgggagccctgagcttgttttcctgcacctaggtggtcccatttggggatgatgggagacatcatcaggcattagactctcataaggagcacacaacctagatcccttacatgggcagttcacgatagtgttcacattcttaagagaatctgttgcggccactgatctgacaggaggtggagctcaggcagtaatgtgagtggtggggagcatctgtaaatacagatgaagctttactcacttgcccactgctcatctcctggtgtgtgatccaggtcctaacaggccacagagtagtaccggtccatggcccaggggttggggaccgctgccatagatgactgttgtctctcctgccttgggaactgggatgcagagccctttatcactttctgtctcatccaccatttttaatatatggaagcaagctgcttttatatttaagaaataaaactttgattaaatttctttgtcattgaaccatagcttttaacctaacagtgtaatagattgttaattatataactgaagacagcatctagctatcttagttaagatacaaaaagctttaaacattattcttactcttttgtttaatatcccccatcgcccagtttacttcattttagccatttatagaataattaaagtgaaatcaaagtttggctttaaatgataccatgcactgaaaaagagttcctgcgtaatccttagcaccaaaggatgaccttacacagctgaagaacatcatgtaattgtgagagatgaaaaggaagtatattatgtaaaagagggaagaagcaactaggaggtattctgaaagaatggaaacaaccatgctgagttttgactcgatattatttttatttctcaccttaatgcttactgaatagtgttagctaccaaaaggatgcatggctaaagaattgtggggcagtaggtttattgggctaatttgcttatatcctgagattttacatttggtgatggtagcttctgttttccctccttcagggcatccaattttgtttactgaagttcactccttagtttcttggggtatctttgtggtagtagaatggaagttacatattcaggccagctgtatatgtgtttcttgggttcacaaccaccttctgttcctgctacactgaatccttcaggggtttaggtgggactgggctatatacatcttaatggggtgggccctcattttttcctttttttttcctcggcatgcctactcaagattcatttggttttgtatgactttgagttgccccagaaggtctggactagacctcttgagctcttgtggtagaatctggcatgtatgtagagaggtgtgtgccccactatgcctcctcttttcccttcattagtttgtcatcattttcatagtgttatttgttcagacaacaagcattcgtaggcctgctcataggtttataggtgctattagtatcctaggtgctgaagtatcttatacaagagaaataagtcacttcttacagactactgggatgttcaagatgcacatacataaaagttaagtaacattttcaggcagtatgtgattatgtgctaaatgtgtgctatagcaataattactctgggaggcagtgacttagcaggtgtctaatacatttattttttatttattattgttattattatttttgagacagtgtcttgctctgttgcccaggctggagtgcagtggagcgatctcagctcattgcaaccttcacctcctgggctcaagcgattctcctgcctcagcctcctgagtagctgggattacagatgctcgcctccaagcccagctaattttttgtattgttagtagagatggggtttcaccatgttggccaggctggtctcgaattcctgacctcaagtgatctgcccaccttggcctctcaaagtgctgagattataggcatgagccaccacacccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgacctcaggtgatccacccaccgcggcctcccaaagtgctgggattacaggtgtgagccactgcacccagccacatttattttttatatgaataaatggatggagacaatcactatgaaatgcagtggtcaagagaagattggggcttgagccaaatcttggaggatgagtatggtttttatgggaccatagttgagaatgacttggaataatccaaagagtgtgactgatctggtttgagtggagagtctcaggataagtaaggtgaagtaggatagagagtgctttgaatgctagagaaaggttgacctgtagctaaactcagaagccctctgatttttattgactccagcaaagtttgagactacgtacttggggaaagcacagaaagagctatggtttgacaagagactaatatttttgtgccctgtgtcttattggtaagattcttgaagtggcaaataacaaagaggtctaatgactgcaaactcattgactatttattgacttttgtgttagataacttagaaattcagaattgctgtaaatgttaggttgtgacctagatgaaacaaatagggactttgaccttgccttcgcttgagtgcattctgccttagctctttaaaaagggacttttggtaacagagaagtactttgaaacatattgaataaattagctcagctaatctaggacatttgggttgtacagaaaaaacatgtactgggaaataatttaactgtctgatagaactttctgcagtgaaggaaatgttgcatatctttgttgtccagttttgtagtcattggccattcatggcttctgaacactcgaagtgtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagatgtatgtaaggggacagtgtgtaaaaactagtgaagtgctgtaaagagctaccagtaattattggcacttgccccaaatagtgtccttctgacctgagaatttcatattaacttaatcctcagggaatttagtgatcatcagggtagcatctattccatttgtttaactggaagaattatctgcaagcttctcagaggaaagttatggtttgtacttttgctctggcaagtaacatgggaagcaaagtctttaacacatacttgttttttttcttagcttgaaggatgccaatgatgtaccaatccaatgtgaaatctctcctcttatctcctatgctggagaagtaagtctgctttactttttcctctattcttttacaaagctttgtatatttcaaaataatgaaaaagtggattttaaatgttctcaccataaagaaaggataagtatttgaggtgatagatatgttaattggctttatttgattattcgacagtgtatatatgcattgaatcatcacattgtatctgaaaaatatatacaattattgtcaattaaaaatgaaataaggttgggcacagtggctcactcctgtaatcccagtactttgggaggctgaggcaagaggattgcttgagctcaggagtttgagaccagcctgggcaatatagtgagacctgtctttataaagaaaaaaaaaattacaaaaaaagaaataaaacttttttaaaaagtagaattctggcattgttttatgtttaagtagggatgtccttagagaagatgcagcattttctgatggtcctgccctgaggagctcttcctgggaacaagttgagaagctgcatttgttctgaattcttctctttgagaattcgtgttatggctttgcatctatcccataagtgggttagttgccattaacagacatctgcaatatctagtccatttcacctactcattgaaatgtagtaggcttttgaaaaatatataatcagccttgttttttagatgaatcacctggctttttttaaatgcaatgtaagttttctttcaaggattctagtttgttcaagtacttagtactgtcacttttaaaacttggggatttagaggtctctactcttttacttatgtaatatttttcctggagatctttgtattgctttgttgtagcattagagatagctttcttgcttagaaagttaactctactggccgcttgcagtggctcatgcctgtaatcccagcgctttgggaggccaaggcaggtagatcatttgaggtcaggagttcgagaccagcctggccaacatgataaagccctgtttctactaaaaaatacaaaaacttagacgggtgtgatggcaggcgcctgtagttccacctacttaggaggctgaggcacgagaattgcttgaagctgggaggtgggggttgcagtgagcataggggtgagactactccgtctcaaaaaaaaaaagttaactctgtgagagatgattataggaaaaatgtttatcttattaactgtagaaatgatcagagtaattttctttttatatttttgttttatgcttttacaagtcagtcattaagtctactctaaaatgtctattaaatagattttgacttttatattctgcatctcaaccttttttggcatttgtgctttaaatcatcattatagcaagtccagcactgcatgacaagtgcaaattttctaattgtgtttcatttcaatcctctttttagggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtcatttgtacttgaagaaattatttcattgagaaaatatgaaacttgggagaaactttaagataatgcataaaaacaaattgatgcttcagtgaggttgcagagtcatagaacttctttcagtgaatatctaactttgggctttatcttcttatcactttataatagtagctctcacccaaagattattttgtcctccacccaaaggggcatttggcaatgtctggagatatttttggttgtgacaagtgggaaagtgaagtggtaccactggcatctaatagggattagggatgtcactaaacatcctacaatgcacaggatggtctcctacgacaaagagttatctggcctaaagtgtcaatggtgtcaaggtcgagaagccttgtttcaaattattcatttactctgttttgcccaaatatttggtggcacttaggaattcaaaagaatgtagtttctgaattttctctggtaggctattccagttttttgttattgttgttgttattttagaggattaaaaaaataaaaagacaaaggtggttctttaaatatgggccatagatcattggtcattagtaagggttctctgtgtctaaaatgctgtttgcatgaaaagactgagctttataaatgcatcttaaataatatttaagtattgaccaaaagtataaaaaggaacatctggataaatgattctaaaaattatatctagaaaagagatgaataaatttcattttccactaacaagttgtcacaagataggatgtcattcatggggtgggtcttttgtttaaggatcacttttttttttttttgaagagcatgtgatgttcatatccatcaatcttacctattttttttttaactaaggcctaaatcattcatttagcatattttctattttatttcaataacagctcaattttgctattgttatctattccagttttcaaaaagattagtgaagtttgacttctcattgaaatgagctccaaatgggttgtaagaatggaattgcagagtctttagctcctgaatgccaaaaactgatactaatggtatgatccgtttctttttttcttgaaccttgctatttcctctgctatttccacctgctatttattcttctcctgttgtaagaaaatactagtgatgctaggaaaagggaagaatggaaatgggattgtgtagtggttttgttggagaggagcgatggctggggaacattgggtagttaagagcaaactctgagagcctctgagccatgaaatgataaggtgatagcattatgtatttttatgagttcttgttaaataattgttataattcagaaaatacagaattgggtaaaatgtttatgaaaataaaagctagaataatttggcagtaacagtatagaatttatgtgacagttgatagtcattttgagtctggcttgatcgactggctgtgatttaataacttttttgatagtcacaagtgaacatataagcccaatgggtatgttacttgaatatttgatttttgttcaatttccctcttaacctctctaatttaatccagttttgatgtccacaaaggaatttttagtgacgtctattggaagataaagaaaaattcagttttcaacttctacctcttctattcctggaagttttggcttttattggtaattttgattttatttctaattccagcttactattgctagcacttcctctttattcatcacagtacagtcagatttcagttatccaggtaaaaagaggcaaggaaaaagcatgcatactcttagaagagtgactaaaacacaaatcattcagttagtttggaaatctgtttttctgttggccaacgtggacatttttgcaattcatggtcctgttttgagccctggtttaggaaatacatattgggaagtgatgaatgaatgagttagccaataaggactgagtgcttgtcacgtggccagcaatattagatggggtataaaaagtataacacagagacttgtccttaaaaaacttacattctggttaaagggacaaaattaacccacgtaacaatgaaaagataatttattactaaaatgtaaggaattaagctcagtaagagttaaacaaaggtaatcataaattggagtttatcgtgtcctcatcgaaggatctcattgtattaggattctccagaaaaacagaactgataggatattaaaagtaatgggaaaaactgcaattacttttgcaccagctgaaatatgtagatatatagaaagacttattttgaggaattggcttatgattatggaggctaagtcccatgatctgccctctgcaagctggtggtgtggttccagtccaaacccgaaggcctgagaaccaggggagccaatggtgtaagtcctagtctgagtctgcaggctggagaaccaggagtgcagatgtccaagggcaggagaagatggatgtcccagctcaagcagagccagttgacccttcctctgccctttcattttattcaggccctcaatgtattggattgcccacactgatgaaggcaatcttctttactcagtctcctgactcaaatgttaatatcttctagaaacaccctcaaagacatacctaggaataatgttttaccagctgtctgggcatgccttaacccagtcaagctgacacataaaattaactatcacacccatcattttgagagtagagctatttccttctcaaattggggttagatgtttatttttatttatttttttgagacggagtttcactcttgttgcccaggctggagtgcaatggcatgatcttggctccctgcaacctctgcttcccgggttcaagcaattctgctgtctcagcctccctagtagctgggattacaggcgcctgccaccatgcccagctaattttttagtagagacggggtttcaccatgttggccaggctggttttgaaatcctgacctcaggtgatctgcccgccttggcttcccaaagtgttgagattacaggcatgagccatggtgcctggccagatttaattacctctaagtgcaaatgtgtattgtgatttagaagtggatcatgaaaggaagatttataattattttggggaggaaaggggtcccttaactgcatcaagttgccaggtgattcatgcccaaaatatggggttaattaggaaatctataactgatatttctaagtgtggtcgcctgaaccaggtacatcagcatcacctggaaacttagaaatacagattctcagaataactacattatgcatatgggggtgcagcctagaaatgtgtgttttaacaagccatctgcatgattttggtgtacactaaggcttgagaatggtcactgtaagagaatttggggaggctgactgaaagttcagagatgttcctgtgttgatttgtttaagataatggcctccagctgcatccgtgttactgcaaaggacatgatttcattcttttttatggctgcatagtattccatggtgtatatgtaccacattttctttatccagtccacctttgatgggcacctaactggattccatgtctttgctattgtgaatagtgctgtgatgaacatacaagtacatgtgtctttttgggtgaacgatttatacatttttttagttatatgcacagtaatgggattgctggaccaaatgccacatgttttcacttataagtgggagctaaacattgggtactcgtgaacataaagatagcaacgatagagactggggactgcttgagaggggaaagaaagggttggaaaaccaatagtttttcaccagtagttgaaaagctatgcttactacctgggtgacagaatcaattgtaccccaagcctcagcatcacacaatatattcatgtaacaaacctgcacaggtactgcctgaatcaagaataaaagttgaaattattaaaaaatgttcagggatggtactaaaaaggaaacataaattagggagagagactgagaggccagtgtttccagagcaataataaattaagctagaaaccaaatagataaatcttatgtgagctttgttctttcaaacacccgagggggcggtactgatcgtggtaaaagaatgaaagatgggctgcgtgcggtgactcacgcctgtaatcctagcactttgggaggccgaggggagcggatcacgacaggagttcgagaccagcctgaccaacatggtgaaactatgttggtctctactaaaaagacaaaaattagccaggtgtggtggcgtgtgcctgtaatcccagctactcaggaggctgaggcaggagaattgcttgaacccgggaggcggaggttgcagtgagcagagatcatgccactgcactccagcctgggcgactccgtctcaaaaaaacaaacaaacaaaaaaactagcaagacatgaccaggagaattgtaattactagaacaatggtttccaacccttaggatcctctgaattacttggagagatttttgaaaaatcttgcaagtttttgacttcaatcctagagattatgattctcagtctggtagaaggccagagcatctaatttataaaaagcattagatgattccaaaaggcagctaggagtgagaattactgacttggaggcatagacttagcttagaaatcaacaaccaaggatgagagggaagagactggatgtgttctggctttgaaagcttagacgaggagaagagtgaagaacatttcacttgagaacagtacaagcaaaagatgaatacaggcattctggggataattccactttgcaaatatctcagactgctagaaacaaccagcctaaatgggggtctttctaaattttatccctgtctgactcaacatcttctgaaatgggaatcagggtggtaggcagggaagagaaagaggaaagttagtgaacagtttggtttaaaaatattacaggcacttctttcgggctgaatgagaagtaaaaagtataataatgtgttaaggccaggcgtgatggctcacacctgtaatcccagcactttgggaggctgaggcaggtgggtcacctgaggtcaggagttcaagaccagcctgggtaacatagagaaaccccatctctactaaaaatacaaatattagccaggcgtggtggcacacgcctgtaatcccagctactcgggaggctgaggcaggagaatcatttgaacccaggaggcagggggtacagtgagctgagattgcaccgctgcactccagcctgagccacagagcgacgctctgtctcaaaaaaaaaaaaaaaaaaaaaaggtgttaaggtgatgacgttatgggtgggtttttttctctctataaatttttggacaatacattcttaattttatgattaaaaagctttatcttttataaaggctcaaaggaaaaattaaccaaaggtgttcacattagccactttggtacagctgtgaaggaaatctgaggtaaaattggctgtggtgcagttgaggtggaggatgtaaacatactttcagagagcggaatgtgcattgttgcagtataagaaagcgtagtctccattatgctattgtctttggcattgggcatttaatagagtcttcatttgtgaaatatgataatgccttatgattcagaggaatatacgaaggaaatatatagaaatttaaggtaatgcagtttgaggtaaagctttttttcaagaggtttaatatgagccctctgatggaatgtatacattcagtattatgtctttaaagctgaaaggtctaaaaggcttgccaaaaaactcagtgagtcagtggtgacaatatgtttatgtgaacagtgttttccaaattatcaacaaagttaggacaccataagaacaaaaagtctatccttgtagcttcatgactcatcttttccacatcagttcttcaatttctgtctcagtgattccacttcccaggaaatgatccttcccacaaatctcagattttattctggtaggcaaagtttttttttttcttcttacaaaaccatgtgtacaactcatgttgtattttatagagtaaaatatataacataatatggataagattgaaatgagacaatcgattttcttttaaagtttaaaatatacattttattttattttttaaaataaattcctcacttttttttttttttaattggagacaggttctcaccctgttgcccaggctggggtgcagtggctcaatcataactcactgtagtctcaaaattgtgggctcaagggatcttcctacttcagctttccaagtagctaggactataggcatgcagcaccatgcccagctaatttttttttttttttgagacggagtttcactcctgttgcccaggctggagtacaatggcgtgatcttggctcaccgaaacttctgcctcccaggttcaagcgattctcctgcctcagccttctgagtatgtaatccctcctgggattacagacatgcaccaccacgcctggctaattttgtgtttttagtagagacggggtttctccatgttggtcaggctggtcttgaactcctgacctcaggtgatctgcctgtctcggcctccccccgctaattttttattttaatttttggtaaagatggtctcactatgttgcccaggctggtctcgaactccagggctcaagaaatccttccaccttggcctcccaaagtgctgggaatacaggcatgtgtgaccacatctggcttattttatagacttctaaaaggtctgaaatgtgataaaggagagattaactgtcacacgaatataaagtaaatattcagtaaggataactatggctaacatattctaacacttaaccatgtgtcaggcattgcactaagcactttacatacattatctcatttaatccttattactttcctatgaagtgggaacttttattgtccagtacacagggaaactgaggcatagaggttaagtaaattgtttaagattatatacctcataagaagcaaagctgagaattgaacccagagtctaaatccagaggcccatactttttgtctacttaaaataaattcaaacatacacaatagaacagagtaataagcctctattacttagtttctaacaattaattgtggttagtcttggttcatttatttctcactttccctctacaccccacccacccactgaattactttaaaatcagttcaacatcttggttgtaatacttcattgtatcagtgtatattggagtgataaaataaccagtgtatgtgtgtgtttatatatatgaatatatatatgtatttagaccaggtctcactctgtcacccaggctggagtacagtggcatgaacatggctcactgcagccccgaactcctgggctcaagtgatcccccaacctcagcttcccaagtagctggtactacaggcacatgccactggtccaggtaatttattttgtagagacgaggtcttgccatgttgcccaggctgttcccaaactcctgggcgcaagtgatcctcccacctcagcttctcaaagtgttgggattacaggcgtgagccacaatgcccaccccatgatatttttaaaaccttaataattaacaatcatgccttaatatcatgtagtatccagccagtgtttgaacttccccaagtgtctcataaatatcttttttttttttttttctgagacagggtctcactttgtcgcccaggctggagtgcagtggcaagatcttggcttactgcagcctcaacctcctgggctcaagtgattctcctgcttcagcccctcaagttgctgggactacaggtgcacaccaccatgtcggctaaatttttgtttttttttgtagagagggagtttcaccatgtagcccaggctggtcttgaactcctgagttcaagctatcccccttccttggctcccaaggtgctaggattacaggtgtgagcctctgtgcccagcccccagtgtctcataaatatatattttttatgttgcattatttgaatcaggctctacagtcaatttattgcctttgactaatatgtcttttaaatattcccttaaatatttaaaaatatatgcaggtcctccttcctcttcttttttttttttgtttgatatttatttgttagaaaaaactggttactttttcaacatagatttgcagattttgggtttcatttccatgatgtcctttaacttgctcctctagcctccatatttcctgaaaattatagttatagctgaagcttgatgaaattcaaggtcaatttttttttttttttggggggggcggaatctcactgttgctcaggctggagtgcagtggcatgatcttggctcactgcaagctctgcctcttgggttcacgccattcttctgcctcagtctccccagtagctgggactataggcacccaccaccatgcccagctaattttttgtattttttagtagagacggggtttcactgtgttagccaggatggtcttgatctcctgacctcgtgatatgcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcattccagcctgggcaacagagcaagactctgtctaatcaaaacaaaacaaacacagaaacaaacccaaaaaacttcatagatagtgtgcatacttcatgttaatctcattagaggcacataaattcagttcttgttcagcctaacaagataaagagtatctctgtgttcttataaagatattttaaaatcagtcctctgaaaatagattaataaaatattaaaatcacctagggtcactatggaataaagaaatcctaatttaaagaggaaatagtggcccttgatccaactatttaatatggccttagtagaattagctgtatttagggcaagtcagactttattgtgaaatgtaataggtgtctgcattctcttcattttaatcaaagaaacttaagtggcttcttttcttccacatgtcctatccttgacaagatgggcaatatcactaaggggcctggttttctattatctgatgctaggaagtataaacttgtacttactgttcttgtttctcttttatctgtgtatctttgccattctgttttctcaatgaatagtatgttctctcccattcaggtaccttaatggtgtctattttattttattgctgcataacaccacatatttattttttagtttctaaagattagtaatccaggagtggcttagctggatagttctgtctctggttctctcatgaggttggagtcaagccatcagccaaggcagaagtcatccagactgcactggggctgaagaccgtgatgccaagctcactcacgtggcctttggtaaaaggcctcagtcctgtgccatatggacctctccataggacctcatgacaaggaagctggctttcctcagcacaagtgacccaagcaagagagacagcagcaagatagaagccagtgtcttttataattaacctcagaagtgacatagcatcatgtctataataccatattggtcaactattgtacaataagtgactactcaagggtataaatactggaaggcagagattatggggacccatcttaaaggctggcttccacaaacttaggtgtaaaattcttaacacaattttagcaaatagaattcaacaatatattagatggataatataacaaagtggggtgtagcccaggaatgcatggttggcttaacatttgaaaattaataaggagaattcaatatattaacagacaaaaagacaaattatagatttaggaaatacatttctcaaaatccaacatcctttccttataaaattttagtctcatgaca

SEQ ID NO: 83 - DNA, 2365 bp, Homo sapiens
cctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccgcatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgg

SEQ ID NO: 84 - protein, 522 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 85 - DNA, 88853 bp, Mus musculus
  misc_feature (1)...(88853): n = A,T,C or G
gctgttttttggtttttggtattttcgagacagggttcctctgtgtagctctggctgtcctggaactcactctgtagaccaggctggccttgaactcagagatccaccagcctctgcctcccaagtgctgggattaaaggtgtgtgccgccaccacctggtttgacctctgttttcttatctggttggtctactcattgatttagcaagtagaaatttaaggctttctaccaggtgcgtggctttgaggatactgaagtaaattaagtctaacattctctgtagtttggttgtaaaggttggctagactaataaggaatatgttttgcttaggacaggcaaggcaatgaaggggttaactgctggacttggggagaaatggagtgacttaccttctttacctctgtcttagaggcttcttttgaactttcttcttttttagatttatttattcttgttattttatgtgtatgagtgctttgcttgaacgtatgtatgtgcaccatgtgggtgtctgtgaagttagaagaggacctcagatcccctctggctggagttacaggatggttgtgaactgtcatgtgagtgctggggattgattgtgggttctttgtaagaacaagtgctgttaactgttaactgctgagccagctctccgagaggcataactccagccctgacagagaggtttgtgtcactgaactctttgttcagaggagagctagggtgccggtgaccctagttaaaactcagccaacagactgtagacatctagaggagagcctctgaagtccactcatccatgctggggccttgatactgagcctggaaaagaagggacaaggatgggggcctacctagctgctcctttagacttctcacttcctcctccagctgtttgcttcgggtccccagctcctcctttagggcctgccgctggcggctcatctctgaggtaggagcagtaggcagcagggatagaggaggcataagggaaggaaataacgttacacgtaggggaacgtctcggcggagacacagaactaagaaacttgggagaccttgaaaatgagggagataggaaagaagactctctcccccatatctgtttaggggggactctggcctttcctcccacttactcccaaaggtgaaaaaggtaagggctgtcactgcattttgttcatgccaacaccaagcatggaacattagacaccctaggatgtggtgatccgtgttcataccagggatctatctttgggtctctggaccctgcctatgcagggaaggtgagactaggtatggcagttggaatcactcttcatttcccttcctccaattccctgacctcctccaggcccgtctcctgtccacctgatcaaacatacctgcatatatggccttcccttcactttgggttctttccagttcagcttctagcccttgtaacctctgcttcagcctgtcttcagaagccttggctcggcgagcctcttccctctgtagagctgtgagtatcgcagagccatgctcaggcctgaccgtggatctcatagaatcaatcaccatagccttgaactctgcttctctttgggaacttggcagtgtcaacctcttatgcagtgtctctccctggaccctcttgaaacccagagttttcattcctacagagtcaatagtctctccgtgttctggctactaaaaaacaatggcttcccgagctgcagattagcttcacggtagactacttacctatcctgaatggggttgtgattgcgttctcagagtcagggggaagaacaacttcttcatcaatcttcattgtctagcccttcctcacaatccttgccaacagagaattagccctggacatagtccacacttccagttccccaagaacccagagatgccacgtgtgccaaggctgcacggatagttactatgtcaacttgacacaagctagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagcctgggtcctgggagccatccaggtgtaaaacttcctcaagaggtgggaccaagaactgggatgttgggtttctggatactgcacattgtccaggcaactggaaaactcaggcaggtgggtgagctaaatcagctcatacaaaggaaagcttctctttttacctccatatcctagccctaaagaagaggcttaggagccgaatagctattattcatgtctacacaggcactacctgtggtctggagactctccaggctaggaatctagaaacttacagtctgggagagcagtgttttgcaagacatagggaaagcagggatagtggccatcacagctactttatatctggaggtttcgtgtgaacacagtgacattatttactttaaaacggaaggtttgggggctggagagatggctcagtggttgagagcacttggctgctctcccagaggtcccgagttcaatttccagcaacagcatggtggcttacaaccatctgtaatggtatcggatgccctcttctggtgtgtctgaagaccaccagatacataaaataaataataaataattttttttttttaaacaacaacctgaaggtttgcctcaaaaaggctactatggtgtgtgaggtaaacatgttctgacacaggtagttgaaaggatgctgacccacaaagaggaacacaaattagacaagagtctggagttcagctacttaattttgctcagcttgtatttcttggtgtataagttttgtagctcctgaaatccccagacgtcagtggagtgtttacaggacttctttttccctctccagtcaatcttgccttctccccctatttctttatgaggtttaatctgcaggcaggggtttagcagcccccaggctccctgcagcataaagttgcttagggctccctctagtggacttgcttgacctcctgcatctcctaaagtttgcagttggtaatttcttgggcaatattgggggagatcccctttacggggtggtttttagtatcttatgtataattaaaatttgattgttggcagaaagcatgacgggaagccctccctccatctgggagagatccgtctggacctgtgccatctctgggcaccataatgtcaccatacatagaatttaaacaagccttcctcccctgtggattatggaacctacagatcctttttaggcatgtctgtccattctagtccctgaaaatgttggtcagttgcatattattagaagcaaatctgccgaaacagacacaagatgtgggactatgaaatcacttccagagcaagcggaaggtcaatacctgttttatttaactccgtagcactttagatactgtaagagagagttttaatttttatttttgattatgttctttatgtgtgggtttgtgagcacagtgccggggcgtgggggaggctacaagagagctttggagtcccttggagtcggagttacgggtagttgtgagcagcccaccagtgtggtactggaaaccaaattcgagtcctcttcatgagcaggactcacttttaactgccgagccatgtctccagccccggctctggacactttatagagcaaagagtcctacttgtcgttgtgatgcttacagcccctgtaacgtagggctggtgaccccgtacacaggtctcagatatggagaaatctcatttttcatcacgttttcatttattcttcctttagaatctccggtcctttcccaggagcttctcagggacttctttccctgaatctctgtcactcacgtttgtgcttggaaggacacattggggatgacagaacacaacctagacctcatgttttaggagatcgtgtattttacaaatgagttcagtcaactgactctcaggtgcaggatcaggatgtggtttgaggtcaaggtgaagtggagaaaaaaaaaggtgccatgtgtcacgtgatgaactggtcccaacggaacccagaaaggggttggcgttgtgctcagcaattcagcccctctttagaaaacaaaccaaataaaaactgtgagaaaaaggccaaccttcccttctctttttattgacttcagtttagaagcgacgataggaaagatcgtttctgatctcactgtctctgttaatttttttttttttttttttttgggctggggaagctggagaaatgggtcagtagttaagggtacacgctgctcttggagaagacccattcaagtgcacacacacattcagattgttaaaattaaatcttaaaaacttgtattacatttagtgtgtggtcagaggacagcccatggggacttggttctatccttctcccatgtggatctgtgggattgaacccaggtcgttgagtctggcagcacatacctttaccgactaagccatcttgttggctccctgtcctcctttgaataagatctatccaggatggcttctgtttgcttgtcttttgagaaagggacttacgtgtagctctgactgacctggaactcctagattggggcctctacctctgtttttacagggctggaattaaagctgtgcaccacagcctgatctggacaagagtattgaggagatatataagagggacaatcattcacttttattcaaataggacattggttatttatatattaaaagaaatgtgacctgatcaaaaacacagtggccttggcctacaccaccggctctcccccttcctaatgctgtgacgctttccgacagttccttgagaaccccaaccaaaaattatttctattgttgctttatagctgtaattttgctattgttatgaattataatgtaaatatctgtgttctccaatggtcttaagtggcccctgaggatcccttaggggaccacaggttgagatccactggcctccagggaactgtgagctaagcagggtgacatagctacttgggaggctcttcgaggaggatgctttgaaccagatatttnnnnnnnnnnnnnnnnnnnntttgctggatgggaggaattggtctggtaaggttagtagaatcaggtggtgtgtgtgtgtgtgtgtgtgtgtgtgtgtgtgtgtgtgtgtgtgtgtgtggtgtatgtgcgtctttcttggcaggaaaaacagctttgcaaaggcctagaggtatgtggctctcagatttctggaattagaaaactgtgctcatcttctctgggctggattttgagctattaaaaaatatatataaaacgtagggtggttttcagttcctctctttgtttccctctggggaaaagagctgctgggcccttggccacttctctgatggacagacgggaggttagaggtatggagaggtcagggtatggggactgctctctgcagatatggatggctccgctgacccctgcctgggggatgggacaggctttcagagattgggttgctgtcttttgttctttgagatggcagctgtgcttctcccaggaaattgacacaggagtcagtgtcaaagtatcctgaagggtgctcaggtttctggcaaatcctctacctttctcatgcttaggagagagatggcagcctccagatgaccagcagcgagggttctgggttagaaatgacactgggattagatgcaagtcttcgtgatgctatgtatatagtaaattctgatgagcacttaacagctatgtttacagtttaaatcagagttttgctggggtttcaaattgtctcctcctaatgacttactgctggtgtgcagtgaactctcaggttcctgtagaaaacaaaccaagcaaatcaaagaaagagacagaactatggcctgctgcagcagaaaccaagtgtgtgctacattattctaccatatgcagattttactgaagataaggcaggttggaaatattttttattttaatttttaactttgagacgaggtctcttaggagccctggctctcctggaactcactctgtagaccaggctggcctcaaactcaagagatctgcctctgcctcttgagtgccgggattaaaggcgtgcgcccccggtgcctggacagcccaaatgatttttgaagaatgatgtggatcttagaagcacactccaggcagaggggacacactcagtgatgaggaagaaaatgttgctgttgtcactgtgtgacttggtaagctatccagcatagagtctatgtatcatgaagtagtctacaactttaagtaagattgtgactgttacttttattacagatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtggcgcacacctttaatcccagcacttgggaggcagaggcaggtggatttctgagttcgaggccagcctggtctacagagtgagttccaggtcagccaggactacacagagaaaccctgtctcgaaaaaaaaaaaaaaaaaatgactgatttgcaacccaaagttgtgggactgaataattctggtgttcagagactgttttctttcttcaagtactggacaagttcaacaacctaccagccaaaggcttggtggcagaactgagtacttaatgtcaccaaatggttttggagctaaaaaaatattagcaaaccaaggttgggtactttcttcttctttggaaaagaagttcctattttcaaagtacttctagtgaagtctgaagattagggaagtgaaggtgtccgggagctgaatttctgttccctccatgcaagtggctcacagcctctgtgggcggggcctcgtgccgccagcgcattccgctgagcaatagaatatctttaaagtacatattcagttcccagaaaaggaattgctcttcagaaagaaaaagatcaaaaggaagttacttgttttaaaaaggttaaaaagtctggaagaagcgcgtgagacgcgagtgtccttaaccttaaacctttatgtgacttagtctgcaaaaagctgcagcaactgaattcccaacctttgagggttataaataccaaggcgatttttaatccctgcgctcgggaggtagaggcatgtgaatctctgtgagttcagagccaccctggtctacacagcgagttccaaggcagccagggctacatggtgaaacaagatggtggaatagggatatagctcaaggtggggtacttgtctaggatgtgtgaggtcgtaggttcaattccaatcaccacaaaaataaaaacactaaggggaagaaaacgaactttggctttctttttccatctttccacaagatgaggcagataactcgaagctcaatatccacatttagaagactccttccatccctacccgtcttaatccgagcacagccatgactcaactcccggaggcaacaagcccaggccacaacgaacatggacggccaggcttctcttctgcctagtgcgcaggttctaccttggaccccacctctttccttccattcctctcttctccagcagagggcgcaggcactgagttttctttgggctccgccccgcccgtcccagtgggtcagggcgggagcagtgggcgcggaaacttggtcgaggctttccgggagccgcggggcacgcgggtgcacgcgagctcgtgcgcgcgttgggggtcgccgcggcgtgccgtgcttgcccgtatccggcgcgcgcccccgcgttgcgccggccgcgctcgcgcccgcgcaggggcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaccaccaccaccacctcatcccgcaccctccctgcacggtggacaagtaagatggtggagaagtgctggaagctcatggacaaggtgagcggcctgcgggcgcgcgcggcgccgggtgggcgtgggcggtggggcgccagggagggctgccgttggcagttgggaacgttgaggtgtgggggagccagacaaagatggggtgggggctgggggagggctggtcaccgcgccacccgggcggaagtgcgatgggggtgcggagcttggggatgtgggtcgtcgagtgagccccgggaggtgggcctggggtgctgggggtgggatgtgtgttggatctgccggctacggctccgggtttggaagaggagtcgccctgggtgagggacttggggtcaggaggcggcccggctgactgcggtcagggtgagcttatagttttttctcattaagatgtagcacacagatcaaagaaaaagaggtgggtttaaatgggggcagggaaggaaggaacttcccttctccgctaaggatggcttaagtttttgtcttgcaaagtgttggatgtaatccatcgctgctgctgagataggcactggttaaaccacaagttctggttagaaccattatctttcgaaaggtggactgactgagcgtgctgaattaatagtctgacttatacagaacttcctgcttgctctcggtgcttttcgctgggctgtagtgtttgatttttgtaacgggcctacctgcttattatttaagacccctttgatagccattataaaatcaggtgcgggggtggggttgcctatggttagccctttaagtctgtcaatcaggagaatcttacttccttacagttgagcctgtataatgtagtcttgtagttggccccagtacttaaacgtgaatacacaatcttgtcttaacattttgttggaagtcagtgctctgtttccttaactcttaccacagttattatttttttcaacattcctactgcagataaatgtgattaggaggccccggcatgtaagtgaatggtattatttcctccggagtaaatttggttttctttggttcctctctgggcctaggttcctcttctgtaaagttctctatgggttgttttggactagaaacagccaataaaatgattatgaagcacttggccaatgtaactgctatataaatgcttaataagtcttgtgtgagaattaacactcttgcactccataccaggtttcagagccacttttccagggctgacccccccctacattaagtaatttgaattgtggcagcccccctccctggtcccagttgatattgcaattaatggcataagtatgctgattattttggtgttgtggaactgactttattgaaaagatatgctgataccttgtttttctttttaaaatatttgactactttggatattttgtgtgcatgtatgactgtatcacatgcatgcagtcagatgttgggttccctggaactggagttatgggtgctttcgagccagatgggtgctgggaattgaacctgtgtcttctgcatgaacaacaaatgctcttaaccactgcacagtctctccagacccagtataaccaagactgtctggagatggcagggaatgtaaccattttgtttgtttgttttcttactcacatccctcacacttctcctggtcacccttctcctggtcaccccttttccccaattcccctccccttcatttctgagcaggtgggtgtccccctgggtatccccttgactctgtcacttgaagtctctgtaatctctcccactgaggccagacaaggtgctatggagcctggggtggctgcctcctgtggcccagcagaagccctggtggagtgattaggacaccaacccacccacagaacttttgactcaacattcatccatgttagtttctcaagacaagctttcactatgcatcttcaggccagtctggaactcacagcagtcctgcctcagcctgtcaagtgttgcctaaatccatgtgttgacatcttacaaaaatattgaatgtctttacagtttgaagtttgtaggtttaactgttggggactcctggtagagaaaaatagtttcatttctagctagtttcccatataggatgtctgagtgggttcattgtatcaaagtgatcctgattagtgacttctgtaaaataaggagcattaaaactatgtttctgctaatgaaagcttctagctattctgcatggcagcccaagtaagccctcctttatttgatccgtgtttttatcacttgagcgtattgaaatttgagttttcctagggatgttcaatcacttacagtctcagagttttgattgaacctgtttagattttggtggtttcaaggacagcaggctgctagctttacccttctagtctaggaagacgggatgttttactccttagtgcttgtttctgaagatggtttcagcagtgtgtcctctaacccgccactaattgtgctcagccctttctcagcttaggcctgcaggtttgtaccacttttcagacttccagattttcttaatacttccggactgttacttaatatctagtacttgctaaattgcaccaactcctttgcccttggagttttggggtttctttttacttttttttttttttttttttttttgggtttttttgagacagggtttctctgggtagctctggctgacctggaactcactttgtagaccaggctggcctcaaacttagaaatccgcctgcctctgcctcccaagtgctgggattaaaggcgtgtgccaccacgtccggcttactttttttttttttttttttttaaggtcttttaaaaatacacattatgtgtgtgtgtgtgtgtgtgtttatgcattcgatagcccatgtgtggccatcaaaggacaacttgtgagagtcagttcactacttccatcaagagagtcccaacagagtgttactgcttactgcccctcccccagtctttaaatggggtcattatacctttttgctttatatgtgtgagtgttttccctgtgtgtataatgtatatgcatctctgtatgcctgctgtctacagagggccagcaggagtcttgattcccctggaacaggagtaacagactgctgtgaacttccgtgcaggttctgggaagtgaacctaggtcttctgctaagagcagtggctgctgagtgatctcttgagcgcctcattgcatcttcctgatgtgtggaattctggagtgagtccctgagtcatcacttcatgcctgtcttgttcttgtgaaggttaggtgtgtcttattccagcccgctgttcaccaagccctggggactgctggtccgctccttcccccagtgttggatgtctgcagctcatctaagctgtggcctttgctcaatataggccccgtttgttcagccttgcgagccttaaatttgttggggggaaaaatgcttgtgttagaacaccccctaaataaaaataggcatgaccaatttttcttttttgcttgtccccccccccccccgtgttaccaggctattgtagtaaatattcgcagaattatttctctgtaaagaagttgcctagtacttcaaagactagacagagaagtgaggatggaaagaagtttcaaatgaccttaacatgtaaattttaaatcaccaagatatttaatttagagagctggaaaatgccattgtaaagtacagctggggttggcagacatttccggtaaagagaaagatagtaaatattttggtcttgctggttagcatgcttaatcccatatcttttgttgttgttttgaggttttaaaacttaaaaactattctcagcttgaagatcttccaggccacaattttctccctctgcagtggtaggatcttaggatcactgtagcccaggcactcctgcattacaggcaggcatcaccatacatagctttcagtttttgaggttaaaagaagtattttcaaaaaaggatgatttgggggcagtgagatggctcagcaggtaaatggccctgctgccttccgagttagcctcagaatgcacaaagtggaaggagacccaagtcctacacattgtcctttgaacacagcacacatacaggcacatgtgtgcatacactaaataataaaaatgaagaaagtgatttcctgccgggcgtggtggcgcacgcctttaatcccagcactcgggaggcagaggcaggcggatttctgagttcgaggccagcctggtctacaaagtgagttccaggacagccagggctatacagagaaaccctgtctcgaaaaaccaaaaaaaaaaaaaaaaaaaaaaaaaaaaaaaaagaaagtgatttcctttccttctgtcatctttctttgtccccacctgttccctactcccaaaagaacattgggtaaattagtatatttggaagtaaaatgtctttagtgttttcattgggcttgttgtccttccctcctctctcccttccatttgatttgcctgctgagttccaggcaggtgctaggtgttaggctcacacactgcaggagctgggaaatgataagtgactcctgaagtggtctgtccagagagacctggggtctctcaggtttaaacacaagacatacttgttccgagtttatcttagcctctaaggctctttggtgtgcgttcctgctgttttcttttttagatgcagtctcactaacctggaactcacatatctgcctgtctccatttgccaagtgttggaattaaatgcataccaccacacctggcctttcgttgttttttttcctcttgaaccccaccatgggtatttttgtttgtatactagattggcctcctagattttctgtgattctcctgctttagtctcctgacagccagggttatagccatacaaaggccaccatgccagacaacctctgaagcttgtaaactccacagggaaagcagctataagctatgtaagcggattgtctgttacactgttagggcaggggagccttacagtagtaggtactgtgtaagtttttgctaaattaagttacttgtatgaccaaaaggaattaactgaaaggaaaaggcctgtgggtgggaattaagtagctgatttacttattttgttttgttgtggaagaatttatttcagccacagtaagtttatttcttgtcataactctttattggtatcatccttgttttataggtgaaggtagttagggtcagaggttcagtaatcccctgacttggaatccagggttaacttacttcctaagactttataagttcatctctttacttccttctcaggtataaaacaaattgtcaatcgcagaagacattacagtggagctaaaagggatatttgtcagtcacagcccacatagatgatgctggtctcacgagatagtcacggagcacttccttcccttcataggacagcacgctgctgtcttattggtgctgacacaaaccccctgtgaggccagtcacatagaattactacactgcattatacttggtaatgacgatagatgtctgtcacattactagactatactattttagtgtctgtgttccttctagtgaaggtaaacaaactgtatgcagtgttaagctgggagcagccttctagacgccatgtttacagcagcccttacttgatcaagagaggcatcatgactagctgtcatctaggtttgtataggtacatgctaatgctaatgttcaagcagcaaaataacctgaagatgcatttctaggagaatcaggattgtgttttgagagagacctgtgtaggttctcaagggtgattctcaacctggccctcatttgtgtggtgtcaaactgtcgttctctcagttggtgttaaggtaatgtttaactagtgccattcaatggaataaatgttagctacttctctcagagacatctcatcatatagctttagctggaatggaactctggaactcactgtagttgaggctggccttgaacttttagtcctcttacctgcgcctcccaagcgttgggatccagacatgtgctgctctggcagacttctggtagctcttgctcggtcagagtgagtgcttcacattatgtgcattggctactctgtgtgctgagcatgagtgagcgcacacattctttcccattatattaattaatgttgtctatgatggcatctaccatgccagcctaaggggaagagatgagacagggactctatgctgccaggctgtttgtttggttttttttttcgagacagggtttctctgtatagccttggctgtcccggaactcactttgtagaccaggctggcctcgaactcagaaatccacctgcctctgcctccctttaattcctctgctgggattaaaggcatgtgccaccacgcccggtgtaaggctggttttgaaattcaagtgatcctctgcctcaaaccaccttctgcccctccccaggtactaggatgatagctgtatacaaccccactcagcactttttaccatttttactttgactttgactttttttcaagacaatgtctcttctctggctgtcctagaacttgatttctataccaggctggcctttacctctgagaccttactgcatctgcctcctgagttctggggttaaaggcgtggccaccattcccagcatatcactcctaccttttatagtttatatattttttgatttttgagagaggcttacattttgtagctcagcttgccctcgaaccttctgattctcatgtctttgtctttcaaatgctgcggttttaggtatttgccactatgcctggaaaatgtgctcttttgtgtatgtatgttttaggactcctccagaggatatgaaattcttcattaactccaaatgtgtgagatttaaggcaattaaatattttgtatgactggtgttcaagtttgaaaggtcagaaataggattaagggctcggaagatagcttagtggttaagagcactgactgctctgccacaggacaggagtttgattcccatcacacacatctttaaccccaggttcaggggctctgatgtctttttctggtcatcatggcactagacatacacactgtacatagatgaacatgcaggcaaaacatttgtacacacaagataaaaaatattttaaagtaggattaaatcaaggctaaactttttgatggctcttacgatagaaaaatttgcttttatttaatatgtgcttagctggttgtgtacatataataaactgataaatcatgatcacattggtccctgagtctttccccttagaattcatgttgtattcaaacataaactgtgaaaaaattatttccttaatgattaacctggaacattcaaagaaaagcagattgagttttagtttgaaaacagagcctaaattttaatcacggtttctaaagaagttgttaattctgatgtccattaggtttgttaggagggggattgtaacaagcaagtcattgtgaagtgttttcgtgattagcacattttgtgctggaaggaaataggtgggagtagtcgctaggagcactggaaagcagcctcatgctgtcccccacagtgttcctttccacagcagcttctaaaagggggaacggtttctaataatgacgttgtgacatgtccctggggatgcaggcactgctgagagcagtggtggcactacctacacatagccgtcagaaccaacagtggtgggcagtgtgctcactcagcatgctccaagtcttggggtctaccagggatggtgtggtggcatggggacaggacatgacacaaggtgacacactggtgacacaaggactcagtagtgactctggatttttttctctatatcttttggaatggttggtggataagtgtttagatgagtctgatgccagagaccttaagttactgctctttttcctccagctctggtctgcatggaaggcaactttgaacaaggctaatttaattctccagtgccgcattgaataggatggggtctgaatttttgtaatttcttgttttttgttttatttttagggataggaccttgctagcccaggctgctcacactttaagcagtccacctgcttagtctctctaatgttggggttataggcattgaggtaccatcctcaggactacttccttctttagatctgctttgagcagctgtgtggatctgtagcacttttttgagaaaaagaaaaatacaactgttgtatcataaaatgcataaaagaaaatgtagacgtcctcattacttagtgctcatactccaaatgagctccctctctagaagcgtctagagttcactcctctgccccatcctgcttcctaagtggctgaggaactccatggggagcatcatctttgagacacttactgcactattgacttgtaacctgtaaagtttgtagcatttggctccttttatttttcttcccttctggtactggagatgaaacccaacgccttgagaatactgtgtaaatcctgtctagctgaatattcactccagaccaacagtgacaccacagaggatcagtaattagccattctttatatcttggaccggtttttaatttcacatctttttataactccagaatctcaaaatactgtgtctaatagcttaatgtactaaattttttttttacaagtctctcagtttgtaactgtgtgtgtgcacgtgcttgtgtgcttgcaaggccagaggccagcctaaggggttattcattcctcagaccctttccacatttgtttttgttctggaactggccatgtaggctaggctagctatcttacaccatcgcagatagccccaggtacttgcctatttctgccttcccagagctggaattacccctgcctgacctttttttgttggttgatgtttgtaatgtggattttggtgggttgaattaggtcttcatgcttgcaaggtaagcactggaccaattgagctctttctccagttcctttctttcatctcaagtagctctcaaactggtggactggtgaactagtgatcctcaaagtttaaactggcatttagagggcttgttaagtgggagaatctggtaggcctggggtggggctgggaggggggttgttaagtgggagaatttggtaggtcttaggtggggcctgggactctgcattcctgaccctcatccaggaaacagtctagttggtctaaggatcgaatttgatgtagcaagactctctatatactacagttgcttttatttagaaaagcttgatttttttttttgttaaaaaatggcagtatggtatcttaaattatgaaagtaacacatattttttcttttttaaacaaacagtggggtcctaccccccactccccagagacagggtttttctatgtagccctggctgtcttaactctctttgtagaccagactggcctcaaactcacagaaatctgcctgcctctgcttcccaagtgctaggattaaaggtgtacaccaccgtgcctggcagaaacagtgggatttttacagaatttttttcttttataaatttgttacatttctgagatttttcccatgtttccatgtccctataaaagctttcaaaggactgtgtaaaattttatgatatgggtaaatttgtttagtctctgcttcctgagttgtgggattaaagatgtgtactaccacatctggctatttttaggttttaatattagaaacagtttttgtcttgacatagagttaaatagattaaatagataaacagattaaacatagagttaaataggttaaatagagatagccttaaaatattgattcttgattccgcttcctaggtactgggattagaagtataagctaacactcctggcctagtttctaagttttttttttctttttaactttaattttttttatgtgtttagtgtcagtatgagtacagtttaaacacacacacacacacacacacacacacacacacacacacacacacacgcctttaatcccaggaagcagaggcaagcggatctctgtgagttcagaatcagtctggtatacatagtgaattctaggacagtcagagctatgtacaaagacctgtgtcaaaaaaaaaaaaggtgtgtagggtggggctggagacgatggctcgggggttaagctcactggctgctcttccagagaacctgggttcaattcccagtacacacccacatgatagctcacaactatctttaattcctgttccagaaaatctgacaccctcacatagacatacatgcagtcaaagcataaatatatatcaaattaaaaaaattatttaaaaaagtatgcacacatatttctatatgtacatatgtgtgtcgacacctctttacagtcacagttttatcaaatggaaactcacgtcgaagagctggagagttaagatggttcagtgctcacatttaacaatctgtgatgtatgtaagtataggaagggccctggggactctcagagagctagagccagaccaccacttaattcctgaggagacaagaggattgggaatggaacttctttagtgccctaatctgaagttgcattgggatagcatccagaagttttgctaatgttgcttaatctgtcctttgtgttagcatttggcttgaaagttaaagttacattgattatttctgcatagttatgtttttctctttaaaaatagagtatgtataaaaaccgaaccataaagtatgattgagcttcagaacatatcgttttgcattgaatgtattttttcagaagatgtgataaatgaaagtgatgagctttaagtggctctgtatggtaacatgctgctggtaactggacaagaacgtacagttacgattcaagagcctgaacagagctttggtaaatcaacattggaggatagtagttagaagaaaggctttttcctttgggccctaaattatttagtgatagtaggtttttatgaaaagtataggttgcagatttgtttctggaaaatggtcttctcttgtgagtgcccgactcgccagcaaagcagacgccacaacaggatccttctgcacacatttattgggagagcttgattgcagaggcgaaaagaccccaagcccagaactggtgctgcttatataggccttggagaggcgtgtctcacacccggattggttatgctttccacctcatttgcatgttcctcatctgattggttattctctctcagtacctcactgagcctcattatcatacctcatttgcatgtctctcatctgattggttattctctctcagtatctcatggagcctcattatcatgtccaggccaggcagtgacttggtgaaaaactttactgcatatgtacatattggttgtttacccaaacttatgcgtggtggccagcggtagccagtgccaccttgtaatggcatatgtggcttcccacagtcttcagttctttttcttttcttttaagcttccctatgtatttacacttgtaaaactgttagaccttctctggttcggagagggtagggttgggtttttgagacaggtccatacacactgtaagcctctttctgtctctctagtactggggttacagcttgtgttccatcatgccaagcttgaactttctatcttttgaagtttctgtggattttattttttttgtaaaaaaacacttatttttacttacatgtatacatgtgtgtatatgaatgcaggtgactgagagccagagacatggggttcccctgcaggtgaagttacaggtagcgtgtgctaggaattaaactcctgtcctctaccagaacagaaagcactctttaccatggaatatctccctgaccctttctttctttttgtttttgtatttttattgagacagagtctcttataggtgatgtggtcttgaaatgttgatcttcctgcctttaccttcccaagtgcagggcttacagtccaagtgtgtgctaaccttgactagcatagccaagcctggctggcatattttaaaagactttagaaattgacctagtgcttacatccacagacaaaaattgaagttcaaaaagatgagtatctgcccatgttaatgtatatgtacttattgtcccccttttatgatttacttatttatttattgtgagtacactgtagctgtcttcagacacaccagaagagggcatcagatcccattacagatggttgtgagccaccatgtggttgctgggaattgaactcaggacctctggaagaacagtcagtgctcttaaccactcagccatttctctagcccggtgtacttagtgtctaaagccaccagactaatgatctttcctaaggtgcctcctgtacttgtgagcaagattattttcaaagctgtagtcaagttttacattctgtactgtgtatagctccacttaaaaaacatttgtttttgtaatattgcaatttgttcctttaaaaagtgtgtatgtgcatgtgtttgtgagtgcatgtggaggtcaggacagcttttgggagttgggtttggctttcctccctgttgaggcagtctcagctggtccaggagccttgggcagttcttgtttctatctcccatttgctgtttagacactaggattacagtgtgcagcactggatctagctttcagtgtgggctccagggatggaacttggattgtcacacttgtgtggctagcagttttacccgctgtgccatctctctggccccaaaagttttactaattttacagaaaaacttgtaaataaaaaatgtttcattgggaactgaggaggtggtttagtgatgaatgctttgctcacaaatctgagaaccagaacctgagcccagtgcccatggaaggagccgggcactgtggtgcttctaattccagtgctgcagtggagacaggattcctgaaactcactgccagtcagcctagcctgcttgttgagtgagacccagggcagcaggagactgtcttaaagaaggatgacatctgaggctgtcttggcctccacctgtgtatgtacacacatagtgcgtacttgtaaaaaatgctggtatgggcaggttgaactttatggagaaaaaacatttatttaaaaattattttgtataagtactgtgacacagaatattttcagattatttactgagtgctacacatttgtttagagaaccaaagacacagttaagaagacaacaaataaaagctctagcccttaggaaacaagcttagatatacctttcctgcctagttggaaatgcagattcctcactggtggagaaactctgtattagaacgaaagcaggcaggcactgttctctgtggtttctcacttataaaaatgcagcgacttaaaaacttactaggtgtgcgtgcatgtgtgtgtgtgtgtgtgtgtgtgcgcgcgcgtgcttgcgagcgtgcatggcgtacatgcagaaggcaggtggcagcttctctacttccactatgtgggttccagaaattaaccaaggctgtcatgtcaggcttacacgaagtttctttcccatcccagccatcttgcggtcccccagatgtagcagttttaaagcttggttttacttctctctactgtgatcatagcggtttccagtggtttttttgtctgttgactattgagccttggcagagcaaagggagaagtgaagccagtgagaagctattatgaatggagcctgtggcagctgcacacagacattgttggatttccagagctaagcacgcgatgttgacattgttctgagggactataaatatatagctggaaattgtaaaagacagacactttagaagaatatatataataaaatttaccaaatagagggtaaggctaagcagaattttccttatcctttatggctttttgtttgtttttaaaaagacagtgtcttgttatattcttggctcatttggaactcactgtgagcccaaattggcctcaaactcatcaaagttctcttgcctctcagcctcccaagttctgggtttataggagtatgccactaacatccagcactttaggaaaatcaaaattatttttctttatgaagtattttgatgaatgattgttgggtttttttgagacagggtctctctatgtaatcctgactgtcctggaacttgctctgtatatctggctagccttaaactcacagagatcttcctgcctctgcctgctgtgattaaaggtggcctccagtgaaaacatctctaaatcatagaggcttcgatgtgcgttaacttttcacttgaatttctcacagaggcctttttggatcacctttaaaaggctgcaaatgcttaggccattttctttccttagggagtacataaagaatacacctacctgggctggagagatgtctcaatggttaagagcactgacttccaaaggacccaggttcaattcccagcacccacatggcagctcatagctgtaacttcaagatctgacaccctcacacagacatacaggcaggccaaacaccaatgcacataaaataaaaaccaacttaaaaaaaaaaaagaaagaacacagctccctgcgtatttattttccttatggtcagtgttaatgctctgcagtagaggacgtggagcttagcggaatgctgacctccctgctcatgcactgattcatctcaaaaacattttggaaaaagcagatgtttaatcttcaaacctttttataaggtcatattttaacaaagtacaaataacatctgtgagaagtgcattgtatggggctggagagatggttcattagttaaaagcacttgctggttttgcagagcgcatgggtttggttcccagtacccccatggtggctcacaacagtctgtaactctggagtcagagcttccagtgcccttttctagcctccctaggcagtgggtgcgtgtggtacgagtacattcatgcagacagaacactcacacagaaaagattctttgtttttgaagtacaccatacaagtttaaaaatgtacagtgagtattttggaagccaactatgatggctcagtcttgtaaatcccagtctgaggcaggagaattgctacaagtttgaggccagtctgggctacagagtgacactctaattcaaaacacacacacacacacacacacacacacacacacacacacacaaaagcaaagaatttttatagatttttgtgttgaggtataaagctgtctgtttttagctctttgtcagtaaattgtatattataggctgggcattcattctatataaagccagagaaattttagtttaattaaaaaatttttttagctaggcagtggtggcacatgggatttttgagtttgacccaggccagcctggtctacagagcaggacagccagggtacaccaagagaaaccctgtctcgaaaaaccaaaagagataaataaccattgttatcattaaggaacatgtatcttcccaccaaccataaagatggttggtgtatactacattttaacttcaactttaataagaaatacgctaataaatacttttttttttggtttttcgagacagggtttctctgtgtagccttggttgtcctggaactcactctgtagnnnnnnnnnnnnnnnnnnnnnnnnnnnnnnaaatccgcctgcctctgcctcccgagtgctgggattaaaggtgtgtgccaccacgcccggcttaaatacttttttaaaacaagatttatttattttatgtaaatgactacactgaaattgtcttcagacacaccaggagagggtgtcagatcacattgcagatggttgtgagccaccatgtggttgctggaaattgaactcaggacctttggaagagcagtcagtgctttgaaccgctgagccatctcaccagtcctagtacttttttgaaagatgtgtgtgcgtgcgctcaagcccaatcaaaccaaaaggttacttcagagtcccctggagatggatttacaggcgagattggaactgaactccagtcctttgaaaaaagcaagtgctcgcaactagtgagccatgtctcatgccacacgttttaaagtaggaagattgtctgagtatttggatatgtaaatgtaaatgtctttcgtgtttacttttattttcatgtatgtctgtgcgtatgtctgtgtgacatgagtgcaggtgcccacggaggccagaagggttagatcccttggagctggagtgacaggggactagaatactgacactggactctggttatggaagaacggcaagtattcttaagtgctgagccatctctccagccctaatgtgagtgattttgttgttgttagtgccctaatttaggtcctgtgtgtgaggactttggttttttgtttttggcttgaatgtatgtatgtgtaccctgtgcatgccgcaggcccacagagtttagaagagggcttcagattctctggcactgaagttatggatggttgttagccaaaatgtgggtgctgggaactgagcctgggtcctctgtaagaacaacaattaattagtcttaacttctgagccatgtccatcttcattcccccgatgttgtagatggctttggttagaagttgtacttggcttgaattcccccccccctccagttttttgttttgttttgtttgagacaggatctcacaatgaagccctggctgtcctggaacttgctgtgtgtatcaggatgacctcaaactcagagagatctacctgcctgtgggattgaaggcatgagtcactactcctgtcttggcttctatcactgaaagtgcttttgcagaagatcggttctcctgttgttgttttacctacagtattctgcctctgtcctggtttctgtagacttgtaggactgagagggtaactgtcatgggccagggtagtaagagcaacgctaatggctcctgggagtcagcaaagggtgttgtgaaatctatcattttgcctcttgtctatatttttattttaatgcacaaactgttaaactcctgaatatatgcaaactcagaaatgtgccccaaatcaagaagaggctaaaagacaagtttggtatgctacttaaattggaatgcagcatcggttcaccagtgcagtcgtactgctggtcagggagggagggtgtgtgtgtgtgtgtgtgtgtgtgtgtgtgtgtagttttgttttgaaacaggatctagttataccctaagctgacctcgtttacctgacttgctgttatagcttcctgagtcactacaactgtaggttgatgccattgttcctagctaccactgtgtcttcctctcagttcttcaagagaggttgtatggaaatgggagggggactatatacatcagagacttacttcattggtagtcgggagggcccttcaccaacattttatgagatgggttttatctctttataggtaaagagtattgaggcccagaggttgagtttattcaaggtaaatgactgacgcaggatattttgatatggttggttgatagaaccttaccaaatactaaaacctgagtttagtctttgtcttatctcctaagcaattcctaagcaaacccatgaatttcttaatcgcatgtagtgccttgttggctgcacgttagtctaattgacctttgtattcttcatagtcttcaggtaagtcccaactcattggtaccttaggactgttgaggtaggtgtcttgttggctattctgctaattttacagaccggactttgccctgtgatttcagccctcagcatgaatatcacctagtagagccctgtcttctgttttaaagcagccacccagcactttgttataacaccctccttaactctgcacagagcctggtatttccttgttgacaacccttcttcccaccccactacctgataacttctgtcagattcagggaccttttctttgcatttcatttcccagaatgacacatattgagaaaaattgaaaccatcagactcagtttaattacctctctacttacctacatatctctgctgtctaagctcagtttggtcccctttcttctagttaggaggtgtctgcttagatagtgtggtccttctgacccgaacttcaggtttcattcttattgttttaccagaaacttgttattgttctcattctttgttctcagtatgaaacatgtacagcttcctctgacaataaaaacctggtcagggggtggctcaaatgatagtgcttgtctagtgtctatgatgtttcaggttctatccctaatagtgcataagaaagcacacagggaatggggttacatgcctgtaatggttgccagactgggatgagaccttgtcttaataaacacaaagctttcaatcacaaagcttttgtggtctttgaatccttttcttcaattggcacataaaaataatacatatttatggcatatactaagttcccggttgcttactatcagttttctctctacccaagatgcactatactttagggtgctaccatgtaacagtttttattattataaagtatattttgagttatagcatcaaatttacaatgaggttttggaatgtaatataacttgggaatcatttgttttgttaatatgaaattttaattattgagcttagaatatgtggggttttttttgtttttgttttttgagacagggtttctctatagccctggctgtcctggaactcaccctgtagaccaggctggccttgaactcagaaatccgcctgcccctgcctcccgagtgctgggattaaaggtgtgcgccaccatgcccggcttatgtgatgttctgaatggagccttttttcttggctaaggttctccctttttttagtacctcattggatgaacagcttccagaagtaatgttaaaatatttatgcatcgagctggaagtggtagcactcgcctttaatcccatcactcaaaagataaaggctggtggatctccatgttagttcaaggccagccaaggctacacacagaaaccctgttggaaaaaaagaaaagaaaaaatatttatgcatcaagtatttttgatgatttagcatatctttatttgctagacttagacagggctattttccaagagtataccagaaatgatctactgctatatatttaatatacatattaaagtgatagttttagagcctatgaattgtgttttcacttgaagaatccatgatggttggctattatattggattttcgcagtttgtgtgtttttgtggcgtcagcatttttacatagcccaggttggcagggaaccacttgctccttcctgcctctgagtattggcattacattggggtattataggtgtgtgctgtcacacctagcagctgggatctgctttaaggaagcatgtctaagcgtgtctatcaccttgatacttgtagtcatgaagaggtgaaaacaacataattcaagtaaagtggatagctaagatagagttattgaacgaatggtttagacatcacagaagtgttgctagcatgcgttggggacgcagtgatctgtcagtgagcttgagctctgccccagtgtggtgcttccttttcctcctttctctcttcaccccttagtctcgctcttcctcttcctttttgtttcttgagacagtcttatgtatcccggactggccttgaactcttgatccatctacctccacttcccgagtgctgagtttataggagtgtgccattacatccagatagtaatccagatatttactttaacattttcattttgtagttttataatttcaacactcagtagttagttctgtgtattgattgtagtttttatttgtttggtttggtttggtttggtagttgtgtttttagtggtaatagggatgtaggctaaccatatatatggatcttttggggtgaatcttcatccttactatgttttctggacaactacattagaagcagtatgggacattatcactccttctgatccaaacagctttgtggagcctggtatcttcgtgcgtatctgaaggtcctgtcttttcatttctggatttccccctttgtttaaactatgctttgtagtccaggcaggccttgagcttgaagcagtcctgtgacagacttctgacctccgctcttatagacataagccagagcttttaaactagtctgcttctaaccagtgacaatgagagcaaagttagaagatacagagcatttatctagtccagtagttctcaacctgtgggttgtgatctctttgagggccacatagatagcctacatatcagatatttacattatgacttataacactatcaaaattacagttatgaaatagcaatgaaataattttatggttggggggggggtccccacaacatgaggaactttaataaagggtcacagcattaggaaagttgagaaccactgatttaggcagtgagaagaaaatttaaggtcaagttctgaaagatgaagcaagctctaagaactgagtcgtacgttgatgaggaaaaacataggaaaggcctgggaagcagtgggttggctcccacgaggcctgaattttaggaagaagaatgaaacagaagttgatcggtttttttttatagggaaggaaatctagcctttaatctgttaatctgcattggattaagatgttctaggatagcctggcagtggtggctcatgactttaatcccagcacttgggaggcagaggcaggcagatttttgagtttgaagccagcctggtctaaagagtgagtcctaggacagccagggagaaacctggctggttattaactgttcgtgcgtactaagctagatagcgtggtgtaggtaaaggcactcgatgtcaagcctgataacttgagctgaagagttgggtccctgagacccacatgatggagagcctgcagtcttgaaggttgttctctgacctccacaaacatgctatgacatgtatgtgccttcaaaaaaataaattaagttgaagaaagaggtagaacataagtctagaaaaattccacactgaggtgtcgacaaagagacgggatggatgtcgtaagtagacgtcattcaagtctatttcaagtctgagaaagagtaggcagaaaaagtttttaacaagaagctgtctgagaagtctctaataaaaaccacaaaactacaaattaaggaagctttatcagcatcaagcagaaaaatacaaagcaaacactagctattacactctactgtagcacttagcactgctgagtgctgttgtaggtctgtttcatcctagggaaacatgcacaannnnnnnnnnnnnnnnnnnntggcaaagtccaacgtggtgaaccaatgggttggtgtgcatttaattttaactatgtgtgagtgttttgccggcatgcacatctgggcaccacttgtgtgtttggtgcccatggaggctgaagagggcacccacaggaactggagttacagatgattacgagctgctatgtgggtcctgggcgtctaaagggagattctctagaagagcaactggtgctcttaaccattgagccatctttttagttccaaagaagtaaattttattggagtcacaagagtgtgggtgaaggattgcttacagaagcagaaatgacgcaaagatagctgcatcaccaaagcccaccccagcgtgggtggcagcttacaaaatctggaaacctgcagacagctcaacagattggaggatattttttctaggtagctcaattggttggtctctgcctcttgtaggcatctcttggcagtttatttatgctggggagggaggacccagtaaatctggtcagtttcagagacttcctgaagtctttgagtttcctttttatattttaataacttttatgtttttgttttagtttttttttttttttttttgaagtgctaactcaggaaggcctcccttgagatattcccgtttctgctttgcgtgtgaaggtcagcagacaacctatgggaattggttcttctctgtgagttctggaaatggaacttaggttgtcaggcttgagggcaagagctattacctgcagagcagtcttgtaggctctagatggccattctttggatattaagatgatcatatacatatgcatatgtacatatatgtataggtatagtgcatatattttcttatttgttgtctttagttagcagaacgggtttcattatgacattttctgtaggcataaattttttgcaacctacttataataagggtttgacctcttctctagcccaccaccaagcagaggtagtagaagagaaaagttatcaagatatgggggagggctggagagatggctcagtggttaagagccctgactgttcttccagaggtcctgagttcaattcccagcaaccacatggtggctcacaaccatctacaatggggtctgatgccctcttctagtgtgtctgaagagagcagtggtgagtaaataaaaaagatatgggggaagtggacctgttcagcaatagttctttgggggtgagctccatcctctttggcagcagctcagtcctgtagcaaacaccaaatatgactcagcagctgcagtccagccctctaggcaggcagacaccacgcatgaactagcagctgtagctcaatcctgaggaaactgtaaggttcaccaatcggcctgaggtgaggctgtgaaagcagcaagctgctacaggaacctcatgagcaattccttggcaagttttcctctggcatcaccagtagtggatatcaacaaccccatgtaagggaaaccaatacatgtgtgttgttagggaagaatagagaggcggagcttagtgctcatctcccactgtgtggggtctatatatacttcttcatcaagcgtcctttcacatgtttgctatatccaaacatcctttcagctgtgtctacttcaggaaaacattctctctgtatttgctccagcaaaacaccctttcacctgtgtgccccagcaaaccatcatttgacatagctgactttccagagaactagaagcttccacttaatcttcattctgtgtttttcttgtttaggccaattttgagagaggcattcatgatgcagttaggataatgtactctcactgctaaataatactctattgtagtaaatataccataatgtatgtgtctataatacacgtgtgtggtcatgaggatggcacccatgctctatgttgatatgtgggttgttccagtttttgggtttttgtttgtttgtttggttggttggttggtttttggttttttgagacagggtttctctgtatagccctggctgtcctggaactcactttgtagaccaggctggcttcgagctcagaaatccaccagcctctgccttctaagtgctgggattaaaggcgtgcaccatcactgcccggcaatgatctttctgcatacttctgttttgttttgttttccagacagggtttctctgtgtagccctggttgtcttggaactctctctgtagaccaggcaggccttaaaccccacagagattcagctacttctgcctcccaagtgctgaaactcaaggcgagttgagttcttccactgcccggcattctcacattcttgtatgtgtatcccagcacaattttctaggcatggaacttcatgttcatagtgtgcaattttttagagtttatatatttttaatttttttgtttcatttttttttgttttttatgagatagggtccccccgccccttctgtcctaaaactaactatgtagagcaggctggcctggaactcactgaaatgggcctgtcttgcccatttcatggggttaaagtgtaccaccatatccagctcacagtctagagactttccatctgacagacagtattgcttgccgagtggtttccaagttggttgtgtcagtttaggttgttctaggcagtatttgaatgtgccttttgtttcattttcttgcccttggttggcatagctagtgatttgtctgattgtgattgtagggttttcagtctagagtgaggagtgaggtgggcaccttcttgtgtctgttatcattgattccatcttttgtaaggatcctgttttaagtcttgatagcgtgtatattggaggctctttcttaatgacctgtaggtgctatttatctatcttgcatagatttgtttggatatatactccggatatgtatatgttggggtatcttctggcttgttaatgatgtcactgtttgtatgttgtccttcttttgtctttaatttttattttttagatagggttttcttacagtgcctgctgactgctgctgatgttcctacagcaatgccctaagtgctgggacttatagccctgtaccaacatgtccaactttcttgtacaacagaagttacttcttgttctttgtctctccccacttctgaagtcgtagaatttagttaatgttttcctttatggcttatggttttcatgattctttctaaggaaagccttttttaaatttaaatttaatttaatttaatttttaccatggtcatgaagctagtttccatgtactgtaaagctctctagacttgccctccccattcagtgccccattacagatattcggttattctgacaatttttttttatacatatgaggcttccttgatacaaatggacaatctgtgcacagtctgcctgtgtggtctctttctgaacttttgtctagtattgtctttttcagacacaggaaatactggtataaaaagcagagattagtcaataggaataaatacaaatcaccagtttttgtaagaaatagaagatggaccatttagaagtaaagattgttatgttgtatttatagtatagatttaattgctgactttggtggcacactgaggtaatcctggcacttgagagatgaaggcaaggaggatagaggatagcctctgctacaagagacctccaaacagcagaagcaggggctggagttagggcttagggttagaagcagaggctgctcaactggacctgggtctgattcccagcacccacatgttgactgtaactccagttccagtggacctgacttcctcttctggcctccatgggtaccagtcacacacactctgcacagacatacatgtaggcaaaacacccatacaggtaacataaaaacaaagtgattttttaaaaatccaaaaacaaacaagcaaaatctagttttaaaagaagcctacctacttaaaatataagatctcagaaaattggctggcaagatggctcagcgggtaagagcactgactgctcttccagaggtcctgagttcaaatcccagcaaccacatggtggcttacaaccacccataatgtgctctgatgccctcttctggtggcatctgaagacagttacagtgtacttatgtaaaataaataaataagggctggtgagatggctcagtgggtaagagcacccgactgctcttccgaaggtcaggagttcaaatcccagcaaccacatggtggctcacaaccatccataacgagatctgactccctcttctggagtgtctgaggacagctacagtgtacttataataaataaataaataaataaataaataaataaataaataaataaatctttaaaataaaataaataaataaataaatcttttttaaaaatctcagaaaatttgaaaataaaagatgggaaaaagaagcagaatctgagacttggggatttactgagtgtggtccagcaaagtgactcctaactggctcggactctactcctcggctctcttctggattctgcactcacatgaacatgctctataacatgcacaagttccaacccatgcacacacatacatgtaacttaagtaattcaggaagcacctatctttgtaggaggaccattagcacagaataattgcctatggcattgggttacagctcatttcttagcctcatgtatctttcatatttatgcagacagcacatattttatagctcataacaggaaagttgtccttaagattctgagtaacagtttttcttttccctttgttgcaggtggtgcggttgtgtcaaaacccaaagctggcgctcaagaacagcccgccttatatcttagacctgctgcctgacacctaccagcacctccgcactgtcttgtcaagatatgaggggaagatggagacgcttggagaaaatgagtatttcagggtgttcatggaaaatttgatgaagaaaactaagcagactatcagcctcttcaaggagggaaaagaaaggatgtatgaggagaattcccagcctaggtaatggagacatactacacaaatattaactcaggtctgtggctgtcagaatgggattgctagcaatagttgagctgctttgaattttattttaatgggaatagaaagctcacatttgatagaaagggtcttggtaagcagttgaccatcattgggtcaggtagatttatctgtgaaagaaagagtgatttacactcctgagaaaggttgcaggcagtagaccgtgaaatccctaaagataaccgacgtttgtgggtagatgagcatttgaaagaggctaagctgaggttgaggagaaaagatcaaatctctacagaagccgcagcagcttgataaatcacaagtgttagataagagtagaaaaagccagtgcttgattcctttttgtttttaagtgtatggtgtgtgtgtgtgtgtgtgtttgtgtgtaatatatgggtaaggattctttctctccaccatgtgggttttgagtcttgaactcagatcagcagccttggcagcaaatatctttacctgctgagctgttccttaaataaagcaaattgaactgatactctatagaggcacacccaccatgccttccctcccttgctgttggggatggacccagggcttcacacatgctccgtagctgccctatcatcaaatacagttagattacttggcctgttactagcttgcctgtgtaaacacctaccaggaaagaattaactagctcgtgggttctgtccaggtgaaatatggtgtaatatgtcaaggatttaatagagatatgtaatgtagttttgcctattggatggcatcagaagtgagacaggaaatgttaatctgaactagattttgaaggataagtaggaatagttgtatgtcagatatcctgcatatcagatatttacattaggactcacaacagtagcaaaattatagctactgagtagcaatgaaataattttttaatttaattttatttgcaattcattttttacagcaatgaaataattttatacttgggggttaccacaacatgaggaactatattaaagggtcacagcattaggaagttgagaaccactgatgtaggcagagaagtcagcctttaacatgctagaaagaacctgctgctgactgtgtgttcaaagaatgtgggaagtctggtttggctggagttacaggagttggatgaggggaagtacaagggagtcagagtgtaaggattgctttaactctagactgtctcttagatataaatcagtccctacaacagttcctacttttacaaaaaagggcacttaattatatatatattgggacttagttgggctcttgctctattgttttttcccttccccaagcaactgaaaatatatgcatgccactgtagccatttaagtatgtttaaattttttaaaatgcatttatttttatgtgtacgtgcaggtgcacatataagcatgcatggtgtagtgtgtctgtgtgtagattggagaacattgctggggttggttctctccttcccccaggtagattcccaggattaaactcaggtcaacaactaggcagcaagccatgaagcttcgtggcaagctctttcgttacccactgagccaacctggcagccctgagagcattttttataatgaaatggaagctgcattttcctttcttcttagagcatactgaacagtgcttggtatgcttactttaataactgtcttagagtttcattgctgtgcagagacatcatgaccacagcatatattttatgtaggaaaatatttaattggggctggcttacaggttcagaggtttagtccattactgttgtggtgggaagcatggcagcatgcaggcagcatggtgcaagagaaggagctgagagttctccattcaagttgtcaggctgaatgtaaatgctgcactggcctgacttgagcatttgagaattcaaagcccaccccccctagtgactctcttcctccaacaaagctacacccactctgacaaggccacacctcttaatagtgccactccctgtgagcctatgggggccattttctctcaaatcaccacaatgacttgagagccagtatagtatagtgactaagtagttaaactctaaagccaatttgtaggtttttaatcttttcttagccacttttttagctatgttatttctatttcctcatccagtggatgaaataataatgttttcattgtgggttgttgagagttctttcttctacatttttggagaaggttctcatgtatcccaggcaagccttgaattcaccacagagtggagaatgacttgaccatctctgatccttctgtctccgcctcctgagttctggagtcacaggcatgcagcctcacaccatgtccatgtggtgctggggatccagccaagggctcagtgcatgcaccctgcctaccaaggagccatatcctcaaccccagcttttattgtcttaattatggattttattatagagtcaacatagattattatattgggttgtatatcattaatacacaactctacatgaagcatataatttgacatggctaaaataagtagtttcatatgcatttgcaatgactaaatataaatgtatactatataacaaaagtatattaattgttcttatccaaattgaacaacttttgtaagtgagtacctttactgtttctattcattcctgtctcaattccaaaatatgagtcatgggcctctggtttatgttttgactgctacagagttctttggttttgttttcatctattctgtgtatgagtgttttgcctgcatgtactataggtatgcattgcccacaatggccagaagaggatgtgcactcgcctctggaactggagctacagatgtgagccaccatgtgttgggacttggacccatgtcctctggaaggacagccagtgctcttagccactgagccctctctccagccccagacttttaaaaagaaaattatacacatttgattcatacactacaaagctctgtgacgattacttgttcgttacataagctagaatcatctgtttggaatgagggaacctgagttaagaaaattgtctcaatcagctaggctggctctggagtattttcttgattaatgattgatgtgggaaggccctaccttctttggtcagtaccactcctaggcagatggtcctgaattgtttttgtttttgtttaaaaaaaaaaaacaaacaaaaaaactcaaaaaaacaaaaaagcaagctgagctagccagtaagcagcactcaccctggcctcttcagttcctgcctttgagtcctgtcctgacgtctctcagtgatggactgtaactgtgattcggaaccgttctattgtttcagcctttaatacattcgctcatgttgtggagaaccccctccccacacacaagcataaaattatttttgttgccattttataactgtaattttgctattgtcatgccttataatataaatatttttagagatagtggtttgtcaaaatggtcatgacccacaggttgagaactactggactatatataaactggaagataaaataaacattttacagagatcctcctgcttctggctcctaggtgctgggatcaagggtgtgtgccactgtgcctggcttttttcttttctttttcatcaccacagcagtagaaagcaaaacaggagagctcttttaaagtataccgtttggttgtatttataaagtcatacaactgccacaatttaactttggaacattttcagtgctccaaaagaaatcctatagccattagcagtcactttgtcaagcttgcttctagctcagtcactaatgtttattttctgtatctgtagattggactgatgaagacattttatataaaatacatttcgtataagtggagctgtataacgtgtatgaccatcacttactgtctgctttctttaattcagtgtggttttacaacttgtccatatttatagtatgtatccatactttccttttggggtggggagagaagctagctgagacaggtgcacactgtagcctgcattgttccagaacttgctatgcagcccaggttggtcttgagtgttcaagtcaagtcccccacagcctcattaaggactgggactgtaggtgtgagctcctatacctactactccattcatcttgatagttaatttcgatctgtttgaacattttgtttatagttatttgagtttagacattttagctattataagtattatttctatgaacacttgtgtacagatttttgcatgctattttcagttctctttgctacatcctgggaggggaattgctgagttatagagcaactagtttttaactttttgaggaagcttcagactgtttacacagaggcctctgtggcacgcactctgctagcagtggactaaggttctgagggctcaccagcacttgctacctgcagccattctccagggtggaaaacggtatctgggggttttcaagacatttccatagtgagtcatcttctcatgggcctgcggatctctgaagaaagacctagtcaaatcctttgcctttttttaaatttaaaatttagtttgcttttatttatgtatatgtgcatattatgtgtgctgtggagggagttgggttctcttgagctagagttctgaggcattgtgaggcatcttgatgtggctgaccaaactcaggtcctctgcatgaacaggaagtgccattaaccaaggagctcactctccggctccctgttctgttgttgttgttgttgtctttttttttttttttttttgagacatcctagaactaaatatgtagatgatggtgactttgaactcttgatcttcctgctctacctcctacctcccaagttgtacagttagaggcacgcaccactcttcccccaacctcccaagttactgtctttttgttgtttgcttgttttgagatggggtcttctatgtagaccaagctggcctgaatgctggaattaaaggtgtaagccaccacatgcctgaccttagctctttgtttttattgttttcagtactggaaacttcatggtttgtaggccttctgctcattttaaaattgtgtccaccttatcctattgaactgtaactattctttacataatctgcctactgaactagcatcctattatctatactgggagaagtgatttgtaaggtttcactctcattctgtatgtcttttcacctcaatactatcttctgtggtaacaaaatatttaagctttgatggagtctagtagtacttttgtacttttaagannnnnnnnnnnnnnnnnnnnaattcaaagccaactggacttcgaggacagactttgctacagagcccttgtctccaaactccctttcctccatattacctaattcaaggtttctctgagtaaaagacctggctgtcctggaactgtatctcatctaggctggccgcaaactcatagagattctcctgactctgccttctgagtgctggggtcaagggctgtgtgtggtgttgttttcccttgttttttcttattagttttagctcttgtgtttgtttggttatgagttcatatatttattgtaggttttcctttatgaagtaaaggtccagatccattcctggccttttctgatgctggcttcttaccaaagaacttccttactgcactgggtcagcagcacccttagttatagtctcagctttggtgaactatagagtaattgattagtcctgaatagaagctgaaaggggctggttacagagtggaactggatttaaaaaatggctcatattcattatagattatacttttctgttaagttattcttacctttttatgttatcaaatttttaattatcctgtataatttaggaaaattcagacttgactaaaagctcatctgctaagtactcagtagaagactaaggtagtgttgagtgctttgtggtagcacgtgtccaggaacaagttagagcagggttgatagaagctggttgactgaagaagcagccttttcttaataatttgcaaagcaaggttttgttttgtttttttaagacagggtcttactatatagaccttagctggcctggaattcacagagatctgcctgtttctgcctcctgagcattgagattaaacaagtgtgccaccacatctggctcaaagcacactcttgacattttcctccaaagaatggtgatactccacaaactggatcatgtttgcacacctatagtcctttcttagaacatgtttcttcagaacatgtgctaaatgctaccgatagataatgacagctatctcagtgtttaagagttagcttggtgagaaatgatttctagtcttacatggaacatttcttgcattttggagagggtaggaacatgtggctgtcttttcagtcgcagagagagatgatcatgagcggctgttagtggaaggaacagaagtgggcagaacctgttgttttaaagggagcacaccaggtctggtggcttggaccagtgtctgagtgggataaaggcatagaacagtggaagccactgaggtttcaaacaagggcatagcatgtgaccttgttggtattttacaatgacggtatcagttgctgtctgtaagacagataaaggtttgtggctgtggcagtaatggaagtagagaagggaggaggaagttgaaagaaaaacagataagaaatggattagagctaaaattagtaagaattgttgacacattgggaagtggagtgtagaaaaaaatgatggaagaactgaaaatggcttctagtttcattaactctgctgacaatgctatgttgattctagcagagaactcaggctgtaagtataggaagaagcaaagagtttcatttggggcatgtgtaagtttgataaatttgtttgtttggcttttttgagacagggtctcaatgtatgtagcatttgggtttggcctggaattcacagagacccacctgccttcgcctcccaagagctgggcttacactatcacatctggccaagatttgaaattttatgagccatttaaagagaagttaaataaacaattggcaatgtgattaggatttgggctcagagggacgacttagaataaagaaagaaactgggttcaggggtttttagtcttgagagcatccgggcgtggtggcgcacgcctttaatcccagtactcgggaggcagaggcaggcggatttctgagttccaaggccaacctggtctacagagtgagttccaggacagccagagaaaccctgtctcgaaaaacaaaaacaaaaaaaacaaaacaaacaaaaaaaagtcgtgagagcagttttatctgaaagaaggggctggagaaggggctcagtttgtcaaattcaatccccactatctatggaaagggccatggaaaagtcctagggctgggaggtgtagacatccagggcctaatgagagactgtctcaaaacataagatggatgagctgggcatcgtgttgagtgcctttaatcacaatactcaggagggagaggctctctgtaacctggaggccagtatgggctacacagtgagaccttgtctccaaaaaaggaaggagggaagggaagaggaaaggagaaggaaaaggaaaggaagggggaggtaaggaaaaagaaagaaagatggaccccaaggaacagcgcgggatttgaggttgatcacgcacaggtttaaagcatttatatgaacctagattcctagagagtaacttggccagaaagctcatgaaagataggtgtgtcagctggtagggaaatgtaaatcaaaaccacagtgaggcactacttcacacccactaggaagtgtatcatcagaaaaggaaagtaatagatactgctgaggaggtagagaactagaatcatgcgtcattaatggatatgaaaaactgcaaccatgtagaaaagtttggcatttcttcaaaacgttcaacagaattagcatatcatcttctagctttctaagacatatatttctagaactgtaagcaggaacttgatcagatatttgtatatccatgttcattgcagaagtgttcatgacaagcagacgtgggatacactccacatttatcagcagataaatggacaaacgaaatgttggtgtacagttgcagttgcctggtgtgtacccaagcttctgaattcagtaggcattcaccgagattctggagcatagcattcactgcaggactgccatagctaagttagggaacgagctgaggtgtccaacaacaggaaataacaaaagtgtgccatttgtacagtgaaaccttttcagccataaaggaaaatgaaattctgtcatttcaagaaaaatgaatgcaaatgaaggcagtattagtcataagtgagttaagccaatcacagaaagccatatgtatatcattgttttctcttgtttgtgatttctagatttttctatagtcaacataaagtcatgcacacagatattaagtgacaaagtaaaactgtctagggaagtggtggggactagtagggctgagaaaaaggagggtgtgagtatggggaggggatatgtttaacatattgtatagaactctaggaaaattaaatttgtattattctgtatgcacacacacctcagcagttggttctttcctaccttgtggggtccagaaatctgaggtcaaactcaggtcttgtgcacaggcatctctgtccaagccatctcactggccaggtaagtttcaatactcacctgtaagaaggggtagaatgcacatacaagctacagcacagattaattgtgaagacagtttgctgattgaaataagccagatctaaaaggacgttttatgattttacttatgaggtatttagactgtgcaaatttataaagacaggtataatagagtattgggaactaaaaggaggggagaggtggttactgctcaatggtcatatagccagaatagatgagttctagaaatggtagcattgaggcacgttcctgaaattctgctgtgctgagacaggaatatcactgcaggttcaaagccagtgtgtgctgcaaggctagggcctatcttaacaaaccaactattgccatcattgtagcacccacctgcagtctcagctctcaggaagaccagagacactgaaggtcattctctactggatggaaagttttagcccgccctgggatacatcataacatgatgctctgtctcaaaaagataaggatggggtatatggtcaaatgcatatatacaggtgtaaaatttatcaagagtaagcactattgaagaaaaagggaatgtaaataaatctggaaatggatagtggttatggttatatgatattgttgatgttgtgtgctagaaatggcttaagtgatcttaagaaaaaaatgcctttttaaaaaagcttgcatcactgttgcattgcgtaagtactttcctaaggttggccatattgcaacagaacttggtgttcttctcattgtgtcacacagaatgtctaaagaaacaaagcacttcactgtggatctaacaggagtaattattaaagacgtctgcttcaataaaggagattcagaaagtgtgtgtgtgtgtgtgtgtgtgtgtgtgtgtgtgtgtgtgtgtgtaatgtgtatgtgtgggtacaagtgccgtggctcatgtaatttgagtaagctgtaggcattgaacttgtgttgtcaaggtttaagacgagtacctttaatcactgagccatattgtaagactctgttaagggaattcttaaagtgcaagcaaacagtatttggttttattttaagtcatcataaagaatacagctgtgccaggcgtggtggcgcacgcctttaatcccagtgctcgggaggcaaagggcaggcggatttctgagttcgaggccagcctggtctacagagtgagttccaggacagccagggctacacagagaaaccctgtctcgaaaaacaaacaaacaaacaaaaaagaatacagctgtattttgactgcataaatagtttggtgtgttgtcttgattgtgtctggaattggcagtcttgtccactgtttcctgggccatgaatgcgaatgtcactagagtggaaaaaggcatgttgtgtgtaacattttacggaggtaattttagtatttcagactgtctgaaagggccctgagaactattgtattcatctatttctaaattaatttattataagtttgcacatacatgtcatgacacacatgtggaggtgagaagggcagcaccgatctgtctccttagcccgaagcttagctttgtaatagtgttaacattctgtgggagcttcctcgagtgctgttgagatgccagtttctgtcacacttgggaaagctcctgtcactgtttctgtctctcccatttctccttcaggagactgcttaatgttccattggccactacgactacatcgatcccctccccagtattttaatttagaaagtttctactactctcttcagcttactgttgttttctactaaagcactggttctcaacctgtgggtctccgccctttcacaagggtcacatatcagatatttacattatggatcataacactatcaaaattacaattatgaagtagcaagaaaataatcttaaggttgggagtttccacaacaggatgaactgtattaaagagtcacagcattaaggaggttgagaaccactgctctaaagtatttgctattaatctgcccatttaaattttcatttctgagactggagagatggcttagtggtttaagaagactggctgctctttgagagagccagggtttgattaccagcacacacatggtggctcacagctgcctgcaactctaatttcagggaacccagtatattcttctgggctctgaggacaccaggcctgcatatggtgcataggcatacatgcaggcgagatatccatatacataaagtaataaataaataaaaaggctcagtggtttatagtactagctgctcttccagagaccctgggttcagttctcagcacctgtaactctggtctcagaggatctggcacctttctctgatctctgcccaagacatacaagggcatacatggaggcaaaatactcatacacataaaaaaaagtaaataaaaggaaatttcagtgtcttactaaaaataatagaaattttcagcttttgaggtcgaatcgacttattttaaatttgtattattactgcatgtacataatctgaagacatgcttggacacttgagaaattggaggacagctttgtggagtcagcgttttccttctacctttacatgagagtgaacttgccaggctttcaccacaagtgtctttacttgctgagccatcgctccaggccctgggtttgaatcattttatatcttccaggtacttccatgcatttaactttttataacttccataaactccaaatgttgccccccttaaaaaaatttgatttattttatgtgcattggtattttgcctgtatgcatgtctgtatgaggatcccttggaactggagttacagacagtggtaagctgccatgtgggtgctgggaactgaacctgggttctctggaagaacagccagtgccctccttttcctcttcttccttctcctctttgtcttcttcatttcttttctctctctctctctctctctctctctctctctaagacagggtttctctgtgtagtcctggctgtcctggtactcactctgtagacctggctggccttgaactcagagatctacttgtctctgttgggattaaaggcatggggcactactgcctagctctctttattttcttttttgagtttttgtttgtttgggaggcagggcttttctacatagcctggaacctactatatagactagaccaggctgctttcaaactttgagggatctgcctgcctctgactcctgagtgctgagatgaaaggtgtgcagcaccaccacgagcaggcaacacctttgaaacgtctgattcaatattaaattacaaagactgggagaagttaaaacatgctctagtgggctttttaaaggcatgtcggctgaacacaagcatattcagctgtgtgttttaccataggaatgtgcagtcacataacagtcaagttccggtcaaggtacttctggttagaatacaggcttgatcaaagcaggtaggagagactctggagacactgttctgctcgcccaaatgccagtgatactttataaaaccagagcactatagagaatcgagcagcgaacgtcaagtagaatgtgccaaggctttctctactcactctgctctaattgtgccagctaagaattgctctgaactcgtaatgcctgtgaggtctacaactgcatttaaatgagagtgtgttaaagaagctggtcacagaaggcgcttgccagccaggaggtatacaaagccagcgaggctgccgctgcccgggatgcctactagcaggagagttagcagcagctccgcctaccttttcactcgtatttgccatgcaccgaatttgaaaaattttcagaacgcttaagtccaatgtattaaattactaaggaaattgaataaaaagctttcactggtggtttttctctcccttttctgttaactttgcctctatcgctgtatatgcaaaacagtcctccagcctagtgtctaacaacaagatgtatctggatggttgcaatttaagtatttagatttgtatcgttgtttttaatggtattttctctggttatttataggaaatagttaggtcttcagcagtctctgttaaagtggagcagataataatgaggccattctttttttcctgctcttaacttccataagcacgactaaatggcatcctagaaaaagcagccttccttcccttgctgtttgtgttgacagtagccttacttctcttgtcattaactttggcctagataaggctaagtaactatttaattgttagtcactgtattaggcgtctgtagatttatctcccagcaggccccatttcatacacagtttcagtcctttttactcaggaacacagtgacaggttagaaagacatgacccaaagagacaaggtgaaggcagtgtagaggaagatctggtgcctggcagggaagctggattgcccgaatgggagtcctctgccaggtacctagagtctgtggaggagggactcttccctctggtgtgtgggtgggtgaggggtggagcctttgagatacacaccctgggtcctagttagctaactgccaagtaacataggccatttaatcagattcaggacttagggtgagatagatggtggtgggctacatacaagggtaataatggactgacctgaagacagcacaaaaagatgaggaggtttttctctgctgtagtctgtctgtctgtaaagctcaagtgtccatgtggggctgggtatagctcagtggagagtgcttgcctagcacacataaagccttaggtttcatctgtcgttaaaaacaaaaacacaccagaagttcaagatcatctttggctacatagtgagttccaggccatcttgatgtagagataaatttcaaacaaacagacctacacatgaacctaaacaaccgtattcttgcacaaaacctaatttataattacatattttgtgatactgatgtatatgtttgtgtgtgtgtatgtgtgtgtgtgtgcacacgcatactaatgagatagaatgtttgccacataagcagtgaagatccaagtttgatttagcgcctgcataaacagccaggtatgacacctcatgtttgtcatcagaactaggaataccagtctagctgaattggctaggctagcgtaaggtcccaatgaaagaccctgtctcaaacacaaggtgaacagctcctggggagctaccctgtgattgacctttggcctccacacaaacacattcacacacacaaaatatatgtttttactatttaactagattagtgattaatagtcactttagctttactgagtttaggcagtgctaccaagctacctccactgtgcctatgagcattcagaaattgttaaaaagttgtattgatagataaaaataacgtttttaaaaatgaactttatgaatatgattatttttcttgcatgtatataagcataccatgtacatacagtgcccacaaagcccctgaagataacttttgttttgtttttcgggacagggtttctgagtgtaaccactcctggctgtcctggactcactttgtaaaaactaggctgacctgaactcatggagatctgtctgcctctgccttccaagtgctcaaaagcatgtgccgctattgctatgcctggctctgaagagaacacattcatgtttctttgtttcatatactaggattatgcaagtagtaaaatgaattacttttgtatttatgaacaaacttcatgcaagattaaaatagactggtgggtgctggaaagctggctcggtgattaggagtactagttgctcttctagaggacctgggttcattcctagcacccatattgtggctcacaaccacctgaaactctagtttcagaagatctgacaaacttttctggccttctcaggcactaagcgttcacgtggtatacagagatacataggcaaaacacccatatagaataaaaataaaatttaaaaattaaaataagcttttgcgggtaatattcagtacaaattcctttggaaaactgtcactagctaggtggtgtccctgcatgcttttaattccagcactccagaggcagaggcagacagatctctgagttcaaggccagcttgatctacagagtgaattccaggatagccagagctacacagagaaactcttatcttcaaccaaaccaaatcaaacctaaaaagacctgtgactggtgctatttggatctgcatgtgcacgcacacatgtaggggtgtgtgaaggatggtaagtgggtttagttactgtgtttaggagcattagctgttgctagcagtaccaacattgctttcctctcctgttatctcagtccaagtttacctgtgagttattgccatgttaacgtctttgagacctttcacagagagcacctttggatgtcgagtcttctctctattctaatactgatggctatgggcatgtcatttcttccttaattgtgttagtgtaatgcagtggtagtgatcgtccgctgttgaaattgactcttgccctgaacttgtccctgcctggttagattgtgtgttatgttgtgttttgtttgttgttactgtttttaatctattaaatggcattaaaaatctactataagttctggtacctaataagtcctttaaaagtattagattttttttttttttttttttttttgcttccaagcccttccaggggacctggaacccaacacccatgtttggctgctcacaactacttgtaactccagctcccagggttccaatgtccagtcctggttcttgtgggtaccaaaacatggtgtatactctcacatacatacacttaaattaaaaataaatataaagccgggtgtggttgcacacacctttaatcccagcactcaggaggcagaagcaggcggatttctgagttcgaggccagcctggtctacaaagtaagttccaggatagccagggctacacagaaaaaccctgtctcggaaaaaaaacaaaacaaaacacctaaataaataaataaatgaacttttatctggagaggtagtttaggagtactttcgtagtgtgccaagaggctgtgtctgtgagccccagcataggggaagatgtagttgttatgctgtctttccagttgcaaagtctcatttaggctaacctctccccagtcaagcttgagttctacagtgtcttatcttacctggttatactatactgagtcaactcactgcccaaatttgtgatttcctctttatatgcatatggctgtcatttgcagctttgaagcagaccctgcttcccctgtgtcaacctttaaggacaccctactgcatttgtgaaatcccttaatctcttagctttctgctttatccccgctgctgtgactgtgctgtgcatgaggtctgaccttttgctgcatgccactgcccagcccctccccaggctgctcaaatgaaccttttgctttacgtgaactcctttgtctgtagaaatcccatccattctttcaagtctagaaaacttcctaagttacataaaaaattataaagtgtatgtgtggtccgttactctaaattgatgagatggccttgatgatgaaaattctctggctttgattcattcccctagatttttagaatgatctaaaaattccacattctttcccaatctttggggacagaaaaacttggtagcagtagtgtgcttgttcagggaactcatgtgtttaaatagaaatggatgcttaatgtgctatgtactcaggagttaaataattaatcataactggatagactttttacatatttgattagattctattagaactgtctcccattgagtgtgattggttttgtctctgtatttttattttatgtttaagtgcatgccattcgtagccataaaagatgcttccttatttgtccttgtgaaaggagattctggaggtttatagaattagtcttaaggtggaggcagtgaaagtgcacggctttaatcccagcacgtgggaggcagaggcaggttggatctccgagtttaaggccatcctaagttccaggacagcagggctacccagagaaaccctgtcttaaaaaacaaagaaaccaaaaacaaaaagtagaagctggtacagagaagcggtaactgatactatgggctaataggctttcagctgcagacaagtcctgatctctaagagacacatagttcatgattcttgagttattttatgttttctagctacactgaaaaaaacaaaggtactaacctccaaaatgtgtgtcaatggtggctttgatttttgagatagggtcgttctatgcagcccatgatttcccctcctagcttcttgaattctgggattacaggtgtatactatgtaatctagcctatgctttaattcaaattgtaatattgttttaaaatttaagtgaatttgttgcaaaggaattaggaaaaaatagctacacagtgaagaggcatggtcaaaattactataattaagtgatcggagtgataccagcaagatactgtgacacgtgtcaagggcacccatttctgctttttttcatgaactcataatcctagttgtaaaaagaaacacgtgagtcagatgtgttgaaggcattgtacaaaaaaactgactagtgctctggagaacagctgtcatgaaaaaacagttaaagatcaagaaactaccacagcagattaaaaaaaagaacagtggcttatggtgtccagggttgggtgctgatttcttgggttggttggttcattgggggtacttgcccaaaagcctgtgccgtactgttgagtgttttaacaagtcatttacagatgggtaacctaatttagagataaagtaagatgtagatacagagaaagtgccacacactttgtttctgcccctgaagaattgtcttccaaatggtggaaggaagacagttctcacacagcaggtatgatagagccatgaaacatctaaacaagatgatacagtttgttcagaagggaagaatagatattaaatttggatgagtgacttttctctcccctacccgaggaggtaggatctgagaacattgaagaacaggcaacattccataatgatagtcattggaaggaaaaatatgtatcatagtagagctctccagctcttgaatcacatagatcagttctgacacttactaacaagctcatggaaggactagggcatggctcagtaatagagcaattatttttcatgtacaagcttctaggttagttagatctctagcattaaaagggaaaaagctgactatgaagagatacatgtactattgatgtactgccaccatgaaaggcatggggcttagaaagtagagagtattttgggagagcactgagtattgttcagaaaggtgaattaggttatgatggtattttttgttggttcatggccagagttacacgtgacaggaataaaggatctgtattttaagattcatttgggaactggagagatgtcttagtggttaagaacacttgctgctcttgggtaggaactaaattcagttcccataatcctcatgtagactaccagctatctgttacttcagttccaagggatcctgctcctcctcctggcttactctggcactgcatgtacatggcacacacacatgcatacaggcaaaacatttatatacataaagtaaaagtaaccaattctgctggcaccttagctcagttgtagaggacttgcctggtgcatacatacacacagttgattcagtgggagtacaaagtgtgaagcggctgttggagattcgtataggctgctgctgccttctctccttggttccttactactgttaccttacagtgggggtatcacataaattggaccatgagtatggtattatatatatcttttttgttttgcttttcaagacagggtttctcagtgtagccctggctgtcctagtactcactctgttgaccaggctggcctggaactcaaaaagatccatctgcctctgcctctcagtgctgagattaaaggagtgcaccaccacgcccaactgatatgatatatacttatggggggggtcattgatatgtttagatatattgattgaaaatccctttcatattttatattcatatgtatttctctgtgtgtatggatgggtttgggtatggttttgctatacagctcatacttgctgcttttgaagtagacatcttcctattttaacaagtgctggggtataacagatgtgtgccatgactctaagctctctcttttaaaagaacaacttcagtagataagagttagcatttcgtctgacttcctgttgagagacgtttcatggtgtgtatttttagttggttagtgtgctgagcagaggatgttgttactgagttatgattgttttcctcggtatgttcttcttggatgacactagtgttgcatgtaaaggttttggaatttgacagcgaaagaactacagtcaccacttgtgacagtacccatgcatgaaggacttccaggcactggtcacttcacttttaaagtccattacccttattgttaaggtagctttatatctaaatttatgtttataatactcaagacttcccatattttattaaggaaagcttctaattataagagcttaaaatttttacacttatttattttgtgttgtggggcaatgcttgtgacaactgttgtggaaggattagaggacaacttttggaggtgtttccactgtgtggcacagagcattatgtttggtgtcaagtgccttcatctgcagagtcatttttctggccccaatatcacaggcttttttcttgtttttttgtttgtttgttgcttttaaagataattttgtaattatatttacatacagaaaacttagcagtgtatatttaacccagtttagtgatgagttttttagcctttgccctttccagcttggcaatgggagccacagacttaggacccaggatattgcctccttagtagcggcggatctcatcatctgtcgttgtaattagacctaatagcttttactattgtcttccaagttaacctgtatgagggcaacagtagtgcacatcttcctgtggtccagtcacccagcctggcctttcccttgatgattcagtaagagacccccacctttcaacacagggcaggcaggaaaaccgccagctcaatgggctctgtgttgtggggagttactatcagctgagcattcttcttccccaccaaagtggtgactatattgacccctgctcagtctcttagttggggtgtcccccttgccagcagctttcttcttaccacaggcacagtagcctttgcttcttctcctattttgtctctggcttgtacttatgagcaagcttaagcagctggcaggaggtactttgagcaccatgtgagatctcttttggggtgagtgtcctccaagctccctgaacactgctacaagctcctttagcaccctttacccacgcccccattggtcccaagaaagcatttcttctaaacagcagttcctgattgtctgacattatctgtaccagnnnnnnnnnnnnnnnnnnnnnnnnnnnnnnnnnnnnnnnnnnnnnnnnncccccccacccaccccccagcgtttacacagaggtggccctaccgttcctgctacatgtccacccttttgtttttaggttttgacagcctagtaggaactggggtgccattgccttgacattgttgaccctaccacagaggattcccaatattctggactatgtatgtcttgggttgtcctgtcttccaggatcttacctgtcattgactaccagccctcaaagagctatcagtccggaggcatgacacacaagggacagcctacatggtggtctcatggatctttgccatccgtgctttgatcattttcttggggggagggggaacgcaatcaggactttcgagagccatcattggcacctggagggccaccttatttatggaacactgcctgcagatatgctgtgtgagacacttaaaataattattagtatgaccatttctcccatcatagcataagtagctatccacgaggggtcaaacagcctcttaattgtcccatacttttcccaagaatccggaatctaggaagagcacagataccctggtcgcattgaggtcgcatcatgcctaacatgatgccataggttagattaccatgaaagtccccgatggtcatattgtgtaaccacaatacaaaggccaacagaggtaaaggccatcagtggtaaagcagagaatttcctctgtgggccaggtgccttctattcgtcgtgtaggagtgactaagtccctgaggggcaaacccaaattcacactggaagagaaaaggccagggtaggccagggagttaactgctaacggcaaaagaatggacggcaagagcaccaaagcccagagctcctcggccctcccaggctgaagaaaaattaataaaaacagtatgtacattatttctctcagtcctggactacttctggctccttcatcgccccctggtctatggccggtaagcatatcaaaagtaatgctaaggttatattccaaattaatcctagcctgattctcagccaagtcatgatatgcagacctccaattaagaaacatggtggggttgagcactaccttaaggagattagaacaatcataataggtctggatacttgttcaaaataaggggaatctgggccagaatcgttggcagcttttctggtcagtgccaagtcggccagaggagtgggaatccagggcctaagtctccgcatcggggctcaaaggccttatgcctggacggtgtacccaggatggggaaggcgttcagaagccgaaccctggtaccaccacttgggagaccagcccctatgtcaggtaccaggataaatccagaccaaaagtgaaaatgagcaaagagagaaatgatagcctctgtatactcacctagacaaagacaaagaagaaagaaaaaatggccgctgcgcgctccccacagcaccgaaagacaaacaaaaagatggccgaagcatgctaaccctcgaaccaaacagagaccaaaagcaaggtcactgggacatacagatagagaagacaagacagaaatgaggtccatgcactcaccttcgagggacctacaacagggggccaactcaccgaagaagcagaccggggnnnnnnnnnnnnnnnnnnnnggtgggtgggtgggtgttgtgtgtctgtgtgtgtgtgcgcgcgcgcgcgcacatagcagcagcaccgcgagaagagcagatgaggccgaagcaccagcgcagtccttgcagcaacaggcacaaatgaggcccagaaaaggaggtacgagtagccagaaaacgaggatgatgaagtagtccatcaaccgtgctgggtgccagatgttgcctgtgccctggaccctcccctcccctacctgaacttggagtttgaatccacaacacagacaggaatgctctctccagcgcccccagtggtgccaagaaagcacctcttctaaatagcagttcctgataggccgacattgtctgcaccggcaatccagttagattttcctgtaggagatacctttgcggctgcacaggcctagcgtttctctagacgccgccattactactaaattttgaaccattttcagatgaatctaatttgaagtgattatggcagtttttttaagtgtcttacatttttagaaattataaatttttttaaagcatgctacttcttaggttctccggcttaggaaatccctaatgtgataacagaatagactcatttttctagcctcaggtaggatccatctaactatttatataaataacatatgacattagttcatttacattgttgacaggcaaaaaataatatgccttacaaataataaattttaagtgtgtgtgtacgtacacgtatgtgcctttgcataggcttggaggtctatctttaccttccacttgtttgagacagggtctctcttgtttgctactgctgggcaggaacctctgaggactctgctgtctccatcccctgttgccttagaagcagaggagcacctagattctgagattacaataatcgactagacttggctttttgtgggttctggggtttcaacttcaggtcctgctcttacacaaagtacatttcttgatgtagcttttggtcgtcagacatccaagtatataagcactggtgagcttttgtgtttcttcttcagtcttaggaaattcagattactttcccattttcaacttgaacagtatctatccacatcttgttatatatagatggggctatttgagcttcctttgatcatatctgatgtcagacccacagaggttaagtaattgcccagggacactgcactttgactgttactataaatgtgactgaacattcttgtcatctggaaatttatctcagcactgcagccctgactcttggtcactgtccactttgacagcttagagatcatcacattgcttcctgtggaggctcttcatctcacctcgcagccacctgttcttgagatttttagcatttctgagggaagaggcattcttactacttatctttgggcgggggaggggggacaaggtctcaccctggcagatcttgaattcatagagatccgcttgtctctgcctagtcagtatgtttttcttttttctttttgttgttggtgggggtaagggtgggggtgggggtaaaaaggttgggattcagggacagggtttctctgtgtagccctggctgtccttggagctctctgtagaccaggctggcctcagactcagagatccacttaccactgcctcccaaatgcagggattaaaggcgtgtacgctggccccatcgtggccttctctgaagagcatttattcttagcgttcttcatcctgttcctttgagacagactttacactgagtctggagtgaggctggtaacctgcaaacttcctgtctctgctcttcccacagcactagtgtgagctttgtgtaccatcatgtccagttttttacatgggatctggggatttgaactcaggtcctcatgcttacaagacaggtgcttttaacctgctgagccatctccttagctctgtattttcactttcaaagatcaaataggatctgcaattacccatttaatcctttaatgtacttttgttttattagcaagattccttattaggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggctgggtgtgtagttcagcagcacgatgttcccccttgcaggcacaaggccctggactggatccctagcactgacaaagcaaaactgattctgcacttagaatgagcagttgatcatgaggaagttgtgagaagtgaaggggggagagggggtggtaggtggggggggtgttagggtatcagagttgaaggctgtagagtcagtgtgctgttccttagatgtggatgctaaaagaagtacagaagggccctcccctaattctgctacagaaagactgtgttttttgcagctattgagagcttgcaatgaaaagttccgtctttagcatacatattgcagaagatgaagtggttgtgttctctgttggtctgaagaagagagagtgtgggaactgctaacctctgacaggactttgaccagtactgcccacttagccatacgcccagataagctgtcatgcttcgttgctctgtttccgtgttagattctgctaaaaataacactgtagacactgaaccacaagtccaaaaccttaaagtgttattgggcaaaattccagatcagaactcttagaaaactctgacccgtgggattttagagacttactgtttcctcttgagaagtatggttgtggtatacagctggtggttttaagaaatgtctactggcttgggggagaagggctgcatttttgagtaggaaaatgtcttaaattgattttgaataaatattttagtcagcgctttgaactaatcttcaggtagctgatgccattacatccttgtggtcgatagctttcctcatcttgtggctgacttcatagatttataaaagctttctgttcattattattttggtatgcatttttgtttctgattgtacgtagtactatacctggtagatttttagtggaaaaataatttggagagcagaagataccaacttgataatgtctttattgttccctcaggtttagcttgaaggtcaccatctagagaggcctttgagacctaccacttctgttgaacagactacacataattttttaaaaataaaataaaaataaaattgatcatgagagcatgcacctttaattccagcactctggagtcagagggacgcagatctctaaggccagcctggcctacagaacaagatccagggcatgcagggctacacagagaaaccgtctcaagaaatttttgttcaaatctaataaaaatgattttttttttagaattgttagattggatctgcataggactaaagtagcaaagaatttgtattagaataataacacgattcaaggagaactgacaacatattatcttcaaagttgacaaagcaaatatgagagtaaggaaatggaagaagccaaaatgtttgagtttgtgggacataagagttgcatgccatcattaaatacagcataggggtgtgaagaaagagcagattagagaaggaacattaatctgatggttttgttcaagtgttgctgttggtggtgaagtaaggtgaacagttagaaacctagcaagccccaaataagggatttgtagagcatggagatattttatgtttttcaaagatgtgtgtgcgtgtgtgcgcatgcacgtgtgggtaccaacagagctaaagacactggatttccttaactggaatgacaggtggttgtaaactgtcagatgtgggtgttgggattcaaactctctgcaagaacagtgtgtgctcctaatctcctaactgctgagccatctcatcagcccttttcaaggtagttttcaaagtcttgttatcaaagaaagagaagagattgtagaaaatgagaaatagcagaaaagcaaatacgtgggaatatctcaaagggttttgacagttttcacgaagtctggtatagtgaatattatatttgttaggtctgtagatttaaatagttattgataatgcttttgtcttgaatgaactactttatattttttaatctaaaaaatgtttctgccgggcgtggtggcacacgcctttaatcccagcgctggggaggcagaggcaggcggatttctgagttcgaggccagcctggtctacaaagtgagctccaggacagccagagctatgcagagaaaccctgtctcgaaaaaccaaaaaaaaaaaaaaaaaaaaaaaaaaagtttctgcagagaggaaatcctacatggatattgcctttctattcttttttttaaagatctttatttatttattatatgtaagtacactgtagctgtcttcagacactccagaaaagggagtcatatctcattacagatggttgtgagccaccatgtggttgctgggatttgaactcaggacctcttggaagagcagccagtgctcttaactgctgagcgatctctccagccctgcctttctattctgattgtgtggttgtggctgtgcaaagtttttatgtttgcttggtgcatcctctaactgtctccctaaaagtaaatatagccctgtcagcgtaagctcagagagttgactgtggggtttcttcttatttgctgtgtgacatttgattggagagagatgtaagacattatttccatctttcatttgttgctagagaaaaataattcttgaagccctccccgctttacataaagagcagtagctatctagtgtcaaaaacacagtcctccttctcctagtttagagtatttctgagtattattgaccagaaattattgaccaaaataaatttattttcatgttcatattaggttccttttacggtgaattcagtgcactaaagaaatatcagtaattttacattttaattattgtactttgctcatttgtaggcgaaacctgaccaaattatccctgatcttcagccacatgctggcagaactgaaaggcatctttccgagcggactcttccaaggagacactttccggattactaaagctgatgctgccgaattttggagaaaagcttttggtgaaaagtaagtctctaagtgatgaaccttaactatgagaagctaaaactcatattaggagatacttgtttagaattttaaattatgaactatttaaaacacagtggggggctggtaagatggctcagcaggtaagaacactgactgcccttccaaaggtcctgagttcaaatcccagcaaccacatggtagctcacaaccacccgtaatgagatctggtgccctcttctggtgaatctgaagtcagctacagtgtacttgtgtatattaataaataaatctttgggcggaagtaagcagggactgagcgagtggagttgaccagagggagtggggccgctggagtgagcagggttgaccggagcgagcagacatcctaaaaaattaaattcccaacaaccacatgaaggctcacaaccatctgtacagctacagtgcactcacatacattaaataaatttttttttttaaagcaaaaacacagtgggttagcaagatggctcaggaggtcaagcatttgccacataagccccacagctgtgtctgatccccagcccatgtaaagacggaaggagagaactgactccatagagctgactctgaaatctacgtgtgcaccttggcacttgcagtctgcactcacatataaatacacaccaccatcaccagtaacaatgaatttttaattattattatttattattattatttgttgttgctgttattcaagacagggtttctctatgtaacagctcaggctttctcaactcattttgtagaccagactggcctcaaatttacagaaatctgactctgctccagagtgctaggattaaaggcatgcaccaccacacccagctaacaaaaaaaaaaaaaaaaaaaaaggccagggacgatggtgcgtgaccgtggtccctgtactgagaattaactagccttagcaacgtgagaccccctctcaaaaaataaataaataaaaatatgactgccagatggtggtggcgtgtacctttaatcccagcactcaggaggcagaggcaggctgcagagtgagctccaggacaaccaggctatacagagagaccctttctcaagcaaaccttggaaacaaaacagaccgtggacaggatttggggaagctgtgcagcgttgacttcctagatttgctagggacacttgtttctcccatctctttgagatagtgtttctctgtgtagccctggctgtcctggaactcattctgtagaccaggctggtctcgaactcagaaatccgcctgcctctgcctccgagtgctgggatcaaagatgtgtgtcaccatacccagctttctccggtctttttattttaacctcttcattgattctttgtgaatttcacagcatgcatcccagtcccactcattgtccagcttctttgtttcctccttacctccccctccaaaagaaaaaaaatctcattgtgtgtgtcacagtgtgtcacacagtatattctttggttccttgcaagtgttcattggtctggttcaaggctcctggcctctgctccactattaacactggatccttaacactgctcctctcgtccatcctagtgctgccctgtgctacggagatcctgtagctctggatagacaggaatgggtgccctcatgtgctccagcaggtcatagatggggtggatgttggggtgagccatctcaaagccctgagcatgggtggtagctgagctgatcaggccttcagcttccctgcacacatgcacaccactagggctagctatctcccttagtgctacagctgacaaggggtagggccagcttacccacccccacgacattatggccatctctactgtgctacccagacaaggtaccgagtctactcttcagagtgctgcagttgagggatgggggtgggagcccagtcaagctcatggttggtgcttttgctatcagggccagctcctgtgctgcccaggtgaggtgcagggccccctctcctgagtgttacagggccagctgtctcattcactctcgtgacctcctgctgttgactgctgaaaagctgcaggtaggggaatctggccttcattactctgtatgctcaaaagaggagaggcagagccagcttttccactcccctcagggctgactcagcctcaccccctccaccaaggccagctctactgtgctacccagacatggtactacagctagtgagaggtttggctagctctgcatagcccttggacatcaatgaggtcccaggcaacagcccaaagtaggaatagctgcatgcttttggtggtaatatgagccatggacattgacacagacccttgctgctgcatggccacagacccagacatggctctcagcatcagtatgtgctggcacttcaccatggcctcaggtggcagggcaggctactcacatcaggctgttcctctccacccctgacccttccaccccacgtcctcccctaccccttatctccaatacggcctctatttttagtgctctagcgcttctgcttctctttctctcccatctttccacaccataattgcacattgtagtggctccagctgtggaccccacgtggtgggcaggcgtctggatgtcctgctttctccagtctttaaacaaatacaacttcagtttagatagtccgtgttctttgattgaatattcttccttttctctccctgtctatcctgttaatgagcatttacatttcaaattatgggcttaaaatttttttactctttgtatatgtctgtgtttatacctgtgaatgcagtgtctgcagaggccaggaagggtgtcagatctcttggagctagagttacaagtggttggtcgtgagttgctagatgtgggttctgtgacttgaacttgtgtcttatgggagagtagtacctgatattaccactgagccaactctttcgccctataaattatttactgttgcaaacagtgagcagggtcataattatttttgtaagctagaatctctccttagttatatagctaagaatattattggtaaattgtggagttttacctgcccctcccactgagtattgcataattgctttgtatgagtttatattcttcctttttggtgctttacaagacagggtttctctgtgtgaggttacgggctggcctggaacttgctctgtagaccaggctggcctggaactcagagatttgttctgcacagcacttgcctagaatccatgcccaaagttcagtctttagcagggggaaaaatagtactaataaaaaaatgttaatgctgagcaaggcatggtagttcacacctataactccagcacttggaaatctgtttgaggccaggcagcaacacaaaagttcctggtcagcttttttgccctccaaaacactaatgtctggctaaaattataaagattatactgctggtctgacatacataaggccctggttcagttcccaacactacaaaaataaaattaaaagtctattacgcaaaataagaactggtgtgattttcaaagctcagataaagccaggtaggatggcgcaccttagttctagcacttgggagggagggacaggtggatctttctgacttctaggctagccaagcctacgtagagggacttcttctcctgaggaaaatttagtgtagtggtctgcacctctcctctcagcatggtgaagctgagaaggaggatggaaagttaaggctgaccagggtctcgatggtaaaactgataaaacaaggcatgacctcatctttctcctgtacttctagggtggaacaaatgctgtaggaagatgaaaaagggatcaatatgtgatagttttggccaggaaactgtagaaagccatctctgttactcattaggaagtcagcagacatcctttacttccttctttctgttcttagtctaaatataacttggcttctgtgagagaattgctgttaatattgggagcctaatgtgtcttgcttggtgtcatttgatgatggtagtgtctgcagttgcctgttctcaccgtgccttttcacccatccctcccaggacgatagtcccgtggaagagctttcgacaggccctgcatgaagtgcatcccatcagttctgggctggaggccatggctctgaagtccactattgatctgacctgcaatgattatatttctgtctttgaatttgatatttttacacggctgtttcaggtatgattctaaagtcattgactaacctgctatttttctaaggagaaagctctttttaaaaaaagataaaagttgaatatggtggcttgcaattataatcctaccacttagggagttgaggcaggacgattgctgagttcaaggccagcctaggctatagagtgagttagaggcaagctgacagcacctgctgctctttcagaggaccctggttcagttcccatagtgactgtaactctagttctaggtgagacaatggccctgttctcagctgtgggcatcctgcgtacatgtactactcatacatacttgcaggcaaaatattcctagacataaaataaattacacacacacacacacacacacacacacataatatctcaaaactcactagacatgatagcacgtttcctgtaatagcagaccaggggaagctgaggtaagagaataaaaggtcatgactagcctgaaccacaaggtaagttccaagcctagccagatatgtgtgtgcatgcgtgtacacacagtcagacatctcaaacaaaacaaaattttaaatggctatataatcttttgtcttgtgtctttttggttgttcttgaatatcctctcacattattttaatgtcatagaactgacagaaagggatatagtttatccctttggggtaggcaagtggtggcagaaatagagagtctattaaaaacaagggaaggggagaggagggaatagagactgtagttgggaagtaatatatgagagaagagtaaacaaaaaaggaaaaaaaaagaaaatatagaggagcaaaagtttcatgccaattaagagaatcatccctaccttggctatttaaatttatgtagtgatcctttttttgagaaccaaaatccttgagaaggtgctctgtgttgagaagagaccctgtgcccatgttctcctggataaaacccatatgcaaatacaaatgtcatccaataagtttgagagatactttttaagaagattaagaagaaaagaaagataaggaaggcattcccaagagttggaaaggtgctgggctcaaagcctatccttttattcctttgatgtgtgtgtccaacttgtttttctgttgttcaactctttctctcttttttgggggcttggagagggggacaaaatcgtatgtagcccagagtagactcaagtttgttatatatccaaggttagccttgaacttctgacccatctgtttctacctccagagtgttgggattacaatatgtaccaccatacttggctccctgttgcattctagattgttaaccctaaaatgcattggtatttcaatgtatgtgtgtcagcttgaataaacattcattcattaaggacttaataattgcatatatagaccctattctgtttttctgggttttattattatttgactttaatactggttagaattgctgagtaaatttttgtgtgtgtcatcttctccctataaaggcagtttgtattcttagctctcaatgtttctactctcccaaatagatttgtcttcccataggtgacaatagagaatttggaacaaacctgaattcgtaattgagagttgagggcttttttctttttgttattcattgttctgaggctgagtgtatgtgtacactgaatggtctgtgatgaatgttttctttctctagccctggtcctctttgctcagaaattggaacagccttgctgtaactcaccctggttacatggctttcctgacatacgatgaagtgaaagcgcgcctgcagaagttcatccacaaacctggcaggtcagtgagcttgcaggtctcctgctggctttcatgacgctcttaggagttgaaggaacgtgatcatgttggttccccaggagcccagatttagggataggattgatctgtccgaggacttgacttaatcaaatcctgtgatttagtaaatgtttttaagccaatctggaatggggtttatgctggtccttgggagtcccagtgtgtaggagcttggaaggctgaaacaggaagatggtttgagaccaccctgaaatatatcacagaaccctatgtctaaaattagaacaatgaggttaaatgtcttttgtttctgctctgagatcattagagaagttgattttcttttaattggagattgaagccatgcctgtagcatactaagtcctcactctccctaagctatgcaccaggcccttgaaaagtcagtttcagttcttttcaagttagcaacagagaaaggactttgattattacatttttatacattgttttcatttgtattcatcctttccccctataggagctattcttaatggtctttttgattttgtctctatcctgccttctattgaataccagcatatatattgaaacttctggtcatctctgttctcagttacatctttcggctgagctgtactcgtttgggtcagtgggctattgggtatgttactgccgatgggaacattctgcagacaatcccacacaataaaccgctcttccaagcactgattgatggcttcagggaaggcttgtgagtattgctgctttctgttttctctcagaatctaggaactggaggacttcactacctctttgttagtggcttctagtgcatggttcttctgcaggtgacattttaggaatgtattaacatgccaccttgctttgtccttgaggttgaagcagctttgctcatttgaggggttctctaggtatgagattaactttctttgttgttctagttattactacaaatatactttacctctttttccagataacttagttctaaagccaaattagaattaaaaactatgcaaggatcaggacatattcagctgcttatttaagtagtcaatgtgagagtaattagatgttccaatgacagcagaccttggttgccttcaacctagttttattctggtttagcaggtttttttcaagccttgggcttttgtgatatatgctaatatttatggctaagttctcactcctgaattatcattcctatgggaattcaaattcattttcagtcaataaacactgaaaatactgctgtgggtatcaaaaaatgagctgtgttctaaagtgacaggaaaattggttttctattatgtatcatctctacattggggcaagaaaacattctgctcctaatactggagcagtttgatgccagaaactacttagagatatcccctggcttcatttgcttcctattacaacacttgtaaattggtgtcacgtgaagttgttagtcaaaagcaaatggaagtcaggggcatggcggcatgcaccatagtcccagcactccaagaactggatggactaagtggattgtgagtttgaagccagcctaggctacataatgaggccctcccttagtaatcaaaaacaatatatttatttatggctattcattgaaaatacaggctgacaaactaacccatctgctagttgtttgatataacctgcttgccaaggtgatagttgtttgagatagggtctcagtttaggctggcctaaaactcatgtgaacctgactggcctccagctcagagatctgcctgcctctgcttcccaaatgctgggattaaaggtgtgtgatactatacctggcttcttgttgttgctgtttctgtgtatgttttgcttgtatgcatgcctaaataggcaccacttgtgtgcctattatctgaggagaccagaagagggcatcagaatcctggaactggaattacagttgtaagcctccattagggtgctggtaatcagacttggatcctcttgactgtnnnnnnnnnnnnnnnnnnnntacacagtgagaccctgtcttaaaaataaaaacaaaagcaaacaaacaaacaacaacccctccccccatcctctggaatagcagccagtgctcttaaccaaagagttaccccttcagacccttgttacttatttttaaaatgtcatagttctcacttatctgttttagtttgtactgataaattagcctttgtctcttaaaagctatttgtttcctgatggacgaaatcaaaatcctgacctgacaggtttatgtgaaccaactcctcaagatcatatcaaagtaacccaggtgcgttttgttttataactattactggagccagacttttggatagacttgatgacctctattatagagtctaagtaattgcagcagctagattttaaaccactgactagtaagagagtgtgtatgtatgtgtgtgtgggggggggggggttgtattgcatgtgcatgtggaagccccaagtcaacatcgggtatctatctgttagtcactcttcctcaagctcttttgaaatggttcttcctgaacccagagccgactgattggcttgggtgctggccgtcaagcctctgggatccctttgtctttgtcttctagcagtggtgttacaggtgtgtaccaccacacctggctctaggtggggtctggggatctgaactcaggtcctcatgcttacacaacaagcagtttttctcctgtctgtgccatgtcttaagcacctattgtggcacttgtatttgaataaattgacagtttttggttctcctgttgctagcattctgttgcttattcaacatgttctctctcatttttctttcaccaaaggaacaatatgaattatactgtgaaatgggctccacatttcaactgtgtaagatatgtgctgagaatgataaggatgtgaagattgagccctgtggacacctcatgtgcacatcctgcctcacgtcgtggcaggtatggatgtccaaacgctgcattgtttctatgtatcattctgactttatagatagaaaggatgggataagtttagcctttttaaatccccttctatttttgcttgctttctcccattttaatttttcaaggtagtgcctcatttaactactgctggcttccaaatcaagaatttgacctcaaattcttgttccttctgctttgatctcccaaatgatggcattacatgggtgggacatggtacctgactttcctccttttctagattttttttaacgatttatttatttaatttatattagtactctatataagagtcttaagaagtcatcacatctcactatagatggttgtgagctaccctgtggttgctgggaattgaacttatgagctctaagagccatctcttcagcccccttttctagctctttttctggattccaaggcatgctgagtacacacattacctctgagctatatcctcatcaactgtactttaacctctggaaactgtatcttctagtaggtaagtatgttaagcactttcagaagtatctgtcactgtcatctgcttcttctgcaggaatcagaaggtcagggctgtcctttttgccgatgtgaaatcaaaggtactgagcccatcgtggtggatccgtttgaccccagaggcagtggcagcctattaaggcaaggagcagaaggtgctccttccccaaattacgacgatgatgatgatgaacgagctgatgattctctcttcatgatgaaggagttggcaggtgccaaggtaagggggcactggagatacagcttggtattagagtgatgtcttgttcagcatttctattactgtgataaaacattgacggaaagcacggtgaggagaaaagggtttttatagcttgtagttcatcatctaggggagtcagggcaggaactcaaggcagtacctggaggtaggaacagatgcacaggtcatagaagagtgctgcatacttcttagcctgtgagagagagagagagagagagagagagagagagagagagagagagaggagagagagagaggagagagagagaaaagagggagaggagagggagaagagaagaggttatacggacaaggctggcatgtttttattctcctgaatgctaagatgaaagatgtgtcccaccatacatacctggcctcagcctgcttttgtataggtccacctgcctgaggatcacactcacccacccacaaggggctaggaacttccaaatcaaccaaccaacccaccaggtcatccagccaactagtaaggtgctcttcaggcttgtgtataggccagttttatgaggcattttctcagttgaggttcccttctctcagatgattcagcttgtgtcaagctgacaaaaaactagtcagcctaagtgatttcctagcatgtgtaaggccctaggtaagagccttagccttgctaatcaattaattaattaattaatttttggccatatccttaaagctgaatttgtgactggacatatgcttacttgctgttctttctgagggtgaaacttccaggacttttatggaatacaactttaaagtttttaaatgaagacttacaaggcgtgcattatcctgaagcttaggtctcactgtagggtgtcatgtgggaccaggaatcacagataagactcttggggaccgaagagcttgctttcttctctttttctattttttaagattttacgtatgagtattttacctataagtatatctgtgcaacatgtgtatgcctggtccccatgggcatcaaagaggacattaaattccctagaactggagttatgggtcgttgttagccaccatgtggtggctgggaattgaatctgggtcttccgcaagaacaagtgctctttaccactgagcgaagtctctagtcctagtagctttggtcaggaagacagtgtaggtgcaggtaaaacactgtttagcacagggagacagtggatgttgtttcaatggctgcgtatatgtttcttaaatattacgtgtatttggtaaaaggaaagaaatgaaggcttggtggcatgtgcctttaatcccagcactccagaggcagaggcagaagcaggtagatctctgagttccagtccagcctgctctacagagtgagttccaggacagccaaagctacacagagaaactcttggatctgtagccattgtagaagttacaaaactaaagtcttcattgccacttggttatctctggtgatctgaatgaaaatggcttatgcatttgaatacttgctccctagttggtggagggattaggaggtggggccttgttagaggaaatgtgtctctgggagtaggctttggggttgtcaaaagtgggtatcattctcagctttctctgcctggttgtgagctctcagttgttgcctcagcaccatgcctgctgccatattccctgccatgatggccatggactcaaaccctctgcagcagtgagccccaaattaaatgctttcttttttctttctttctttttttttttttgtttttgtttttggagacagggtttctctgtgtagccctggctgtcctggaactcactctgtagaccaggctggcctcaaactcagaaatccgcctgcttctgcctcctgagtgctgggattaatgacgtgcgccacctcgcccggctaattaaatgctttcttatgagttgccttggtgttggtgttttgtcacagcaatagaacagtgactaaggtatcaccccacagctcatttggtctttcttaagggatatcgagtttccaggctgaaacatgttaatgtattgtgcaagtctgtccacaggttgaatttgtagcagaactgtggggtaaatgatgtggtgtttgcacttatgagggctgttgtgataaagggtatggttgtaggcactagggaggcctcctgcacagagacacatacacatttaaagataaactcaggccaagcctaggctacactgaaaggttttctttaaaaataaaacctttgttagtacagaggaaaataactgagagaaggtatgtataagaataccacaaagattgtagtatttcaatttctttagtgagtgacagataggtagtatttttgttattctttgtaactttcagtttattttgaattaacttttagaaggtattaaaatcacaccttagaggtgtacgaaatcacaaggttgcctgtttttcatactctggtggttgtcatttgttgtgtgtgtgtggttttctgagctgcaccttgaattgatccaactcctctgaccactttgtggtcacctgcactcaaatacagatttctacacatagacacatatacatattaaaagcagtaaaaataaatcttaaaaaatctctataaaaaggtgaagtggtaatcctttttgggctttgatgtatttttatcagaagtttagtgtgctggctagatttataccagcttgatacaaactatagtcatctgagaaggggaaaccttgactgaaaaaaagcctccatagatcaggctatgggccagcctgtagggcattttcataattggtgattgaagtgaggggccagcccatcatgagtggtaccatccttgggctggtggtactggactttataagagagcaggttgaacaggccttgtggaataagccagtaagcagctgtcctcctcagcctcgacatcatccattcctacctccaggttcctgtccagtttgagttcctgtcctgacttccttcagtgatgagcagtgatgtcgaagtataagctgaataaacccttttttcccaagtgtgattttcctggtgtttcttcacagtagtagtaaccttaactaggacaagtggctagttctaggattctagttacaaacatcccgctgagggagctggagaagtgctcagggacgtaaggactctgggtgctctgtgctcttccaaaggacttgcattccaggcctggtgtccttgtgaagtggcttacagccacctacactgtaactctagctcaaaaggatctggtaccctcctctgacctctgtggcctcctgcactcggtttgcatttattcacacacacacatacagagacaggcagacagacagactcactctctctctctccctctctctctctctctaaaaaatgaaataaaaatttttttcagctcttctctagttcaccagagcttcctggacttctgggtctgaggctttgctctttcatatccttgctctcccgctgggaatcatggtgcttacttttcttgttttttatctagttttcatgtttgccctgcccttggtttcttagaaaagtgaaggctatcacagtgcccagctcgagaagcctattattaaagtcagcttaaaagagaagcagtagatttgaaggtttttagaggagatcaagtgctggactagacactggtggctacagagaatatctatcttttgtccttaaatttaattatctattattatttgtgtatgtattttagtgcatgactgtatgtgtgtatgtgtgtgtggggggggggggagagggtgctatggcattgctgtggtggtcagaagacagttctgtggaatcagttctctcctccagggctcgagctcagactgccaggcttgcagagcaagcatgtttacctagcttcttgacagtgtcctcttttcctccaaagatgaagagacagagtattgtagtgattttaaaattgtaaggtgggttctttgtggtacaactgcctttctatgaatctgccaatagtctgcctccatgattgacagtgcctgcttatggtgattacagacatagtccagggtttcaaaactatctgagtttttagagctctatggcacccagcacctatggtcacatagtatctgctgtctgtaactttgggattgaaagatgctcttccctaaacaagagtaacccattaacatctcgtcggttctaggtggaaaggccttcctctccattctccatggccccacaagcttcccttcctccagtgccaccaagacttgaccttctacagcagcgagcacctgttcctgccagcacttcagttctggggactgcttccaaggcaaagcattaaccatttctgcactttgctcagcctctgttgtcttagtggttttgattgacttgtttccatcttgttttcataggctgcttctggctcccttcataaagacaaaccattgccaatacctcccacacttcgagatcttccaccaccaccccctccagaccggccttactctgttggagcagaaacaaggcctcagagacgccctctgccttgtacaccaggcgattgtccatctagagacaaactgccccctgtcccttctagccgcccaggggactcgtggttgtctcggccaatccctaaagtaccagtagctactccaaaccctggtgatccttggaatgggagagaattgaccaatcggcactcgcttccattctcattgccctcacaaatggaacccagagcagatgtccctaggcttggaagcacatttagtctggatacctctatggtgagtcctaaattttaaaatatttagcctagtagtatttgtgagtggtattttatggtccatagtgttttgttagactgggcgtagtggtacacacccttcttcccagcacttgggaggcagagcaattggatctctgagtccaaggcaacttggtctacaaagtgagtcctaggacagccagggctgtagagaaaccctgtcttggaaaaaataaagtgttttgttggagtggttttggtctctaccataggctagcttcaaattcttgatctttttgcctctgcttcctaagtaactgagattacaagtatgcactactgtgccttgttttgggtcaaaattatttgataggttttaatatagagttcagatagcattaattcttaactcataagaagtgtgtaaactaagggctgatgagaaggctcggtttgatccctagaagaagtagaaagaagtgaattggaaggaggtctaaggaacatccaagaagccaagcacacacctgcaatcctagtacttgggagacagaggcaggtgggtctctaagttcaagaccatccttgtcaatgtaataagttctaggccagttcaggttaccctctgtctcagaaagaaagaggatggggagaggggagaaagaaaagtaaggaaacacccaagagctgatacccagcaggtagacatggtggtgagcctgacggtgcgagtgtggttcctccacacctaggtactagcaggagagaagagaaccctgaaagttattgtgtgacttttacacatacatacatacacactaaatcaatggctttttgttttgtttttgttttttttttaagagacaagggggctggagaggtggctcagcaggtaagagcacttgctgctcctgcaggaggcctgggtttggttcccagcacccacgtggtattctccaactccctgtaactccagttcttggagatccagtgcccttttctgacctctgaggggacatggtacacatgtacatgcaaggaaaacagtcatacacgttaaagacatctggtctctcgtaaactgatgatttgaacctggctaacagataccaatctgatgggtgaattgacaaggaagttagaaatctaagaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttattttaattgcatgtagttgggtgttctacctgaatatatgcctatgtgccatatgcaggcagtgcccatggagatacaccagaagaggtaatcaaatcacctggaaatggacttccagatagttgtgagctgctgagtgggtgctgggaattgaacccaggtcctctggaacagcaccagtgctcttaaccactgagctatctctccagccctgcaggaagtggagtgagaattatgtagtatgtgctgcaacagcaagatctctgaagtaggggcccagggatgtggtcagtctagcatgtgcaagatcctgggtttgatccctgcactgcccccccccctccacccaaataaaatgcattaagagtcagaagtctaggatcttctctaggatgctagcaaccagattactttttatcttgtttagattcttctggtaggaaatattgaagagaaaaggcagttacactttttttttaagatttatttatctattttatgtatgtgagtacactatagctgtcttcagacacataccagaagagggcattagatcccattacagatggttgtgagccaccatgtggttgctgggaattgaactcaggacctctggaagaacagtcagtgctcttaaccactgagccatctctccagcccccactactattattattattatactattgacaaactatatactttactaccattaggaaatttcatattgggatttgctatatatttctagtattctagcgccttttacaaggagctttatattaaaacttacttacaagttgagtatacttcccatttcagttgttttgttttgttttgtttttttccgagatagggtttctctgtgtagccctggctgtcctggaactcactttgtagaccaggctggccttgaactcagaaatctgcctgcctctgcctcccaagtgctgggattaaaggcgtgcgccaccactgcccggctcccattccagttttaacatttggatgagataaaaatagaatttgagttggtgcttgttttcctaaatgcttgccatggtctgtggaatgatagtaccttaggtgttttttggtttttgtttgtttgtttgtttgtttgtttgttttgtcaaattgagctgtttcaattctaactctgtttcatacttgaaagttttccggcttaattattttcttcatctatttttaaaaactcttccaggcctcttcctatgccaaaactgccacctggggagcaaggggaaagtgaagaggacacggaatatatgactcccacatctaggcctgtaggggttcagaagccagagcccaaacggccattagaggcaacccagagttcacggtatgctcacagcaaccctatttggagccaagtgtctttgctgtcttttacctgcttgtttgctaattgccagaagtaaagcagaaagagaaatctagaccccagtacattggatctaatgtggataagcagttgtgttgtttccacagtggcacaggcctctagaacatgcacatctgatcttgtcatgagtcagtcatggtaggtataaagagaatgtgttattttgaaagaattagggcctaagacagttagaaacaggtgagtcgtcttaaatttgcaaataacagaattttgtttgtgaagagcattgtacctctttgtgattcagagcatgtgactgtgaccagcagatcgacagctgtacctatgaagcgatgtataacatccagtcccaagcactgtctgtagcagaaaacagcgcctctggtaagtggcctgtcttctacttaaaaattgacttatgtggtagcacctgtctgtaaaatgtcagtacttgggcttgtgaggcaaaaggattgcaagtttgaggccagcttggcctgcatagcaaataccctgtctgggaagagagggagaccgtagggttgctctgtaacatttggttgatatagcttaaaccgaggagaaaagtattctcagtactcttgttcagaggtctttgatttgtggacaagatggacccacttgtctttccagacactcagtcctgtttttccctcctctcagggcctggagacatctgttatatggctattacatagagatagctgttctatctcagtattagcagctttcttgtagttacattacattgatgaaactcttttgtgtgggggtggtaggtactcagttcccaagttaagcagcttgccaaggggaaagttcaagaagccttcacgcacagcctttgactgatcttcttaggtgagatgcagagaaggctctaaaatagctctcgggactcttgcttcagtagttattaaccacagcagaggtgactgttgacatgctcaacaagagagagagctggtacaggcttaactcacctctctccacaggacctcaaatggtatttcatccacagtggacatttgagtaactgttgaatgaaataaatggttgtgtgcatgtgtgaataatggctgcctctggattgaagtgtgttggaaagtgatgtcaggagaggacagtaacttacaccagctttctactaggggaagggaatctggccacagctcacacgagtactggccccgaggaatccgaaaacgaggatgatggctatgatgtgcctaagccacctgtgccagctgtactggcccgccggaccctgtctgacatctccaatgccagctcctcctttggctggttgtctttggatggtgaccctacaagtgagtctccaggctgtcttagctagtcctggattgttgtctggcctctggtttataactgaaagtcatgactttgtctcgtgtcaataagtcagtgagtagaagtagtggactgtgtcctggatctatatgttggaaagctggtcctaggtcctacattaggaagtgacactctgaagatggtgcttaaaccacagctctgcctatagaggaggcggggcttctagttcttctgagtatgcacgtaatgctggaaattaggcttgatggaagcaatgttatgtttggtttttctaagccctgttccactggggaagaaatgtgctgccctccaatacacagtttatgggcctgggccagccccatcggtctctagtatccagggctgttcttatacctatgactgcctggtagggcagcagccagaatagctgtcactttggaaattgaagacaactttcaaaacagctgagggaaaagatctaccatcttgttgcccctctaggtagcatctccacccagtccagcttcctgcttcctctttacagtttaagctgttgtcttgttatttgtagaagtagtgagtgtttgaacctattgctaagtataacacccagtgtaggtgttatatgcttttcacagtcacagttgttgttaacagcatgggtgcatggcatatttagaaggtcctttactctgtaataggagtctaaatctaaaacccagaggccaacagcagaatacttaacctatcatgtgtatagccctgggtttagttctagcacctcaggttgataaaacccagacttatgccaggcatggtgtttcatagttgtaatctctgcacttgggagaatgaagcaggagctcagctgtgagtttgagttccatctgggttttagagtgaacccttgtttcaaaatgaacaaaaaacagagccccagtcttgagacagaaaagcacactattagcactattagtaactactgttactgctgttaaatgtgagcttcccaagatttgcacatgttttctttcctttctcttttagacttcaatgagggttcccaagttcctgagcggccccccaaaccattccctcggagaatcaactcagaacgaaaagccagtagctatcaacaaggcggaggtgccactgctaaccctgtggccacagcaccctcaccgcagctctcaagtgagattgaacgcctcatgagtcagggctattcctaccaggacattcagaaagctttggtcattgcccacaacaacattgagatggctaaaaacatcctccgggaatttgtttctatttcttctcctgctcacgtagccacctagcacatctctccctgccacggcttcagaggacccatgagccaggctcttactcaaggaccacctaggaaagcagtggcttcttttgggacgtcacagtaaggtcctgcctttcctgtggggatcgacacatatggttccaagatttcaaagcagtggaatgaaaatggagcagctgatgtgtttcattgttgtattggtcttaagagtgtttttgtagtcctgcagtctccagtaggagagagtgggtttttattaaatggtaacctaccccagaaacagcacaggaagcagtagcagtgctgtgctgtggccctaattaaggacttaaggctttcctgttaagggtgtgtgtctctgttgtctgtgtgtcctgtcattataagattatcctgctgtgtgtgaatccaggcagggagttagcacaagagcttcaggaaggaatctctgaagactcccatctactgtggaattgcacctagccctgctggatactgtaacctcaatcctcccctttggcttagattatcatgtacttagctatgttttatattgttagaacaaccaatgtcctttcccttggaaactccttacttcacctcctcctcattggtgttctgtaggcttgccgtgaccagtcttactgaaaccaagcagcttataggatggtctttctaatgcgtgatggtgttggtttgtttggtagactaagtgggaaggaaagtactgttctgtggctaattgatgctagcacctaacactggtcactccaaagtgctgtttctataggaatgttgaatttgtttttgtttttgttttttaaagaagttttaattctcctagttacctaatgaccgatttgagatagaggccttcatatacattccgtgtcctccccaggacatagcctgtgggagtcggttgccttgatgccaggtgtatgtttctgatgtaggtcatgagtgtttctgcctaacaggaacagaacatttgtttccagggtggctttccaacccaaaaccatagagcttttaggaagcgtcagtcatatatagatttacaaaataaacagctaggacttatctgtttagtctttcttgccagtggctaacttcagcttaggaatttctcccttgaatgggagccaggtaagcctttcagaaatgatttcttcttttgccctgtgaggaacggagctaacaccagtgaggacagcatttgctgatggcttctctagattggtgcacccagtgacttggttgtccatgtgcctagcttgtgctttggaatggtttctctttccttttccttgccttttttattgggtcctagatgtaaccgctgtgtcatccatctacagtatttagttatcattcattggaattctttagctagacggtttggaacagtgtaatagtttgtgtatttacaggttcatcaaggagatgtaatttgttttggagagtccgtttctacgtcatcgtagtgacctcttgggttcagtttgttctctgactggagtcttgctggcttctctgacagcgttgccctttctcctgttgagtacgagctggcttttacatgaatcctctctgttctttaggtccaggcagaaatgacccaccaagaatctgctttctttccagtcttttgcaacaaaaatcttttgaactcttcttttagtttcttgatgcttcaaggtctggattttatcctcttaccttaaggctattcgaaaggcagatacggtatctatggctacccagtgtcttctctacatagcaatgagtagaaaacaatagcttgtcatccacaaaaagtttgtgatatctaattttgtgttcatttgaatactgaaagcctaagccaggcttggtggcatctcagcacctgagagatggtggcaagatgatcaggagttcagcaccagctcaaagctcctgaaaccctgtctcaaaaataacaggggttaaagagatgacttcagttcagagcagctcttcttgcaaaggacctaggtttggttcctagcacccacatgaaaggtttctcagatgtataagcaactcacaaccatctataacttcagttcagagcaatctgatgccctcttctggcttctgtgggcaccaggcacacatacgatgtacatatatacaggcaggtagagcattaaataaatacatatgaaaaaattaaaaaatgaaaattaaaggccttaaaagaaaagtagggaaaagctgcaggctctagtctgtttatattggagtgtctttttcccttttagctattgcccagaatctgaagatgtatcaaggaaacagcactggctgcaggccttttgccttctttgtgcatctgtcttgtgtggaggctaaggagatagctcaattggttgagtgtttgtctggcattcacagagccatggttcagcccccactctgcacagaagagtgtgctaaggcacacctctgatccttagcactcgagaggtagagactgcattagaaggtcaaggcactcctggtttaaaactagcccgggctacatgaaaccctgcctccaaaagaaaacaaaaaccaaatctgtggggattactgcccataatacttagggaaatgacagttttgtcctgctgtctgctgaggtgtgagctctggaatgggtgtggatagggtaggtgggtattgagtccctaggctgattgacttgggtgttagtttatcagatgtatacctgcaggtgttaaggttcaaggccattgtgtgtaggcctttcctttgctccaggacacactgaggccgtgcctggtattattagatgtccttaggaaggcttcatgccactcattttggatagtctccaaattttgaatttctttttcctgtgagggcaaatttcctatttttcatcttccatctgtatggcaagtcttaactctttggctcgtcctctgagtttacctaaacctgcc

SEQ ID NO: 86 - DNA, 1783 bp, Mus musculus
caccaccaccaccaccacctcatcccgcaccctccctgcacggtggacaagtaagatggtggagaagtgctggaagctcatggacaaggtggtgcggttgtgtcaaaacccaaagctggcgctcaagaacagcccgccttatatcttagacctgctgcctgacacctaccagcacctccgcactgtcttgtcaagatatgaggggaagatggagacgcttggagaaaatgagtatttcagggtgttcatggaaaatttgatgaagaaaactaagcagactatcagcctcttcaaggagggaaaagaaaggatgtatgaggagaattcccagcctaggcgaaacctgaccaaattatccctgatcttcagccacatgctggcagaactgaaaggcatctttccgagcggactcttccaaggagacactttccggattactaaagctgatgctgccgaattttggagaaaagcttttggtgaaaagacgatagtcccgtggaagagctttcgacaggccctgcatgaagtgcatcccatcagttctgggctggaggccatggctctgaagtccactattgatctgacctgcaatgattatatttctgtctttgaatttgatatttttacacggctgtttcagccctggtcctctttgctcagaaattggaacagccttgctgtaactcaccctggttacatggctttcctgacatacgatgaagtgaaagcgcgcctgcagaagttcatccacaaacctggcagttacatctttcggctgagctgtactcgtttgggtcagtgggctattgggtatgttactgccgatgggaacattctgcagacaatcccacacaataaaccgctcttccaagcactgattgatggcttcagggaaggcttctatttgtttcctgatggacgaaatcaaaatcctgacctgacaggtttatgtgaaccaactcctcaagatcatatcaaagtaacccagatatgtgctgagaatgataaggatgtgaagattgagccctgtggacacctcatgtgcacatcctgcctcacgtcgtggcaggaatcagaaggtcagggctgtcctttttgccgatgtgaaatcaaaggtactgagcccatcgtggtggatccgtttgaccccagaggcagtggcagcctattaaggcaaggagcagaaggtgctccttccccaaattacgacgatgatgatgatgaacgagctgatgattctctcttcatgatgaaggagttggcaggtgccaaggtggaaaggccttcctctccattctccatggccccacaagcttcccttcctccagtgccaccaagacttgaccttctacagcagcgagcacctgttcctgccagcacttcagttctggggactgcttccaaggctgcttctggctcccttcataaagacaaaccattgccaatacctcccacacttcgagatcttccaccaccaccccctccagaccggccttactctgttggagcagaaacaaggcctcagagacgccctctgccttgtacaccaggcgattgtccatctagagacaaactgccccctgtcccttctagccgcccaggggactcgtggttgtctcggccaatccctaaagtaccagtagctactccaaaccctggtgatccttggaatgggagagaattgaccaatcggcactcgcttccattctcattgccctcacaaatggaacccagagcagatgtccctaggcttggaagcacatttagtctggatacctctatg

SEQ ID NO: 87 - protein, 594 aa, Mus musculus
TTTTTTSSRTLPARWTSKMVEKCWKLMDKVVRLCQNPKLALKNSPPYILDLLPDTYQHLRTVLSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQICAENDKDVKIEPCGHLMCTSCLTSWQESEGQGCPFCRCEIKGTEPIVVDPFDPRGSGSLLRQGAEGAPSPNYDDDDDERADDSLFMMKELAGAKVERPSSPFSMAPQASLPPVPPRLDLLQQRAPVPASTSVLGTASKAASGSLHKDKPLPIPPTLRDLPPPPPPDRPYSVGAETRPQRRPLPCTPGDCPSRDKLPPVPSSRPGDSWLSRPIPKVPVATPNPGDPWNGRELTNRHSLPFSLPSQMEPRADVPRLGSTFSLDTSM

SEQ ID NO: 88 - DNA, 43454 bp, Homo sapiens
  misc_feature (1)...(43454): n = A,T,C or G
cgaatgacctccttcctcagcactgtgttactgggttagtagaaaagccagtactgctcgctgctgctggaactgaaggaaggaaagttctgtcttcagggtatttacaaaaagttgaacagttgtgttcctttgtggatctttggagaatcgttagaactcactgtgtgagttaaggtaactgctgacagaattttttcaagtattgcttaccatgtaaactcaaatgtctgtatcatacctcattctttttacatgttaagacagattattctgctgattaaattctgccccatatactgtagacactgaaccataagcttcagattggttacaaaatgctctgacccatgggacttttgtaaattcattatttccttttaagaagtatgatgcttacagtggatatctctggtggttttaagaaatgtaagcaggctttttggagggatgcattctggagtaggaaaatgtcttaaattgatttcccgtaacagtttcagtcagcactttgaactgctcttaggtacctggtgccattacatctttgtggtcaataactttttgtttgtgtggcttacttcacaaaataaaaatgctttctgtgtcctgttattttggtatgcatattttatctttgatccaacatagtgctaggtacctggtagattttcggtagaaaattattttaagagccaaagataaccagcatggtccagttattccaagacccactccctgtattcacttcagactcagcttaaaaagcaacactcgataaggtctctgagactaccctccctaaacagcaatcctgcatggcttctcatactctgtgttattcttcctcacagcacttttctcctaccatctgataacactctcgtgggaatgtacatgtcataaaagcaagaattttattttgttcattgccatattcaccccgagcctagcacatagtaggcactcaaatgttttctgaaggtatattgatcattagaaatttttgccgttcgcttggcccagagggatataaatacaagtcagaaatagatttagccattgtgtacacaaatagctatagtcaaaatgggttcagatgatgtaagagaactgcagagaaaacactgggattgttgagcattttattatgtctagctggctcctaaagaaatgacatttaaactgggtcttatttcagaccagagaaacaggcaaaggccgagaaacaaagaagagaggcaggtgtaagaaaaggtgaagtacttggtttggctagaacatactagtgaagaactaagaagttagttagaaagataggttagatccaggtcaatggcaaagccttaacaatccaagctgagtttggattttatcccattggctgtgaaaattgattgtttattttttcccttcttcaaaaggcagttaaatgtcataagaattggatctgcatagaaagagacactgaagaccaaggctggaattttaattttaattttaattttaattatcaccaaggagtttgcattaggccaataccacataaatagaaggtaggaatgaccacagattggcaacaaattgactagtcagatatggagaacaaggtaaatgaaagaagctaagaagattcttcaggttttgaacttgtgggaagtaagatggtgttgtcattaaatacagaagtaaagtacatgaagaaagagcagatttaagaaagattagtttaattctgaacatgttgctttgaggtgctagcattcgagtggaggaaatgtggtagagtagatagttggaaaaactaccaaggcctaagatttgggcattgtttgctaagtagtttttaaagccctgagattgcaaaggaacaggagagagtacacggagaaagaactgaaaatagcagagagcagattcttgggaaataccgcttaagacgatgggggagaaaagccaagaaagaacaaaaggaagtaggagaaccaagagaagacaacactgcaaaacccaaggcaagatcgtgttcaggaagaagtagaattcaaacctgtttgcttcagaaagagctctggtataacctcagaagtgtgacacggattttttctatcatctcattcattatcctgctatactgttcagcgtagttcttcacacacatagtaggttctcaataatctagtttagggactactacttgacagaatgttatgtagatgtagatgtctgagccacaggctgctgattgtgcagtctagggtcctgcggaacactggaaagtaaatacattgggattaacttgtgctttgtagggtttctttcacgttacctatttcatattccatttgtgatatattcttgatcttgtctattttctctttggtacatggtagaaattctattaaacaataatcaaaggatctcaaggtgctaggaaaaaaacagttaatggactttaaagattggataagtgcttttttttttttttttttggaccgagtctcactctgtcgtccaggctggagtgcagtggtgcaatctcagctcactgcaacctctgcctcagcctcttcagtagctgggattaaaggcatgtaccaccatgcccgcctaatttttgtatttttagtagaaatggccaggctagtctcaaactcctgacctcaagtgatgcatccgcctcgacctccgaaaattttgggattacaggcgtgaaccaccgcacccggccaaaaaaagatttcaatagcatttttcgaacaagtcatggatataaagacttggataatttggtgctgcattttatccacgaaagacaaagatagcactgatggtgaccttccagtatagcattaaaaaagaaaaatctgttcctaatagaggattgttaggcagtcagtaattgatcacgatttgacttgaaattttatagtacatttatgccgggcgcggtggctcacgcttgtaatcccagcactttgggaggccgaggcaggcagatcacgaggtcaggagatcaagaccatcctggctaacacggtgaaaccccatctctgctaaaaataacaaaaaaattagctgggcatggtggcgggcgcctgtagtcccagctactcgggaggcagaggcaggagaatggcgtgaacccgggaggcggagcttgcagtgagccgagatcgcgccactgcactccagcccaggcgacagagcgagactccgtctcaaaataaataaataaataaagtacatttatatgacaagaataaacttttgaatacataaatacaaattattgggtcaaaggaaaatagacacgtattcagtagcttgtttagtgtaatagtatctatatcatctgtatcctgtttctgtggcacatagcattaaagagaacaaaggtaatctgatcaaaggacacatggaaaagtagagactacatctggtatgttaaatggtactgtgtgacatctttttttttttttttttttttgaggtggagtttcgctctgttgcccaggctggagtgcagtgacacaaactcagctcactgcaacctctgcctcctgggttcaagggattctcctgcctcagctctcccaagtagctgaggttacaggtgcgcaccaccatggtcagctaatttttgtatttttagtagagacggggtttcaccatgttggccgagctggtcatgaactcctgacctcaagtgatccgcccacctcagcctcccaaagtgctgggattacaggcgtgagccaccacgcccggcctattacctctgttttataggtgaaggaccttaagcctagagaggtcaaatgactttccaggactgcaaagttaataaatgacaatgtggggctttgtcttacagcaaaacccatgcttttaacaggaaattctgggatgtacttcctgctctctgccaattacctacttgtaaattctgcctaaaatttgcatnnnnnnnnnnnnnnnnnnnntgcaatctcagctcactgcaacctctgcctcagcctcttcagtagctgggattaaaggcatgtaccaccatgcccgcctaatttttgtatttttagtagaaatggccaggctagtctcaaactcctgacctcaagtgatgcatccgcctcgacctccgaaaattttgggattacaggcgtgagccaccgcgcccggccatttttatattttttagtagagacagggtttcgccacgttggccaggctggtcttgaactcctgactgcaagtgatcgcccactttggcgtcctatagtgctgggattacaggcgtgaggcaccactctcggcctgtgtgatatctttataaccatatccattaaacaggttgtgagaacaaaattaagtaattgttaacagtagcatatgcacttatgtagaaatttttgtgtggtttggatgttagcatctcatttttggtaaaggaagaggagtttgggtaaaatttatctctttaaggtctggttcagtgaaagaaagcatttattaggtctggatacttaaaaattcttttaattaagacttatttatcttttatttagatatgttatatgatgataaatatacttgataaatacacctgcaaagcaggaaataatacattggtttcctaacattttttcttccgtgatagagtgattatagcagtgcataagttcttacacttatttgttgaattctcttacctgtcatcctaaaaaagtaaatttgtccatgttcatgcttagctattaagctttattaattcaagattaaaagctttaagatatatgactaaattttttctcttgtttacttcataatatctatttgaatggaggagatacaagtggaggcagtgaatgcaacagtatttcttcattgtgtttgtatctttcatatgatcttacagcaaaaagtttctaaaacccttctttaaataaagaacaagatcactgaatatgtaacatcctcaacagcgcatttcttttctcttctctacttttttatatccttgaataatactggccagaaagaatatttgaagaggttctttctaaatgtattttaatattcatgttaattatacatcttgtatggtgaatttggtgcatttaaaataaaaataattttatgtgtttaattattgcattctgatcatttgtaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagtaagtctcagaataatgaatttgaactatgaaaaactaaagcttacgagttttttctttacttttttactaatgaaatatttaaaatttgggaactctgagaaaagtaatatatgtgtatgtatttcctggctttggttaaatattaagtttttgctctgttcattgtttttaaaaaatagttttgcagattaaattgaaacccatgctctttgaatactcttccctttctctccccatccattgtggtttctttttgagacggagtcttgctctgttgcccaggctggagtgcagtggtgcgatctccacttactgcaagctctgcctcctgggttcatgccattctcctgcctcagcctcctgagtcgctgggactataggtgcctgccaccacgcccggctaattttttgcatttttaatagagacagggtttcaccacgtcagccaggatggtctcgacttctgacctcgtgatccacctgcttcggcatcccaaagtgctgggattacaggcgtgagccaccatgcccagccccattctgctcttaatggacatgtacatttcacattatttgctatcagcagtgagcaatatctaagttgtcttcatatgcaagaaattgtctttatttacatacgcaggagtggaattgctaagtcttggggttttacatcttttgctttgctaagtattgtccaatttctttccaaaatggtgtaccagttcatattttacagtagccccacagtttggctaacgctggcgatgtgaattggtgtaatattttgctttatattccctgatgagaagggagattgagcttcttctcacctttatgaccagtcaagattcttattcttacttgcctgttcctatttctgatttacccattttcttattgagtggtttatctttctgttattataggttactagttctttgttagatacttacattacaaatatcttctcccagtctgtggcttaccttttccgttttgctgtattgtctctctatatattatataggttgatttatgcatcaagcttgtatttttaagtataaatataaatatcctaggttttgtcgttttatttattttttttttttgagacaggatgtcactctcttgcctagtctggtgtgcagtggtacaatcaatcatagctcatcgcagcctcaaactcttggattcaagcagttctcccaagtagctgggactacacgtgtgtgctgccaggcccagctaatttgcagagacaggattttgctgtgttacccaggctggtctcgaagtcctggcctcaaataatctttccccctggcctctcaaagtactaggattacaagcgtgagccactgtgttaggcccaagtttctctttaaaggccttcatttttggccaggcacagtggctcactcctgtagtcccagcactttaggtggccaaggcaggaggatttcttgaggccagaagtttgagactactaccctggatgacattacaagacctggtctttatttgtaaattattttttatttttcttttctttttttgcagcaaggtttcactctgttgcccaggctgtagtgcagtggcacgatctcacttgcaacctctgcctccaaagttcaagtgattttcccacctcagcctccagagtagctggaactaattagtctggctaattttgtttgtttgtttgtttttgtagagacaaagtttcaccatattgcccagtctgggctcaagcagtctgcccactttggcctctcaaagtgctgggcctcccaaaggcatgcaccgtggctcctggtccccttctttcttttcttaaagaagttgacctgtattttgaattacgagaattgaaattggtattgagagcttaatgtggctctccttcctttccttgattatggcgatgcctggaattatctctgttatttcactttatgcctcctctccaccccctccccaggacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcaggtaggacactaaaaaagttgactaaactggttactgctacttcggtgaagagaaagctttttttttttttttttaaataacatttggggtttttgtctgtatgaaagtattttaattcattttaggaactatgccaaaaaaaagattaaaactatctcatattaaaaatatatgtatgtgtgtgtatgtatatatagtgaaaatgacagctataccaactgctttcttctcctcacatctttccttgttattgaatattcttcttttgtatcattttaatgtttgtagaatggccagaatatgaatatattagttttctgatattggatatttgtgtatgtttgcaactgtttctcctgttttattgaaattgactgttaatattgagatgtttagatgcttcaaaaacaactcctttctttttctctaaaaataatgctttctctggtgttgtctgtgccaatttgcatacacatttatttggaacttattagttgcacctataggccctatcctggttttcagtttgttgttgttcaaccccactactgttaattagagctgctttacaaattctagaattttcattttgtgtcaagtttctccctataagcatatattcttttcttcgtagcttttcagagtttttaatctcctgaacacatgtgtcttctctctgagtgatggtataattaaaaatttctgacaatgaactgagagttggtgttgttttttttttttctcattgccctctgagttggttgtacatctgacctgaatagtctgtgattgatcttgtttctttagccctggtcctctttgctcaggaattggaacagccttgctgtaactcatcctggctacatggcttttttgacgtatgacgaagtgaaagctcggctccagaaattcattcacaaacctggcaggtcagttcaatgacgcaaagagatttattcttctgaatttcgttatcttgagacttctgctagtatagaagaaacatgaccttaattagtttcgcaatagccaaggttctgcaataggattgatacctgtttatcagacgtattgacttaattcagatcctataatttgataaatgttttcaggccacttaagaattgaatttatggccgggcacagtggctcacgcctgtcatcccagcactttgggaggccgaggcgggcagatcacgaggtcaggagtttgagaccagcctggccaaagtggtaaaaccctgtctctactaaaaatacaaaaattatccaggtgtggtgcgggtgcctgtaatcccagctactcaggaggctgaggcaggagaatcacttgaacctgggaggtggaggttgcagtgagccgagatcatgtcattgcactctagcctgggcaataagagcgaaaccccatctcaaaaacaacaaaaacaaaaaaagaatagagtttatgtgtcttttgcttctggtgtggagtcatggaagaagttactctctttttaaaaatattttctttcttttttcttgtcactgacttgaagctcagaagtagttattcttggctgggtgtggtggctcacacctgtaatcccagcactttgggaggccaaggtgggcagatacttgagatcagaagtttaagactggcctggccaacatggcgaaaccccatctctactaaaaatacaaaaattagccaggtgtggtggcacatactgtagtcccagctactcaggaggctgaggcaggagaatcatttgaacccaggaggtggaggctgcagtgagctgagattgtgccactgcactctagcctgggtgacagagccagactccatcttaaaaaaagaaagaaagaaaggaagaaagttattgttattcttgatggttcttttgatttttgtctgtatcttgccttgccttccaccctaataccagcataatctactaaagcttctgtttatgtctgttcatagttatatcttccggctgagctgtactcgtctgggtcagtgggctattgggtatgttactgctgatgggaacattctccagacaatccctcacaataaacctctcttccaagcactgattgatggcttcagggaaggcttgtgagtacctactgcataccatctgttagagtctgggaacttaggggctgtccaacctcatcattaatgactttattccaggtttcttaaactgcagactaagattcaggaaaatattaacagatgatattgatttgaccttcaggtcctggaagacttttgtttttcttttttagggattccatgagtgaaattattctctaccacttcagttattaccataaataaactttatctttcttttttccaaatgttaacttattttcaagcctgtgttaggttttaaaatataccaattagcaggaaatttgaccagttatttaactagtcggcattcaagtgattcaatgttcctaatagccataggcctcagtggccttcatctgctttcatcctcacttcgcttttgttcagcagcatttcttcaggccttgggctactgtaacctatgctgctatttataactaagtccttatttattccagaattgctattcctttgagaattcaaattaattatcagttggtaaacacttaaaaatactaacagttgaccagatggcagaaaactagcttgtgttttgaagtgattaggaaaatacattttatattatacattatcttttacttacaatagcattgggactgaaaggagtgctgccccaaatgtcagaacagtttgatgctagaaactgtggatctccctggtagatgatctcagtagcttaatttgcatattgttacattgcttttaaattggtgtctctcattttcttaaacctgtaaaccttctttgatcaaaagcaaatgcagtttaaactaagaagttaagccgggtgcagtggttcacacctgtgatcccagcactttgggaggccgagacgggtggatcacctgaggtcaggagttcaagaccagcctggccaacatggcaaaaccctgtctgtactaaaagtacaaaaagttagccggacgtggtggtgggtgcctgtaatcccagctacttgggaggctgaggcaggagaatcacttgaatccaggaggcggaggtttcagtgagccaagatcactcactgcaacctcaaaaaaaaaataagaatctgtcgcgcacacacacacacacacacacacacacacacacataaagaatttctatctggtggccatccattgattaaaaatgggttggtaaactgtgacccatgggccacctgtttgttcccccggggagccaagatagcttttcctaagagtcgttttgaaaaaaacaatcagagaagaatatgtgacacagactaatgtggcctacaaatcctaaatgattttctatctggccctttacagaaaagcttgctaaccaaccccttgattaaaagatagagcctatggcattgttacctggagaaggaataatagtttttggagaatatctttaaactgttctgtgttttttatttttttgaagtattattttttggaagtattttttttttgaagtaagattgatctttatacttacaccacgttgcccttttagaatggagaaactcccagattccatttgtctatattagcaagcactggcaaattggcttaaataaaacccagggttggttactctttacagctatttgtttcctgatggacgaaatcagaatcctgatctgactggcttatgtgaaccaactccccaagaccatatcaaagtgacccaggtgagttttgtttcacatgataaccatatcactggacacaagctttagtatattctttatagaactgacagcataattgaattcattggaacccattgactagattagtgaatttgtgtgtatgtggtttcactttaaaccctggagcttaaaataggacccagactagatgctttctggtttaataaaaaataaaccactgttgtgacatttttatataagcaaaatttgtataggaaacaagtcttcactttttctgttaacatttataattgcagttatttattcaactaatagtcttttaattttttttaatcaaaggaacaatatgaattatactgtgagatgggctccacattccaactatgtaaaatatgtgctgaaaatgataaggatgtaaagattgagccctgtggacacctcatgtgcacatcctgtcttacatcctggcaggtacggatctaaacagcgacttttttcagctatgtaataaccttggaaaattcggtattatatagcctttactgatacaaggggtggcctggcttttggggttaggtttaaacttttacttttttttgatctctaggaaatgtattttctagtagattaatattttaagtattttcagatgcatctgttactatcttttgcttcttctgcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtaagatggcagtttaggagactggcaaaatccattgtgagttgtcttctaaagccgtaaaacacttaacgatatccaaactacaatgataggtagtattaatagctaatatttattgagcatttactatatgacagatattgtgttaagcactttacttgttttttactcaatctttactacagccctatgagtacatactactattatccttatttaacagatgaagaaactgaggcacaaagaggttaaggaatttgccgaagaccacacagctagtaggttgaagcatctgtgagctgcatctatgaccaggcattccagcttaaggcccatgttcttactgtctgtattttttaggactaagactttattcatatctgttggtggagaatatgagggagaaataaaagaactggaccctcttttgctaatgcaactagaataagttctgttccctttttttttttttattttaatggagtcttggcattagaaggttggggctgggcatgcccatagctcatgcctataatcccagtactttgggacgttgaggctggaggatcagttgagcccagtttgaggccagccttggcaatatagtgagaccctatctctacccctgactccaaaacaaaacaaaaaaaagctgggtatggtgttgtgcacctgtagttctaactactctggaggccaaggctggaggatcagttgagcccagcaattcgacatagcaagaccgtatctttaccaccactgcccccatgcccccccctaaaaaaaaaaatagctgggcatgatggtgtacgcctgtagttctaactagtctggagactgagacgggaggattgcttgatcccaggaattcaaggcgggagtgagttgtgattgtaccactgcactctaggttgggtgacagagcgagaccctgtctcataaataaatagtaattgtatacaatgtgtagtgtgacttatttctgtaaaaaaatttttttaagcatatacgtagaaaaactggatgactacataccaaactaatcactgttatttctgaggataggaattcagagcacttaaattctgtggaatatttgaattttttacaattaatgcatattactttttcaaagtgtttgttgtgctagatggttgagtgctatatgggataagaagtctaagacaaggctttcaaggagctaattgttttatttaggaaaaggacatatgtgcaggtgaaacacttcaacacaaggcagacagtgaacattgttccaaattgttgggtacactataagtcggataggagtttagaggaaagaagtaaaggaacacactttccctagccatgtagaaatgtaaacagaaaaaaaaccagcctcatgtattttgtcatttggccattccataatttattttgtcttccttttaatgaacattcatattgtttgcaggcttacgtatattggcctgcttttacaagtctgtctaggctagcagtgggattgctgcataagggagtgtgtatttcaactgtgatagaggggaggttataattaacagaggggcttatgggaatatcacagtgataatggtattttgttttttagctggatggtaggtaagtatatggatgttttattccttgtactttatagttcattatatattttgtatgagtaaaataatttgagtgaaaatatttaacttttggttagttattaaagtttatcccccttttttggtcttgaaatcactcttgaaggtatggaaaagaatgagaatgcctgtttcttcacatcctggtagatgttgtttgttgttttattttgattttttttaatatactgaatctacttatagttggtgaatgcacatggattttttttaaggtttaaaagaattgctaaaaaaaacttacaaaaacattggttccctgcctctgccccctccagcacctctctgtcccctcgttcagagttttaattcttgaaactgtttactacctctgtgtttcttaaccatgtgcttatactgctttttctggattcttgatctcttcacctcagatgttgtgggagagggtttaggtctcttatatctccctcctccctactccatatcctcccactacagttatttgaatttggcttagtactagtgtttacatgatttcactccttactgtgccaagtaacatactatacaataattacttttgctttcttatacaactttctgcttttcctggtataattatttttattttcttagttttcagtttgtacctgtcactaccaaatcatatcatactctcaaacatcctctcaatatagtttctatgaaataaaatctgttagtatagtagtatgtgataccgtgtactgctttgtaggaaataggagtcatctgtgttccgctccagtctgctccagttactcctgtgccacactacttgtcaccctgaggtgtcccctcgccatcctcatgggacttcattgcctctcctctgttggagtaccttggttcccatgttttcctcttttttgcttctttgtttatgtccttaaagtagctttctgtgaaagggtgagagataaacttcttgagatctttggtatcttaaaatgcctttattcaaccctcaaacgtgaattgactagttacagaattctagattaataaatattctgctctaaattgttaaggcttcactgacttctagcttctaatgtatttttgcttttcagcgcttcctttccctctgtcaccaaaagccttttttttttttttttttgagacagaatcttgctctgtcacccaggctggagtgcagtggtgcaatctcggctcactgcaacctctgcctcccgggttcacaccattctcctgcctcagcctcctgagtagctgggactacaggcgcctgccaccacgcctggctaatttttttttgtatttttagtagaaacagggtttcaccatgttagccaggatggtcttgatctcctgaccttgtgatccgcctgcctcggcctcccacagtgctgggattacaggtgtgagccactgcacctggcccaccagaagcttttaagatattttcctcatccttgatttgatgaaaattgtaagggtatttttggtttgtttgttgtgggtttcctttctttcattgagctaggtatgtaataaaccctttctatttggatatttatgtcctttaagtcttgaagtcttggaaatgtttgtatttctctgatcacttattttccatttataaatttataaaggttccaccttttctggagccttatatgctatgataaaagaatattgcggccgggtgcggtggctcatgcgtgtaatcccagcactttgggaggccgaagcgggcagatcacctgagatcagaagttccataccagcctggccagtgtggtgaaaccctgtctctactaaaaatacgaaaattagccaggcatggtggcgcatgcctataatcccagttacttgggaggctgaggccagagaatggcttgaacctgggaggcagaggttgcagcgagctgagatcgcactatttcactccagcctgggcaacaagagtgagactccatctcaaaaaaaaaaaaaaagactattgcaaggatccattatgatgttgagacatgaatgtaaaaatatgattagttcaaccctctgtgcctaaggaatgagagaaagattgatgatcggcagagagggccttccagaatggggaaaggatttaaagaatgatacggaagtcgaaataatcattagaatgtgcaggaaacactgaggagatgagcctgaatagagcagcgttgatgcttgttagggagttgtgggaaatacctttctttggttgcagagaccagattagaaagacttgtgaaagctgggcaggagggtgagattttgtaacagggcaaattgggagttactggtggtttttgagttggtgagtgtttaagaatggctaagctgatagtggtaagcagaaggatgtggtgagataaactacaagttgggaagttcactaggttgttttaataaatcacggccacccgcggtggctcacgcctgtaatgccagccctttgggaggccaaggcaaggaggatcactttagcccagaggtttgagtccaccctgggcaacatgacaagaccccgtctacccgtgccttccccgcgccccaaaaaaaaaaaagccacatgtggtggcgcacagcttgtcccagctacttgagaggctgaggcaggaggatggcttgagcccaggaggtcaaggctgcagtgcaccatgtttgtgccactgcagtccagcctgggctacagagcaagaccctgtctcccataaataagtaaggtctggggttggtaagtagaatgaaatgaaatatacaggtatgagaatcttttagggaaaaatcagcaggatatagctactgacaaaataattatgatgaagtgagaggaggcttgactagtaactttgacttttgtcattgagctgtttagctgctcatgctgcattgtcagctaattgggaacccgttatcttaagcatgtggataaagcaaagagttaaagatgagagcttttctgtcatccaccacccagcactaataacatgactaaatatggctgtttttctgtcagtgttgctttgctgttggggaatttaaatgcagagtagcattttttttttaatgaattactgtgtatctcttgacagcttactttgacaagcttatcagctattcctaagcctgctataggcagggaaatggaaaaggttatatatgtgttctttcttctaatttggtacctcattttttagagctcaaattgacagaaaatattaatcctttttaattctttctttttttttttttttttttttttttttttgagatggagtcttgctcttttgcccaggctggagtgcagtggcgctatctcggctcactgcaagctccgcctcccgggttcatgccattctcctgcctcagcctcctgaatagctgggactacaggcgcccgccaccacacctggctaattttttgtatttttagtagagacggggtttcaccgtgttagccaagatggtctcgatctcctgacctcgtgatccacccgcctcagcctcccaaagtgctgcgattacaggcgtgagccaccacgcctggccttaattattgaattgaaataatttatttctttggaaggactcaagatgctttttagtgatattcttgatcatttttctttacaaattcaccttaaaaaaatttttagttaaaattttttagagggatctcactatgttgacaaggctggtcttgaactcctggcctcaagcaatcctcctgcctccccaaatgcaggattacaggtgtgagccactgtaccgactctcatcttctttcttaccttaataacccatagagaattcaccgtcatcgatctctttctttattatgtcccttaaacattgttttcccaggtactttgttaagaggttaatatctgcaccccccgccccactgccatcctttttttttattttatttttgtcgagacaggctcttgctctgttgcccaggctggagtacagtggctagattatggttcactgcagtctcaaactcctaggctcaagcagtcttcctgttttagcctcccaaatagctgtgtgccaccatggcccagctaattttttattttattttttgtagagatggggtctcattatgttgcccatactggtctcgaactcctgcctcccaaaatgttagtattacaggtgtgggccactgtgcatggcctgccccttactttttatatggattcctatttttaatcttgaaaagatttttttctttctccaaagatgagggggtagaaaactgttgtaatttttaaagttgtaaactaggaaactttttgtagccctgtcctttctagatagattacctgtagcttgccatgggtatggtgtttctgtgattgagagtgccctcttatggtgacacaaaaattattcaggaagtgctagagtctctggaagttttttaagagggtgtgtgcgacctcaaacctaggtctggcccatttgtagtttaagtgttcccatggtatttgccatccacagctttaggagagttgaaagatgccatttccccaaacgaaagtaatctgttaaattttttatgtaccctaggtggaacggccgccttctccattctccatggccccacaagcttcccttcccccggtgccaccacgacttgaccttctgccgcagcgagtatgtgttccctcaagtgcttctgctcttggaactgcttctaaggtaaagcattttccattactgcagtttttggattctttgctgtgtactagtgggtttttactgatttgctttcaccctgcttccacaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatggtgagtcttaattttgaaactatctaacctgttaagaaatatgtgtgggccaggcacagtggctcatgtctgtaatcccagcaatttgggaggccaaggtgggtggatcgcttgagccgaggatttcgagaccagcctgggggacgtagtgaaaccctgtctctacaaaaattacaaaaattagctgggcgtggtggcacttgcctgtaattccagctactcgggaggctgaggtgggaatattgcttgggcccaggaggccaagctttcagtgagccatgatggcgccactgcactccagcctaggcaatagagtaagaccctgtcttgaaaaaaaagaagaaagaaaaagaaatatgtgtggatagaagtttatgggttgaaattttgtgataagttttatatggaattcagagatgctataacataattcctaccctcaagaaatatggctgggcgtggtggctcacacctgcaatcacagcactttaggaggccgaggcgggtggatcacctgaggtcaggagtttgagaccaccctggctaacatgatgaaaccccgtctctactaaaaatacaaaaaattaactgggcctggtggtgggtgtctgtaattccagctactcaggaggctgaggcaggagattcatttgaacctggaggcagaggttgcagtgagctgagatcaggtgattgcactccagcctgggcaacaagagtgaaactttgtctcaaaaaaaaaatgtgtatattcacagaccagatgaggcagtttgtaaatattgcagtaaatgtcctttcataaatgccatttgtaatctaactagaaaacacttaagttttagagaaataagaggttattcccagatagggcaatcatgagaactttatagaaggagtggcatctgagatctgaagtatttctttggaaagtggatacggttttcagattgataacagccacaatgacagaaatgcctaaggtgtattgtggaatgatgattaggttattttaagtagagcagaaattttgtcagtaggagaaagaactggaaaggaacatcacactagattagagagagttgaataccctctcccaaaagaattttaatttgtatggtaggaaatgaagagcatttgaagggggtaggttattggtcctttgtctaaatatgcaagaaagggtccagaactgagaggtgggagaggaatatttgatgttttgttcatttatgcacttaacaaaaagtcttgccctcacaaagtttatattctaatgggaggaagatggaatataaacatgttaattgaataacatagtatgttcacagtcacaagtgctatggagaaaaatagcccaaagaagggtatagagaaagctggcataggagtgggaggtatgtgaagttatagagtacaattctgagcagaaacctgtagcagtaggaggatgtgccatgctgatcccaggggagattattccaggatgaaggaaaaagcaagtgagtttgggagagactgaagaataacaaaggggtttaatatagccagtactaaatgagcaagagagagaatcattgtttatgagcagagtgggcagccagatgattaggtcgaagcctttcgagagcatgaaataaagacttgttaaggcttgaaaagcagtcagtgggtggaaaaaaaggtaagtaccacacgtgcactgcatgcgcgtaaaaacgaaacttttacctggctgactgttgcatttgaaatgagcagttgatggaagcatcagcaagtaggcagtcagaaatccaaggaggcagaatgggaagagtgaagttgagaagtgttgtggcactaagtgaatggcatctcttggttgcagagaaagggtaatgctcaagtggtacctgtggggtggatagcctaattagtgagtgtggattaggtttgactttctggcagcatcagtatagaatgaccattttgcgtttggatatagattatttaagatactaatggtatttgtgtagatagccaatttactcaaatctttttagaattaaaccaaaaagttcatttccctggctctttctagatctccacctctctaaactttacatttgaaggttcttcggagccttaaggcccctaagcgtttggtcagatgtgataacccctgggcatggcattgagagttaggtttgtatctgttattgttattttgaaaaggttcaataagagcagaggctcagctgtggtaagaaagttgtttttcaacacttttctttactttccagagtatgaatagcagcccattagtaggtccagagtgtgaccaccccaaaatcaaaccttcctcatctgccaatgccatttattctctggctgccaggtaagtctgctaaagctatattttgtacagtggagttgttacttgtaaaaagcttacttgcagaaaattgagaaaacccagaaaagtgtaaaaaagaaaataaaaatctctgcaccatgtagaaatgattatattttatgttttagagtatttccttcttttcctttttctgcatatgtgtacctagatctgttttgctggggcctgtcaattttattaatattttcaaggaagtaattttggatatctgccatctgtttcattgctctgcgctctttattcttccagctttctttaagtttaatttgctgttttcctagcttcatgaaatggacgctgtgttgatctgctcaggctgccatgacaaaataccacatattgggtggtttaaatagcagaaatttattttccctgagttctggaggctggaagtctgagatcagggtgcctgcatggtggctttccggtgagggctctcttcctgcatctcactatgtccttacatggccatcctcagtgtttgcacagacagagagagagagagagagcacgcacaagctctctggggtctcttcctataaggacaccaatgctactgggtcctcctattcttatgacttcattcaaccttaattacatccttagaggccccatctccaaatacagccacccctcagtatatatgcatgcaggggattagttccaagaccccagcatataccagaacgcacatggtcgggtcccacccttggccctgtggaaccacatatatgaaaagttggccctccctgtatgtgggctctaatgaatactgtatttttgagccaaacttggttgcagtcagggaacccaaggatacagaagcctgactgtgtttattgatgaaaatctatgcgcacactgagaataagggcttcaacagatgattttagggggaacacaaacagatgttttacggtattccacccattttgatatgtcatattttcattaagttcaaaatacatactttttctatgtgtaatttcttctttaatttatgagttactcatatgttgcctgattttcatacatttgaaaattttctagttatccttctgttactgctggctttattccaatgtggtcagaaaccatactgtcagctagtttatggtaaaatttggtaatttgtatcaccctcagttcctaagaatgtgtattttgcagtttttgggttgtagcattctatataagttaatgaggtcaagtttgttaattgtgttaaatcttgtatctccctagaatcttttttaaaatttctctgctattggataactgagaggagaatgttaaattctccacctatgactgtggtttttttcttttccttttagttatatttatttgtgttatctgtatatttagcctatgtaattggggtacatagaaatttagaatttttgatactaagtaagtttttattataaccaaatacctcttttactctgtagttctatttcttgcctgccttaagtctgctttgccatatatgaaagtggctacatcacctgtcttttagtatttgcataacctctgtattataccatttcactcctctatttttttttttttttgtaatatggaacgcttgatgaatttgtgtgtcatccttgcatagaggccatgataatcatggtaatcatctctgtatcgttccagttgtagtgtatgagctgctgaagtgagcacaactccttctattctttaatagttatcaagagattccatcatgcactcttgacttactagagtttgtttcatttatttatttaaagatagggtcttgatctgttgcccaggttggagtgcaaaggctcaatcatagctcactgcagcctcaacatactgggctcaagagatcctcccgcctcagtctcctgagtaactggggctccaggcattcgccaccatgcctggctaggtttttaattttttatttttaatagagacaaggtctagctgtgttgaccaggctggtcttgaactactggtgtcaagagatcctcctgtctcagcttcctgaaatgctgggaaatacagatgttagccatcacacccagcctacagagtattttaaatcagcatctctgtttgttgcccaggctggagtgcagtggcgcagtcttggctcactgcagcctaaacttcccaggctcaagtgatcctcctgcctcagcctcccgagtagctgggaccacagatgcgaactaccacactcagctaatttttgcattttttgtggagatggggttttgccatgttgcccaggctggtctcgaacttctgggctcaagaggtttgcccgccttggcctcccagagtgcagggattataggcgaaagccactgtgcccagcccacttttaattttttaaaaagatacttggctgggcgcagtggctcacacctgtaatcccagcactttgggaggccaaggcgggtggatcacatcaggagattgagaccatcctggctaatgcggtgaaaccccatctctactaaaaatacaaaaaaattagccaggcatggtggtgggcacctgtagtcccagctactcaggaggcggaggttgcagtgagccgagatcttgccactgcactccagcctgggcgacagagcgagactctgtctccaaaaaaaaaagagatactttcactgaatacagcatctatttttgttttgttttgtttagtatgttttgttttgagacagagtcttgctctgtcacccaggctggagtccagtggcacgatcttggctcactgcaacctccgcctcctgggttcaagcgaatctcctgactcagcctcccaagtaattacaggcacacaccaccatgcccagctaattttttatttttttattttttagtagtaacagggtttcaccatgttggccaggctggtctcgaactcctgacttcaagtgacctgcctgcctcagcctcccaaggtgctgggatttataggtgtgagccactgcgcctggcccagtgtagcatctgaactgaagttgttttctttcagcagtttaaaaatatcattccactctcttttggcttccattgtttctgttgagaaattagccgtcagccttaatgttactcctttaaaggtaatgtttcttggctgtgagtggtggctcacgcctgtaatcccaacactttgggaagccaaggcaggaggatcacttgagtctgggagtttgagaccagtctgggcaacatagtaatactcccatctttacaaaaaatatcagccaaccatggtggcacacgcctatagtcccagctactggggaggctaaggtttgctggagcccaggacgttgaggctgctgtgagctgtgatggcactacttcagtccagcttgggttacagagcacgaccctgtctcaaaaaaataaaattgaaaaataaataggccagataaataggccaggtgtagtgcctcatgcctgtaatctcagcattttgggaggccgaggcaagcggattgcctgaactccgggtttgagatcagtttgagtaacatggcgaaaccctatctctatgaaaaagatacagaaatgtagctgggcatggtggtgcacacctgtggtcctagctgctcaggaggctgaagtgggcggatcacctaagcccagaaggtcgaggctgtagtgcgccatgattgtgccactgcactccagcgtgggcaacacagtgagaccgtgtctcaaaaaataaaaatatatatttttaaaaaaatgataatgcttattttcctagctgcctacaaaacgttttcccctgctctgggtcccagcagttttactgtatcttcctttgtggttttgtttatatttatcttttaatccttcataagttttcatactttttttttcgagacagagtctcactctgtcacccaggctggaatgcaatgctgtgatctcagctcattgcaacctttgcctcccaggttcaagcagttctcccacctcagccaagtagctgggattttaggcatgtgccaccatgcctggctaatttttgtatttttagtagagatggggtttcaccattttggccaggctggtctcgaactgctaatgtcaaatgatccacctgcctcagcctctcaaagtgctaggattacaggcatgagccactgcaccctggcctccttttctttttcagacactaactagaaccaaacctccgtaagtttggtaaagtttatttagtttgtgatatgtttaatcagttttaggacattgtcagccacttttcctgaaaacagactgaatattgcagtccctctttgtcctcctcttctgggactaccttttccggaatgttagaccttttcactatgtctccgagagctcttatgctgatgtctttttttttttttccattatttttttcttggcatactttattttctttttttcttttctttttttgaggtggagtcttgctctgtcacccaggctggagtgcagtggcgcagtcttggctcactgcaagctccgcctcccgggttcatgccattctcctgcctcagcctcccgagtagctgggactacaggcgcccgccaccaagcccagctaattttttgtatttttttagtagagacggggtttcaccacgttagccagggtggtctcaatctcctgaccgtgatctgcccgccttggcctcccaaagtgctgggattacaggcgtgagccactgcgcccggcctattttctttgatttttaaatttattcagcctccctagtaactgagactatagatgtgtgccaccacacctagctaatttttgtattttgtgtagatacggggttttgctgtgttgcccagttttatttttcgatacagttgctcctcaacttaagatggggttatgtcccagtaaacccattgtaaattgaaagtgcattttgacttacagtattttcgactgggtttttccaaatattactccattgtaagtagagaagtgtatttgatgtttattacttttgcaccattgtaaagttgaaaaattgtaagttggggatgtctgtgttgtatttttaagttctagtatttccatgtgatttttaaaaatgtatcgattccatccttttttttttcttttttgagacagagtctcactctgtcgcccaggttggagtgcagtggtgcagtctcggctctctgcaacctctgtctcccaggttcaagcgattctcctgcctcagcctcctgagtagctaggattacaagcatgtgccaccaccacgtctggctaatttttgtatatttagtagagacagggtttcaccgtgttggccaggctggtcttgaactcctgacctcaagtgatccacccacctttgcctcccaaagggctgggattacagacgtgagccatcgtgcccatcccatcttcttttttttattgaacacataaattattattttaatggccatacgtaactccaactctgtccagcttggcaagacagccaaaatatctatttagcttttcaattgctgctttctgcttgttttctcaaaatctagccccaagcgtaaacagtttagggatttgtaatagctctagggaaaattgctggcatttcaggtatacttctctgctgttccctcctctgtattttttggtcccttataccttggctgtcattataccccaaaattcctgtctcttcttagtctgttttctgttgtcataacagaatacctgagattaagtaatctataaagaaaagaagtttatttagcccacgcttttggaagctggaatgttgaaaagcatggcgctggcatggtgagggccttcctgctgccttgtaaccaggcatcagcatatgaaggtggtaactaagtttccaacatgtgaaactgggggacatatttaaatcgtagcattctcaccagcccattgagactactttaaacgcctagttcaaaacccctaatatagggcttactctaatgtattctttcttgaatcttagcctgttaagtcgtggctgcctggttgctctccagtgtcttctttcttttaaagcatatattgccaacatgctttgtgagaaggaggttcaattatgtattttatggactttattaacagagaattataattaaaatttttaaaagttaggcacggtggctcacgcctgtaatcccagcactttgggaggccaaggtgggtggaccacttgaggtccggatatcgagaccagcctgggcaacatggtgaaaccctgtgtctactaaaaacacaaaaattagctgggtgtggtggcgggtgcctgtactcccagctacttgggaggctggggcaggagaaatgcttgaatctgggaagtggaggttgcagtgagccaagatcacgccattgcactccagcctggacgactgagtctccgtctccaaaaaaaaaaaaaattattgcctttttaatggccctttttacaaaaataatacatgttaactaaaatttagaaaatataggtaagcaggctgggtgcggtggctcacgcctgtaatcccagcactttgggaggccagggctggcagatcatgaggtcaagatcgagaccatcctggccaatatggtgaaaccccgtctctactaaaaatacaaaaattagctgggtgtggtggcatgtgcttgtggtcccagctgctcggtaggctgaggcaggagaatcgcttgaacctggaaggcagaggttgcagtgagcctagatcacgccgctgcactccagcctggtgccacagtgagactccgtctcaaaaaggaaaaaaaaaaaaggaaaaggaaatataggtaagcaacactgaagaaataaatgttacctgtaatcctactacctagaatcagacaatagttagcaatttgatacatgttcattgccattcttccttgtatgaaatcatattgtcattgctggttttcactaaaaatatcttgaacatctttgcatgttattacatattctgttgcaatgattttcaaattatttcacgattatacatcagtgtaactaaagtggaatctcagtttgtaaaatagataagaacagatctattgtagtagaagcagcagtaggcttccgtggctccggcttggaacctctaaggcacttggggacacagttgtgtggttcagtatttattcagtacattattatttggtattgaagttattgcctaattttccagcattataaataatgctgcagtgaatgttcttgatggtttccttagggaaaattctcagaaatggaatttctgagaccaagagtatgcatgtttggtaaatacttttgttgaattacacaacagaaacgtatcaattccttatttctacagctctgtaacaaagtacccattcatttccctacaccttcactgacaccgtgtggccaaataccacattaagaacaaactagggatgggtggggtgactcaggcctgtaatcctagcattttgggaggctggggcgggaggatcacttgaacccaagagtttaagaccagcctgggcaacatagtgagactctgtctctacaaaaaaaaaaattttttttaattagcctggtattgtggcacatgtctagtcccacctactgaggaggctgagttgggaggatcacttgagcccgggagatcaaggctgcagtgggttgtcatcatgccactgtgctccagcgaaaaatctaggtgtttctttctgaatatggactgtcctcccgccatctcattttattgtgaaaagttacaaagatagtaaaggtgaaagaattttacagtgaacacccatatactgatcacctggattctacttttagcattttattatacttgttttatcagactatatgtctgtcttttgatgttttcaaagtaaattgtagataccaatacacttctgcctcagaacttcagcatgcgttgcacaaatcttaagtggatatttcccattaacggcaaaaaacacaattacttttgcaccaacctaataaaagtaatatgtagatataagaaaaaacctcaagtgagattaaaggggacttctatgttctgtgttaagtttctatagcacttatgtgtgtattataaatgtgttgcttttataattaggaaaactaagcatcaagcagacaaacgaaagagatgctccttgtagcatctttaggatatgcaaaaataataggaagggaggagaaacacaaattcacactccaagaagtaggtttttgtgtgtctttttttcccccctacaatttagtggggtgtttttgtatttcttgggagttttttcatttcatttcatgcggtggcagaagtcttgtttccaaagtttctgggtgaaagttacatgtggatataacagccagatccttgatgtgggagtcagtagatctgggatctagcctcagaatttacgctaactgcggtcgctttatctctctctattttaaatttttcttatataaaacaaggagtttgagaaagcttttgacaagctatgcattccttgaaaccataggtagagtttagaattggaatttagtttacagttctaacattgtcagaaaaaatcttgccgtttctctaactctagggcctgggactctataatgaaacttctgtgggggattaggactaaccagtatctcaggtgattagcccagtatatcacctctgaagcataaaagctgcacctttggtcagttgaaagtgacatttttagttagtgtacttttgctaattacttgtcttggtcagcagaaataatagttccctaggtgacatgtattttgctctgttcaatttgagttatgtctgtttttaagccatttattttatacttcaaagtttactggtttgttacttctttttctattttttattcttcatcttccagacctcttcctgtgccaaaactgccacctggggagcaatgtgagggtgaagaggacacagagtacatgactccctcttccaggcctctacggcctttggatacatcccagagttcacggtaggttcacaacaaccctttttgggccctatacctttatgtgggtaattgacacccttcacctgcttggcttgctacctgcacatactgttatccagtcagattaaagcagaaagataaagataaatctagcccttaatggtttaagccttttgtagctgtaggtaattacacttatgttttctcagcaacatgagaacctcaaaaacacatacacctataacttgccacaagagtcaactttaacatttattagtgatattggcaaaacgagaagatgaatcttcataagtttatagataacagttctatttccaaagatcattatggcactttccttctggttcagagcatgtgattgcgaccagcagattgatagctgtacgtatgaagcaatgtataatattcagtcccaggcgccatctatcaccgagagcagcacctttggtaagttgccattctgctactttaaaaatcattgatatgtcataggaatgaacatgtaatatttggcaattgagatagcttgatctaagctcaaaattcttctgtagctgggactacaggtacgtgccaccatgcccggctaatttttgtatttttagtagagacggggtttcactatgttggccaggctggccttgaactcctgacctcaggtgatccacccctcccaaagtgctgagattacaggcgtgagccaccacgcccagacaaagctgaaaattattttcagtaatctttggcaaaatatctttgacatgggcagtaaagtatccccaatcctttatttcctactcacactgctggttccttttgtgcttttctttgtccttccagggcctagagacatttgtgttctatactctggacctgtaagctccttttttttctcattgcattgatgaaattcttttatgtgggggtggtgaacactcaattcccatgttaactagcctaccagattgaaagttcaagaagcctgctctcacaggatcctttgctgatcttccaaggtggaatgtggatagaaatgtttattgaatgatctgagatgacactggagtcattggcatcggtggctattaaccttgtcaagaataacctttggcatgttcaaaaatgaaagctgcagtgttggtgcagattttattttctatttttatctctgtttacatggtgtttggcccacagtagacaatcagtaactgttgaatgagataaatgattgcatacatgtaaaaatgaatggctgccccgtattgaaatgtattagaagatgaagtgcgtcagaagaagataacatcactcatttttctccaggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaagtgagtctccagactactttgggtttgtcctgaatggcagtgtggcctgtatgtttatattgaaagggagatgaccttctctggtgacagtaagtcagtatgtaggctaaacattatgtctaaatgggaggaaagtcccaagttaggaagttagactgtagtcagactctttaggatttttgcagacttagaaaagaggtcattccttaaactctggctcttcttatgttaggggtaggtaggatttatagtttctctgagtatgccttatgacactggtaattaggcttgatggctcagagcacacattcctttttcctgggctctgttccattggaaagaaggcatgctagctctggaacacacactgaatgggcctggagccagcccatgttgggccttgactactggaggctgctcttcttgcacctgtggctgcctggtagggcagcagccagagttgctgtcactttggaattgaagacagccttcaggacagacagctggtgaaaaagaatacagccttcgcttgcccagacgagcaatgtcccccactcagccttggctaatgcttcttcattgcaacttatatctgtctttttccttatttgtagaaggcgaagtttagtatctttggtcccctcagaattaaaacagacaattacatgtgcacaaacatgttgcttagtgtaaagcatgatgcagatgtttatgattgcagtggttattgttcataggacaggtgcatggtatatttagaaggttgtttttattgtgatgaggaggctatatcttaaaacccttgaacctgtaaaacccagccttgtgactgaagagcacatgtacccagtttacaggaagtcagtaatatcttgatattagcacatttttattgctgttgttaaatgaggatttccccagatttgcaaatattttctttcctatttcttctagatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagacttgagttcttgctcattcagggggttgggaggcaatactcgagttgccgtaggaccaaatgccaaggcccccttcctcatggcggtgagcctgagctgctgtctggagggcagttccaagtggcaggaaagcataggaaggggacatagctcctgctaacagcctgccaggcccttcgtgctgcgtcatcagggcagttttgctgctgaaaagtagggtgactgtctgctctggtagaacttgagccatttgctcagaagcagaggtaacccctgatctctgctgccaactggaaacggttttgtgtgccttttggttgtagtttcacaggcccccaggttcctgtggtacccatgatgaataaaaagcaatgtatgatttctgggacaattaagctttatttttcatatatatatatattttcatatatatatatacatacatatataaaggaaacaatttgcaaatttacacacctgacaaaaccatatatacacacatatgtatgcatacacacagacagacacacacacccgaagctctagccaggcccgttttccatccctaagtaccattctctcatttgggcccttctagggttggggccctgagcttggtttgtagaagtttggtgctaatataaccatagctttaatccccatgaaggacagtgtagacctcatctttgtctgctccccgctgcctttcagttttacgtgatccatcaagagggctatgggagccaagtgaacacgggggattgaggctaattcacctgaactcgaaaacagcgcccagcttcctcaccgcaggcacgcatcttttctttttttttcctcgagacggagtctcgctgtgttgcccaggctggagtgcagtggcacggtctcggctcactgcaagctccacctcctggattcataccattctcctgcttcagccttccgagtagctgggactataggtgccaaccactacgcctagctaatttttttttgtatttttagtagagacagggtttcaccgtgttagccaggatggtctcgtcctgactttgtgatccgcccgcctcggcctcccaaagtgctgggattacaggcgtgagccaccacacctggccccggcacgtatcttttaaggaatgacaccagttcctggcttctgaccaaagaaaaaatgtcacaggagactttgaagaggcagacaggagggtggtggcagcaacactgcagctgcttctggatgctgctggggtgctctccggagcgggtgtgaacagcgcacttcaacatgagcaggcgcctggctccggtgtgtcctcacttcagtggtgcacctggatggtggaagccagcctttggggcaggaaaccagctcagagaggctacccagctcagctgctggcaggagccaggtatttacagccataatgtgtgtaaagaaaaaacacgttctacaagaaactctcctacccgctcgggagactggggctccttgcttgggatgagcttcactcaacgtggagatggtggtggactggtccctgaaaagcgggccttgcagggccaagtgaggtcctcaggtcctaacccagtggccctctgaaagggggtgtgcaggcgaggggagcaggaggcttctctctagtccctttggaggctttggctgagagaagagtgagcagggagctgggaatggtccaggcagggaagggagctgaagtgattcggggctaatgcctcagatcgatgtatttctctccctaaaagtgggtagaggagaagaggggaacacggagacggtgctgagttgaaggtgtgagcaccgagaggaaggagagatggaagcagaa

SEQ ID NO: 89 - DNA, 2502 bp, Homo sapiens
taggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 90 - protein, 759 aa, Homo sapiens
RRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 91 - DNA, 35169 bp, Mus musculus
  misc_feature (1)...(35169): n = A,T,C or G
taggaaagtagagaagaactctgttcacatcttctgctacatgttctacccctgcagatcccgattcgctcctttttgagagaggacacactgtatgagcctgagccacagatctgagcccagatggaagtgaatgaatccagggcggaggctagagctggaagccagctctgcttcagcactgccagcagcgctgggtctggcccagcccctgaggaggctcctgactatcctccagctccccacctcccagaggagctcagctagactcctctgctctctccaggccagaggaactggccttttaatacaggtttttgttacagagatgtgattgaaacagagtagtgtgtcaatagtgaagacttggagacggtccactgcatatagacttgcttgcttccactagcttgcatgccatttcttttttctccctttcatccacacataaacactccctctcacattcaagcagtcgtgccaggcacatgccctatctggcacaggcctgcattcctatcacaccatcctgggcctcaggctgcctgggagggggacgttcacatttgtacaggccctgtcagttgggtggcacgaacagcactgggttccaaattcttggcatctcatggtttgtccccacggggatgagcagagactctgagatccctgctttcagctgaagcactgtgacagtagtgtaatgtccatctctactctggagagtggaatctgaccaggaagtcctagggcctaaggttagcttctgcaggtgagtgcagctgcatgtccccacctgccctttcctgagagtggacaggtggaggaggagccatagccaccaacctctagggtggtcttcagatcacgatcatgctcatcttcactggcaaagcactgctcctccctctgggccctgctggacctagaagtgggaagcagcagaggaactaggtgcaagacattttggaggacctagcggcaagaagaagcctcagcactctctgggagccatgtggatatggcctgtccctgttcctgccaacagtgactcagtgcctcttctcccaggagaagacacctcagggagtcttgccctgtaatgctcacgtccatcctgtaacctaagagtcactccagttgctccagggtctgtattctatcttgggagccaccgggtgttaagaataagcccccaggcttctagtgagctgtggctgtctgttctctgtgtgttgtcatattggaggttaattataaatatggcttttatgctctcgtgtgactcctttgatgggcataaggaccagagtataggaatggtgcctagagactggacttgcatctatgatccatcctaccctaccttacccacaggggactcagttgcctagaaaatgcaaatgatacctgttgacaagtcactaagagagctattgctaagacccaaacccttctagaacaccaccagcattgctattctgcttcacgaagccctgaggctggctctaggggccagggcccttagtacttctccacagactcccttcctacacttagaaacacaactgtgctggtatcccgatgcaggatccctcctgaactgggaagggtgagctcagccctgattgagaggcggaaaaaggaaggggattgctctccctcttaggccccagtcaggatatggctgttctgggcccacccctgacccgttgggtggaaacaggaaatatgtgagacttggtgtgtgctgggtcttggtgcctggctccgagactgataagagccattgtgtggccactaggatgagcctgctgtggatagatgtgcttcccagaggaaggaagctttataggcctttcctgggcggaggaagctgagaggagaaaagggaaggtgcccagccatcattgtgaggacaggcccagggtgcctctgccccttccatgccagcttctcctggaaaagtctgtttcccctgacttccctgttcgttatcatttcctataaggaatgactggcgatccagagctcagttccaggccaggaaaatgtcagctgtgatttagcaacaatgaagacagaaaaacaggaacactgggggggctgggggggaggtgcagttgaaaataaacagagggggtacatacccaagggacccaggaacttaccttgaggctttggaagtgggtagggtagaggcctcttgctcttcctaagagccccttctgcccaacatgaccagccttgacctcaaaaaaagcaagacttgagtaatcaacgcatgcctctcctaccagcacaacgatgatgcaggaggaccacttgagaagttcaaaacgggctggtgagatggttcagcagttaagagcaccgactgctcttccaaaggtcctgagttcaaatcccagtaaacacatggtggctcacaaccatccgtaatgaaatctgatgccctcttctggagtgtctgaagacagctactgtgtacttacatagaatgaataaataaataaatattttttaaaaaaagttcaaaactagtggggacaaaatacatagtcaaatacctttttaaaaaagaaacaaaaaacaaaaacaaaacgtgtaaagcccactttttataggcagctacgtttcaggaacctcaagagtgtcaatactgctaaggggtatgtcctcttggtttgtgggaagatgtgcctctggttggtcagctctctaaaattgatcagagagagggcagccctgccaagatgttgctagagggggtggagggttgtctcctaacctttgacccagagcccagggtccctcatgggtggctgcatcagctcctctggttacctgagacaacaggcatttcctccatccttcagcccctcctcttcctgccccaaccctctggccaagagacctcccagtcagacctggactgctccagctgtgtcctgagaagctggaccagccacatccccaggggctggagttgaagcaggaccaactggccttcccagcgtgagccagtggagccgctggagccagtgggccgccggacagtgtttgcgttctgcaggctggctctccacacagcggaatggcactccaagtagaactgataccaacgggagagatcatccgtgtggtccatccccacaggccatgcaagctcgtaagctacgatgatgatgatcctgtgggctgggaggggtggtggtagggtctctcctgggctgggcgacctcttctgtacatcccactggagagacatgagcattgaggagctattctgatctttgctggggacagaaaccattaagacaaggagtaggtaaaaagaggggtaagggattgtgggctactagaaagaatttattcaaatcggaggtttagatttttaactcctttgccagctccctcaacctaaatgggcttagctggaaactggacatagaaggcaagatgacagtgctctgacgccaaaagacttgtaaaagttgtagacgtacagtacaagtaatttcttcccctttctcacggggcacgcaaaactggggttgcccaactctagcaacatggaacgaaaaggtgggcgaaagaagagagaaaattagaaatggggaaggactggcctagcacgcaaggcagtatagtgagggcctggtttgcttaaagaccatcgcatctggtgttctcacccaccaagtactacggcgtgagttgggtcttctactggagggatgtgtgtgtgtgtgtgtgtgtgtgtgtgcgcgtgcgtgcgtgtgtgtgtgtgtgtgtgtgtgtgtgtgtgtgtgtgaccccgtgtataattgttatgcgtcttgtcctacgagttaatagagaagtgcagcaccaagccttggcgggcgctggcccaggccatggggagggccaccagcacggggcggggcccaagggcgcgcgcgcgcgcatgagcctgggccttgcgggggatgacgataggcagcggcccggcccctagcgggccctgggcggagagatcgtaccggggttgcggactacggaggtggccacgccgtccagtccagcccccacccgatcacccgaagaaccaagccggtgggtacacgagggaggggacgtagtcacatagtcccagatggccaaatggctggaggggtaggcggttgagcgtcttcagctagctgccagagctatggtcgtgttgtctctagctgggtattgctgagacaggattcgctcagcccgactagtgcagggttccaggacccggagactctgaggttcagtctcttggggccgggcgcgggatccaggcactccgtgctctctcccggccactcccgcaggccctcccagctctgggttccggagaaactggtagagccccgccccttcccgtccttcgcccccgtagcccaggcgcgccggtgatccttgcgaaaatgcagcgggtgcggggctcacagatgaatgggagaatgagtggctggcccacagttttattcaattacagcatgagccagcctcttgctcacactcccagcctctgagattcattcattcatgcaagcgcccaccagtgggttatggaatctccagcaagtgcctagctgagtgcttgcctaagaccggagcagtctcccggcagtctgacaaggaagcagacgattagtacttaatttagtaaggaggaggctgtgtgttagaggaaaataagaaggcgctatggcgaaggtgattcctgagctgactcttcggtgatgactaagtgaggtgggtaggccgagagagctgggtttaggaagctgcaggtgcaaagccacagcacgtgcagtctcccgtggttggtggttgtccgcaggggtacaaccagcacctcctggctgtgtgtggtagtgaagaaagaagggactggaaaggactacctgttcagttagagattaatccaggagtagtgcagtaaactgagcccctggtcaagcgtgaagggcaagcttggcacccgggaagcggggagcggtgctttctaagcctcctttccattaacttgagatggtaacagtgtgagatttgcatttgtaaatgccagagcggagaaccgaagaaggctgttactttggtccaggagaggagcaggatggagaagccggaatgaggttttagcaggtggtgactgatctgattggtgtaaggggaagaggaccagctttgaatgccagccaggtcatgattaccacagctagagatgctgtccccctctccggggaagatgagtgaatgtgaaaactcatttaggggcaaggtgctctgtttatttttgctggattctccagtaaagaattctggcaggccgggcgtggtggcgcacgcctttaatcccagaactccggaggcagagacaggcggatttctgagttcgagccagcctggtctacaaagtgagttctaggacagccagagctatacagagaaaccctgtctcgaaaaatnnnnnnnnnnnnnnnnnnnntgtctcgaaaaatcccaaaaaaaaaaaaaaaaaaaaaaaaaaaaaaaaaaaagaattctgtcagaccaaagaattcatggttctgaagccagaagtgagcatcccctcccaagtcactccccccgaagcctctaaaagtccctaatggggtagtcggggcccagacctaaaatggatttgataatctaaattaagcgaggcatgatagggtactttttgtaatctcagcactagggaggctgaggcaagaggctgctgagttccaggtcagcccgagttccacagtgagacaagagtctgccctgtgcccagcgctgacctgcctggcaggcagtactgtgctttccctgttagcctcagtgaaagtcgccccagagcagttcctccagcctttccaccagaggtcaggctccaaaacactgggtaagggccactggatgaaccagttctgctgtcagccccgctccccatagtcccagtacacatccgggtaggaagagccccagcggtacttttagggattaagtcttgggtcactcactggcttaaggtgtactctagcctgaagccaaccttaagcccagggccatgctgtggggtcctcgagtgttccccagttgccacccctaaacatcagtggtcacactacacaggtttctgtcctaggtcactgaggaaaactgtgcagtcctgttaactgttgggagggatcagagcagcactaccttagttgtttcaaagcggtcctgggtttcagttccattcctcgtacaagtctagaaatcttgaacgaacaaggcttctcacctacctactctcagttcccccttctaaaataggataacaacataactcatggtggtacgtccggcactgacgggagtgacataagctaagaacacaggaagcgcctggcatggcggtgtccctcacacccttggttcctcacttcacttcccctctctggactcacgctcctgtccagagaggtggagcaggctagaagtagatgccgggactgtggctggcctcaggcccggagggcggcggctacacgccctccttccgatgcggggcggtggctgtgggggcgccagcgggcatcctaggaatgcggctgcgccgctcgggatgggtgaagtccgtcggacccctccacgcgcggattcccctcattccagccgcttgacgcggcggggcgggacggggcggggcagggcgggcactgcggcctcgaagcccctcccctttcagtgcgctcctcccaccaagactcctctggctggagagggagctcaatgaggccgcggtagggggaggggagcgagcccatgctagtgctggggactccaagctctcccacctcaggtcttctaatgctctggggtggactgaaggtcgtatcctctctatgcttttaaacctgggggcatcgtaaagggcgctcccctttgccctgtctttcacccatcttccacctgcagcacccattcccctggcccgctccaaagggcttcgttccccagctggcgccgcacaccacccccacccccgggttgtggctcgagctgttgttcacgaagtaatgaaccatccttccccttgaggccgcaaggcagcacctgtcgcagactcacctcctccccagggagtccccgtccaaggggtggggcgctttggtgctttgggttcttactccccctatcctccctagaccaagtgtataccctcggtatatgcttcaggttccttacaaagggcgaggaatagataaggcacttgagaaccctttgcaaatggtagatataggggcggacgctttcttcactagacaagaagattggactctcccccaagtccctcagtgcgtgtagaatgaaagaggaagagggtagtagtggtgttgatggcttggtcagtgcttcatttcaggcaacccaacaattctggcaagtatcagccaatcggcctcttaaggcacttactcatgatcatcatcctgctagtaagcaaaggccaggctggttttgttgttgttgttttgttttaccgtagacatccatatgccacaagaggtggcaactgacccaaagtccactccactcctctcacacactcttctcgggcctaaaaagggctgatgtcgtcagagaaccagcgagggtgctggacagacaaggaagacagctgatggcctgtgttcagggaagagcggagatccagagggaagagaaagaagggaagagaggagaggagcccatggggcagggcactgagtccggaggatattcaggctggaacataaggttattggctgcacacgtaggaaagtcagaagggtgctgcctactcggcaaacaggcttctttaggggtcatgctgggtcaaaaagggcaccctgctctgaccctaggatttgtttcttagctagggaagagatctttcaagagatgtttctcttctggctctcttggcacaagtttgtaatcttagtactcaggaggctgaggcaggaggcatcttgagttccaggccagattgggctccgtaaagagaccctgtctcaaacaatttcttttctaaggatttaaagaatggagccagtcctttgggagtgtgtatgggggtggacagtgtcccgtacagaggctccgcctgtcccggggcgccggccgtatttggacatttcgttctatttttaactttcccgggactcgaggttgggggtggggagggaaatcctgcttccccggtgacccacgggcttcagccctcgtctcgcgcggggtgtccagccccgtgctgtagacacgagcccggaagtgagttccggagctgtgtagacgcggcggccgcgcgggttccgggccccaccctggaactaacgacgttcctcctggaaaacctgactcaggcggagcccgcggcacgcaggaggccccgcccctcgcgcgccccctcttaggtcccgaaccccctcccacccagcccggccaggccggctgcagtgggtcctagggtcgggactccgagccccctgagccaaggggcctgcaaggggcggtgcagggggcgggctggcccctccctcggttacgccgcggccgagcacagaccaagaggcgcgggcagcggagcggggcgccgggtccggcaggatgcgctaccgggcatcggtgagcatgggcgcgggcaggtttggggtccagggtatctctcggtggcccgcggcgctccagggccggccttgaagcgggcgcggcccaggaatttcggtggaagatgtccctgaaagttgctagaacaggaggccgaggcggagagggctgcagaacgctcgaacccaggaccatgtggtcgcccctggtgatggctaagacccctcccacttgaggaccagggggcgttggctgcggtggtgtttggcagcagcttcgggctgggtgggtcaggggtgggcaggtctgagggagacaggccctggacttgaggggtgacggagaagcagagaactgagcaactagggctagaaaccagggtcaggggagacttggtgacctccctggaatttacagcggctcccagtaccttcctcttccttgacacccccctaccccagcattttctagatctgcaggccctctttgaaaggaaagctctgcttaagacgcggcttgagggtctagctaagcctgtacctgccccacccttgggtggcagctgggtttcccctgggagaaccctccacctcctgaggcttctcaacggtggaggagctgcggggggagggggggcggggggggaagcctagcagctggagaggagggagtggctccagttgagggagggcaggccacccgcttctggggtgggcatcaagtccagctgaggtggtggcccatggggaaaccctctcctaggacgtgagctctggcttgatccctaaacaacttctacttctgggaatttggggtggatgggagttggagagatggcccctccctgtctgcagaattccctctgaaccgtttgtcctccaaagcacctgtaacacgtagctgggatttgaggtcacctgaactaacccactcctgttctctgaagaggaagcagtcctgagaaaggaggaggtttgtccaaggtcaacaccagcattctttctgccgttcctaggagctccttgtcatgtcccaccttcctcaactcaaaatgccactgccctggattccatgcagtcgttcagtgtctgctgggccctttgtgctcctatgggctgtgtgcatggtccatatgtcccatagggtctcttatctgcattccagcatcctgcaacccagccatatgtccggaacatgttctgtagcctgtgtccaaagtgtccctgccttctacatcctgcaggcagggtaggaaacgagactttaacctgcagactctgacagcgtcttgtggctggttcctcacaggccctgggcagtgacggggttcgagtgaccatggagagcgccttgactgcccgagaccgggtaggggtgcaggactttgtcctgctggagaatttcaccagtgaggctgccttcattgagaacctccggcggcggttccgggagaacctcatttatgtgagtgccatgagcacggctgggcccaaggacctaggggaaggtggcagcaggaaccttcaggaaaagcctctgaccctttctcccccacccccccaacccccagacctacatcggtcctgtcctagtctctgtcaatccctaccgagacctacagatctacagccggcagcatatggaacgctaccgtggtgtcagtttctatgaagtaccacctcatttgtaagtgattcccttgcctttccaggagtgacctaccctgtcctcttgcaagatgaccccatccaaaccccactttgaaatgattccctgacccctgggtgactcactggtcactactgagaggaatcccatggttgttcacctatggtcacctcagttctcattagttgaactctgagttctgtccaccaaccaggaccctcagctcctgagctcagttcccatcctgaagtattcctttaactatcttaacatggcccacctgtgaggactcccagcctcattcaagtacccagcttccccatggctggcacctcacttggagtgatcctcagctgggcaggtgtaccctgtgagggcttcccacctgtccacccccttctccatcttccaggttataacccccatattttacaagagtggttcccgtcaggtataggtggggtaccactctgggaactccctgacaaatctctgccccaggtttgcagtggctgacactgtataccgggcacttcgtactgagcgtcgggaccaggcagtgatgatttctggagagagtggggcaggcaagacagaggccaccaagagactgctccagttctatgcagagacctgcccagcccctgaacggggtggcgcagtgcgagaccgcctgttgcagagcaaccccgtgttagaggtgaggagactgcagcatctgaggagaggggtagacaagacaatgccaggcttccctcacattcctgtccccgactccccaccttcaggcctttgggaatgccaagactctccgcaacgataactccagccggtttggaaagtacatggatgtgcagtttgacttcaaggtacctgtgggtataataaggaaggggtgggttagccattcagtgattcaatatttgttgagtgcctactacgtgccaggcactcttccaggtgctgctctgggagcagtgaaatctaacaaatcttgcctcctggagtgataggtgaattattacagaaacataataattaaggccttagcagaaaattaaacgaggtaacaacttcctttttaattagatagtctcgatttgcagtccagattgcccttaaattcctggctgttctgcctcttcttcctgagtaactgggtttacgggagcataccaccacagctgtgtctgcgaagcgactagggagaaggcctcactcagagatggcattgctgtaatgacttggcagactgggaagcaggtgtcccagatgcctgggggaagaaggccaggtaaacgtgaggaccaaggccttgcagaggtagagcccttggtgtgtgtaaaggctacagcaaagccggaagtaggaggagaaagcaaggtgccaggaaaacagagtgagaagccagatacactgagggccttttaggtctgcgcaaaggtttttttttttttctttttgccttggtgtgggaattaaactaaggaccttaagtcatgttaagaataccagctacgatgagagctgagagctatcctcagagcccagcaagaattttttttttttttaactaagtgaaaaggaactatcagagggttttgagcagtcgtgtagtgatgtaactttcctactgaaaaggtcattctggccgtcgttgggagtagatgacagaggaacacagccaagcaggggaaccggttaggaggctgatgtaatgtagctagctgacagatggcatggcggcctctcagatcagggtggtagacgtagaggtgatgagcagaggttggttctgggtgttttcaaggttaaagcagcaggagtggctgttgggatataggaagtaagttggggatgccggggaaggttccaaaggaggactacaaacttccctcttgaatagcttgcaggacagacttgctgctgaccaagatgagctggagttagtgtgggataagaaaagctggggtgcaccgtcaggcttgttaaatttgcagtgcctgccaggcatgcacacaggacttcagaagtggctgagtgtgcgtgcgtgtgcctgtgtgtgtgtgtgtgtgtgtgtgtgtgcgcgcgcgcgcgcgcgcgggcactgtgtgtgtatgcccactgaggtgagagcagctctctcaaccactgagccctattgcggtttcctagatgaacacggtgagagcagagtgggtgcctgagcccacttagccagtggcaaagcgagaattagatcccaggtttactacaggggcaaaagaggaagacagcttctttcccctggtccagctgaccatccctgttccccactctgcccacagggtgcccccgtgggaggccacattctcagttacctcctggaaaagtcccgggtggtgcaccaaaatcacggagagcggaacttccacgtcttttaccagctactggaggggggcgaggaggagactctccgtcggctgggcttggaacggaacccccagagctacttgtacctggtgaaggtaagtgtttggcaggcatggttgatgccacccagggggcacagtgccagtggcagcagcccagctgtgctctttcttccagggccagtgtgccaaggtctcctccatcaacgacaagagtgactggaaggttatgaggaaggcgctgtccgtcattgacttcactgaggatgaagtggaggttagggctctctgtgacccctccccatcacaccccaaatgtacccacttcttttggaccccttttcttttttttttttccttttggtttttcaagacagagtttctctgtgtagccctggctgtcctggaactcactcttgtagaccagactggcctcgaactcagagatccgcctgtctctgcctcccaagtgctgggattaaaggcatgtgccaccattgcccagcttggaccccttttctactcgagcccccttctgctcctgaaggccttactaaccatccctgccctatttgagcatctcctagttgctctgacctcccccaccccataaccaccatgtgccccctgctactacctcaggacttgctcagcatcgtggccagcgtcctacatctgggcaacatccactttgctgctgacgaggacagcaatgcccaggttactactgagaaccagctcaaatatctgaccagggtgagtgtggcgggcagagggcgtgggaggggtgctgaggtgagaggacccagcccctcactatgtccatcccacctttggcagctccttggtgtggaaggtacaacacttagggaagccctgacccacaggaagatcatcgccaagggggaagaggtgagactctgactggccacaggaacaggaggtgtgcgcagtcctagggagccccggcccattattcccctccgcttgtctactcgggggccttcagtagtcctagaggggcctaaggctcagaggggtacagtgagctgcacctctaagaatgaggctgctataccagcttgtccctgctgtcacaaaaagcaccacaaccctcccacttactgaagctcaggaggctgggtggtgagaacgtccttgtctgacgcctgagtctgagggaggtgggacagaagggtgtctgtggcattcatctcctgtcttttcccctgcggcagctcctgagcccactgaaccttgaacaggcggcatatgcaagggatgcgcttgccaaggctgtgtacagccggacattcacctggctggtcagaaagatcaataggtcactggcctctaaggtgagcactcggtccatgctgctttcaaagaagacagggagggtggtcagggagactcgtggtggggagctgggtcagacactggggacccatgctgtctgctgactggccggccctaggacgctgagagccccagctggcgaagcaccacggttcttgggctcctggacatttacggctttgaagtgtttcagcataacaggtcagtcctacgcttttacccctgcccatctgcctgccgatgtcccctgcccctctcctcctctctcctctgtcccttgcccctctctcctagctgtgaccctgctttgcatctctcagctctgctgcttgtacctgatcctgtcctttccccgtccccgctttgtgtccccggcactactgtgggttctcccgctgtccctcagcttcgagcagttctgcatcaactactgcaatgagaagctgcagcagctcttcatcgagctgactctcaagtcggagcaggaggaatacgaggctgagggcatcgcggtatgtgtgtgtcgggggtgccctgcgtgttatgggaagctaggcagtggggctccccggaagagggtacagaaccctatcattggtgcccttctcgttctgtgcagtgggaacctgtccagtacttcaacaacaagatcatctgtgacctggtagaggagaagttcaagggcatcatctccatcttggtgcgtgtcctctgcccctctagcctcctgctaggtgacggttgggaagcctcctatcccctctctccaagtgtgtccaccgggtcagagtgtggggttgggcaggctaagttgaggtgctggcccagtctgcaggctccctaacagggctccctaaactctgcccccttttcctgtgtctgtggctctgtacatggtgtcccctatatttaccacccccgtccagtaaatcctcaccttgtgtgctgccctgcaggatgaagagtgcctgcgtcctggggaggccacggacctgacctttctggagaagttggaggacactgtcaagccccaccctcacttcctgacgtgagtgggctgtgagggctggaggaggctggggtcccgccacagtagcaatgccatggttgaaggcattgctgggtggtagtggcagagggcttgcccaacatgaacagaactccttttagaacggcgcaacacccaaaaccaaacaaaccaccagctacaagttgttcaccagagaaagtagagatggggacagttgtagaaagccaccactggcccttcctccttaatcctttgttgagaatgaaacttgctaagttgtttgtttgtttgtttgtagcttccttatttgtgaattgttttttatgcaagggacctcctacccttaggaggtgggggctgtaggatcagtagttcacagccatcttggctacagagcaaattcaaggctacacaaagatcctgtcaacagaaaaccaaaaagcaaaaggattaacctaaaatgggggagcttagcacacagactgggtgcatgcacctcatctcctagcctacagcaccaaggatacgttcttgtgctccatctaaccaaaatgcagaaaaattcactcatttggtaataataatttagccaggcagtggtggggcacgcttttaatcccagcactcaggaggcagaggcagaggcaggtggatttctgagtttgaggccagcctgatctacagagtgagttccaggagccagggctacccagaaaccctgtctcaaaaaacccaaaataaataaattatatatatacatatatatgtgtgtgtgtgtgtgtgtgtgtgtgtgtgtgtgtgtgtgtgtgtacatatatatgtgtgtgtgtatatatataatctatttagattgtagagcttgggacagtgtcccagggcttttggactcaaaagccttgagcattgtttgcttcaatacagaaaaccaagcataaaacaaaactggttctggttatgctagatggtttatacactcaagaagtagaggcaggggctggagagatggctcagtgattaggagcactgactgctcttctgaaggtcctgagttcaaatcccagcaaacacatggtggcttataaccatccgtaataagagctgaccccctcttctggtgtatctgaagacagctacggtgtactgaaatataataataaataaatatttttaaaaaaaaaagaagtagaggcagggtattgctgcaagtttgaagctaacttgggctaccatcatgctagctctcatccaaataaaaggaaagaaagaaggaagcagacagaatattagagaaaaaaaaatatttatttatttatttttggtttttcgagacagggtttctctgtatagccctggctgtcctggaactcactttatagaccaggctggcctcaaactcagaaatccgcctgcctctgcttcccaagtgctgggattaaaggcatgtgccaccactgcctggctggttttgttttgttgagacagggtctcatgttgctcaggctggccttgaactcactatgtagaaaagaatggccttgaatttctgatcctaacttcccctgcctgagtgccaggattacaggcatgtgctatcataccaaacaacaaattttacttttgattataaaaacaatattgctcattagagagagctggaatgtgtgcagagcctcttgtgaccctgttacccagcggtcattcttggtaacaattccaggcatttccttcctgccttttcctatacatttttttcccaaagtcaggaacttactgagtataaagctcaggataatcttatgttttaagttgttgttgtttttcctgtatcatcaagcagaagaatttcttcaaattatttctttcaaaaactgtgagccatggggacctcacagctctcaccctgccttaagggctcccaaggagcctctccagggttttgatttttttttttttcttttgcggtattgaatatggagggtaagatttcccatgctagtagggcatcctgcagtgagccaccctccaggcttctgctgtaagaacaaggctgccacacccaccttaaagctttgcttgtatctctagttacaggctcaaaatagttcttaaaagtaagaggtgtgatctggagagatggctcagcggttaagagcactggctgcttgctcttccagaggtcctgagttcaattcccagcaaccacatggtggctcacaaccatctgtcatgagatctgatgccctcttctggtgtgtctgaagacagtgacagtgtactcatataaatgaaataaatacatcttttttttttttaaagaggtggtctaagctgggcgtggtggcgcacgcctttaatcccagcacttgggaggcagaggcaggtggatttctgagttcgaggccagcctggtctacagagtgagttccaggacagccagggctacacagagaaaccctgtctcgaaaaccctaaaaaaaaaaaaaaaaaaaaaaaaaaaagaggtggtctaaagggtacaagtgtgtttaaaatataagtaatctcttgggacagtttccattctgaaaatggagaggacagctttaccaccctctaaacagctgagcactggccagcagctgtgacagacaggtcctgagcctgtactgcttggcagcctgagcccaagttcctattcctagctcccggagttgtggatccctggaccagtgtgtctactgttctgagcctctgtgacccctgcagcaagcgtgtgcagtctgccacacagtgtgcaatttgtgggacagcccaggggcctgctggctccttcctggatggcccttaaagtgtcttcaacaggaattgggcatgccccaggtcagaaatctgtagtttcctgctcttgtcatcctcaggcacaagctcgctgaccagaagaccaggaaatccctagaccgaggggagttccgccttctgcattatgctggagaggtgacctacagtgtgactggtgaggatcctgatgccaggtcctgtggggcagggacggggcactccctctggcactttctgaatgttctccctttccagggtttctggataaaaacaatgacctcctcttccggaacctgaaggaggtgagggagacaggcgaactggggtggggtgggtacccacagctctgtgtgcatctctgactttatgctcaaccctgacctgtcttctgcctcacagaccatgtgcagctcaatgaaccccatcatggcccagtgctttgacaagagtgagctcagtgacaagaagcggccagagacggtacggggaccatgacactggaagcgggtgtatgtgactgagtctacatggaactatgcctgtgagcgtgtttgttaacaccgccatctgtgtctgcaggaggttgctctcagggatatctttgcccgtttctttcttccaatttatttatttatttacttttgtatatgaatgctctgtttgtgtgtatatgcctccaggacagaagagggcaccagatcccctgacagatggttgtgagccaccaggtggttgctgggaattgaactgaggacctttgaaagagcagccagtactcttaaccactgagccatctccccagccccttttttccaatgtattacatttatttatttgagcatgtatgtgccagggtgtgagcggaggtcggaagacaacttattggagtccgttctctccagcacataagtcttgggaatcaaactcaagttgacaggcttgtcaggagctgtttttacccgtgagccgcccttctccaaatgtagactgttgtgtgcctccctgcttctctctatagagtacccatggcacccctgtctgtgtggctgctgtgtgtatccgcttagtcagcagatatctctcagctctcagggatcagaaacaactgggtgccctcacaaccaactgtggtcaggaccaggtgctaaatggaaaagtctccctggcctgggggactgcatgcaatgggtgctttgggaacctaaactgcctgagggggtagaggggtctgggaaggctccaaggcagaggcagcatttgaggtaagaggatgagtgcttgtccagtggacctgtaggggactgctgtaggcagcaggagaccagcacatacacacagaggccgagccgagctatagacagtagaggagaggctggggaaggcgcatgtgtcccgtggtgcctgatgcagtggatcttcagcccactgagggcagaggtgctgctattgggctgaaccagaagaggttatcacagctccaagtcaggagggagaaaggaccagatttccaggtggatcatattgtgatggccagccaggaccctgctcctgcttttctgaccctgccctccccatctcctgcctgaacctcttcctcttcccagccagtatctccagtatatcaggacacctccacaccctcccctcccatactctagcatgacttggtttccatatccagtgacagtactccccacctccacccccagccttgttctcctcttcctgactcaggacggggtcactctctacccagtcccccaggccagggacttttcccactctttcattcaaacactgggtgatgcctattcctatgcctaagtacttcttaactccctctcctttgtccctgtaaccactgctccacgtcagtccctgttattgtgcctgtgagccagccaacctcttccctggtttcctggctccccaccggcccctcccaacccatcttccacataaatgctgtagaaatcatctaacatacagatcttgttgccactcccttgctccaaactcttcatggactctctgttttcctaaagataagatctagtctctccagtgtaaccctgctctgacatactgcccctgcctgccttaaatctttgcaaggttgtagttccctgtgtggcaagcctttgcttgccattcatctgcctggactgcctttctcctgttctctcctactgacttgtacaatctcaatttagggtctttttttttttttttttttttggtttttggtttttttgaggcagggtttctctgtgcagccctgtctgtcctggaactcactctgtagaccaggctggcctcgaactcagaaatccacttgcctctgcctcccaagtgctgggattaaaggcgtgcgccaccaatgcccggcttagggtcattttcagaggatcttccctgtgcacttttccttagactgatcagtcgtctcaaacataaggaaggggttggaggtatctcagagatataggatgctctcctaatgggcaccaggaaaaagaagggggcgggctgatggggtgtgatgtcaccaggacctttgaggaggagagctgggtttctaagctgaggtctctaacaggctgaaaggaagtagggtgaactccagtcccttctggtatgaagcaggggtgatgggaggtagtaggggacagaggggacatgcagggttcagtggcctcagcccagctctagccaacctcctatactcctttggttcatcaggtggccacccagttcaagatgagcctcctgcagctcgtggagatcctgaggtctaaggagcctgcctatatccggtgcatcaagccaaacgacgccaagcagccgggtaggtcctctggccccatgagttgtgaactgtgcctctgggatgggaacacttcctctcaggaagagcctaaggaccacctttgttactctccggtcactttgttactttgtttcctctcaggtcgctttgatgaggtgctcatccgacatcaggtgaagtacctgggactgatggagaatctgcgcgtgcgcagagctggctttgcctatcgtcgcaaatatgaggctttcctgcagaggtgggtgtggtcggcccaccagtgaatgaatgaactaggccagtgagcacttcctggaacctgtgagggaggagggacggttgtagctctagtttagagggtgcagagaccctcagctgctgtgagacccagaccaggaatcgttttatgctacaggcctaatgttagtcttggaaaagacaatgtaagtcatgtacacagccccaccctccctgaagcccctggtgagagacacaggaggagcacgttgacaggctgctaccagagatggtgtgatcagggctcagagaggaagttgtggctgtatagctattcagatgacagaacctgagccaaccagaatatgaatcccgtctctgctctaggaagataggaatacttcagtcctccatctctaaaatggggacctcaggcatgtgtagcatgtgccagccagtgggagcaactgtagactcccagcaaatccccttccattcctaggtacaagtcactgtgcccagagacatggcccatgtgggcaggacggccccaggatggtgtggccgtgttggtcagacacctcggctacaagccagaagagtacaaaatgggcaggtaagtagggcctgttcctggggcatggaggctgaaggaggtggcatccagtggctgatcactgctgtcttcccaggactaagatcttcatccgattccccaagaccttatttgccacagaggactccctggaagtccggcggcagagtctaggtgagagagactcgcctttgctgtcccatgggttgcctggtaaatagaaaccactgctttagggcttcctctccaggaaacctacccagccacactcaggtttcttcccccttttgccaccccagcaaaagtcaacagtcaggggggctggagagatggctcagcagttaagagcactgactgctcttccagaggttctgagttcaattcccagcaaccacatggtggctcacagccatctataatggcctcttctggtgtgtctgaagacagcagcactgtactcatatatattaaatgaataaataaatcttaaaaaaaaaaattaacagtcatcccagttgcctctggacacagacgccaaaccgtccctacactcctctgctgtctttcattggctcacctcacacagcctcctctggtgttctttacttaaaccactgaccatgtccggccctcagctagggctctgagctctgacagttcatcttctcccccacccatagccaccaagatccaggcggcctggaggggctttcattggcgacagaaatttctccgggtgaagcgatcaggtgtgggggcgtgggggtcttttggaggggcgggtctaggggtgggatgggccaccatggcgagaagataaaggtcagctatctgtggtatccacagccatctgtatccagtcatggtggcgtggcacactgggccggaggaaggcagccaagaggaagtgggcagcccagaccatccgtcggtgagtgctggggtgccagtgtgtgggaactacagatcaaagtgagtatggggatcttctagtttctcaccccagttgcgtctgaccctccacccctagactcatccgtggcttcattttgcgccattcaccccggtgccctgagaatgccttcttcttggaccacgtgcgcgcctcatttttgcttaacctgaggcggcaactgccccggaatgttctggacacctcctggcccacacccccacctgccctgagagaggtctgtgtgctctccctgctgtgttagggatagtcatcaaagcacttagcctgggactcttcttaccctgtgtcaggagagctggccaggggagtctcagcagggagagaacagagaacaagagatgggttatggaaatgagtttgctggagagaaaacactccacgggactggctggcttgaggggcctgttggggctctttggtgggaagggcaggctggaaaggtggtctgaccctgcccttcacataggcctcagaactgctacgggaactgtgcatgaagaacatggtgtggaagtactgccggagcatcagccctgagtggaagcagcaggtggggaggatgtagccccaagtatttggctgtaggggccctgggaacagcaggcattttgcctggtcaacactgtagcctcaaaagaaggctaagccttcactggacttcatatgggaagtggaggctgcagtaagtttgagggagcagatagaagtcatgttgtgggccggcttgctttgcttggtagaagcttataggccttggttggtccatcttcacactcgggttggtgtcagccattgatgtgccttgtgtttaccaacatggtattgggtgaggaggaccttagctaacctgacaaggcagtcagccacctacaccatcctaagctggagctgcatctcgaggggcccgagggcctggtgggaagcatttttaaacctgacggtttgtcatgactcctggagagttctctgccttgttgagtggggataataggccaggaagagagaagctgacaggggtcttggtgacagggcactagagagctgatgaaggagctgccaggactgccctccaggttgtccccagtcctttgatgctgtgttcttttgtctcttcagctgcagcaaaaggcggtggctagtgaaattttcaagggcaagaaggacaactacccccagagtgtccccagactcttcattagcacacggcttggtaagctcccacactccagcccttgagccttccagcactatcttgtccccttctggccttacctgacctccttttcccctctctccgttgtaggcacagaggagatcagccccagagtgcttcaatccttgggctctgaacccatccaggtaagaacctgctgtgactctcgctggcaccccccaagttctctgccccagggctagaaaaagtgggtcatggccttatcagagggcaaggaagttgtccctacaaccccttaacccctaccctgtgcctcacactgttctttgtctctagtatgccgtgcccgtggtaaaatacgaccgtaagggttacaagcctcgcccccggcagctgctgctcacgcccagtgctgtggtcattgtggaggatgctaaagtcaagcagagaattgattatgccaacctaaccggttagctggagcagaggcctgcatgggtgggaaggagccctgctccaaccatcgctccctgacctctgttctcccctctcaggaatctctgtcagtagcctgagtgatagcctatttgtgcttcacgtgcagcgtgaagacaacaagcagaaggtaccccttcagggcctgggaggcggagggggttctctagccctaaacgaggcttgactcatctgtgcattgcgctccccagggagatgtggtgctgcagagtgatcatgtgatcgagacactaaccaagacggccctcagtgctgaccgcgtgaacaatatcaacatcaaccagggcaggtgaagcacgtgggggtgactcaaggacatagggacaggacaaccctagggggtccgtctctgtaaccaagtcttcatgtgcttccttgcctccagcataacgtttgcagggggtccaggcagggacggcatcattgacttcacatcgggctcagagcttctcatcaccaaggctaagaatggccacctggctgtggtgagtgggagggacctgctgtcttgggtctaaggtagagccattgacaaccaagccctccttggactatgtgtcccctttttcctgttgcatgcccaggaaagtcagaaaggggagttgcttggacccctatggtggccataaaagggtgataataaggaggacaatgggaaagtatgaagaagattgcagggaatggtggtgtgcgtgtgggaggttcactctggcaagcaggtattgccatggaaacagaaaagtcttcaggacctagactcctgtaggactgctaggggaccatctagcctgagcctgtaagcccctgcagctcctccacttactcctgggcttctccccctaggtggccccacggctgaattctcggtgatgaaggcttcagtggacccctcctgactcctgatgcttcgcttagtcccctcctcccctcccagttaccaaagactcaagcttccagacagggatccatggacaccctcaaagcccacctgcaaactcctgcctcctgctcgccccctctcgaggtgatcaggagccagggagctaccccatgagtgggccaggccgggccacagcaatagaaaagcagaggcctgagcaggccaggccagccctctgctgatgccaaatatctaagagaagggaattttaactgaggttttctctgagattttttgatgctttataggaaactatttttttaagaaagccattttcctaccctaaacacactggatgtgtttttccctgcctcgaacagggcaaggaatgtaactgaaagactgactgggctgggctggaaggtcctcttctctggccaagcctctcctcattcccttgtctgtctgtccatccacctgcaccttttgcagcccactatgacctccaccaaaaggctgaggccacctctgcctaccccatattcctgccttaagaatgtccttttaggggctggggtatagcccagtggtagaactggtgctaagcatgtgtgagaccctgggctcaatccccagcattaaaaaataaaaaataggtttttaatattttcaccccagtctgagggcatccctaaagtgggggaaaagtcttaagagtttggaagtcttcagagacagtgtctggtccaggctcctggaatctacagagctggagacagaggcacacagagggagggaagacttgcctagtagaagactgaagcaaatcctaaagtgaagcccgccctcagcacatctcactgcctttcccagggacagggaggcccataaggcaagggtcgcgtctcatgtatgcacctggctctctgaccagcaatcacccttgggagctaccgggtgggagggactcttctgcctgggtctatgccttaggatgacaacctccatacacatacatactttcgacccaatttaagaatggtagggtcttttattggccttgggtgcctctgtgacctgggagcctagggacagggctggccttggaggaactgcaggggcatcacctctttctgctgcttctctccaccccagaggtccttgggtttgcccagctccctctgtgccctctggggctctcagcccactgctgacacttctgcaatccagagaaacactaaataaagcaatatgtatttgccaacacagtcttcctgtgagtgtggaaaaggggccctagaaggtagacattcttaaggggcttggcactacagaagaaaggagacagacctacttaggagcaatagagagaaaccaagttaggtgtggtattgtgagccttagtgctcaggaagcagggacaggaggattggatttcttagttctaggccagcctggtctacaaatcaagttccagggctatatagacaggcacggggctttggatttgggcaaataaatacctggtctggcagcaccgctggactaaggagacctagcatgggcaatataagcccaggggcctgtgctgatgcaagactcaggtggggagggtcagcacttcataaggaagctggtgtttgaggtatctcaggggcttgcttccagttctggggataaagaatccagtccaaagtggctggagcggtaaaggccacttgtcaacaatggccattttattgtcctggggagatctacttctaggtgatcaaaagacattgttaggaaaatgtcttgggggctagagagatggctcagtggttaagagaactgactgctcttctgaaggtcctgagttcaattcccagcaactacacggtggctcacaaccatctgtaatggggtctgatgccttctggtgtgtctaaagggagcaatggtgatgtactcatatgcataaaataaatgaataaataaacaaatcttaaaaaaaaaaaagaaaaatgtcttggatcagttctagacttcatctctgggtaccactgaaggaatcaccccctgacatacacatacacaccccacacacatttgtgaaagccataactgtcagtagttccaggcttttattctatcatgggcagaaaaaccctgtttttgccctaattatttgcaagtcttggagaggatttcactagagtaaatgggatgccctgttccctggtcatcgtagttagaagaacatggtaattggctagccctaggacccattagccagaaggaaagtgtgatccacccccaagagcaaggaccacaagtggtaaagaggtgacctctctgcagaaggagaggttggatattgtaagctggcatctgctcacagctgggcagccagccactaagacgcacacaagagggaggttcatcatggcagacaaaatgtacacgaaggaccaagaggcaaggaaaggaaaggcttagggctgctcactaaaggcacatagggcagacgttctcagagaatgtggtacccagtatacgactgactgttgggccttgatgtcatcttgtggatggagtagatctacatttaataccttccccaacactttttcttcagaaaaaaaaaaaaaaaaaaagaccatagtggtggccattgagatggttcagcagtcagagtatttgctgcccagtctaatgaagaaaccaaaataacctatcagttctatcaatagaaaccatggctcccagaggctgataattatatttgtagtaaatcagtaaaaccactacgcacagcttactttagagtgctttattcttttttttaaaagatgtattcatttattttttgtatatgagtatgctattgctgatacactagaagaggacattagatctcatagacagttgtgagccaccatgggttgctaggatttgaactcaggaagaacagccagtgctcttaaccactgagccacctctccggcccaagaactttattttttatttttttgttttgttttgttttgtttttttgaagcagggtttctctgcgtagccctggctgtcctggaactcaccctgtggaccaggctggccttgaannnnnnnnnnnnnnnnnnnnattcacctagcgattcacctagctctgcttcccggaagttgagtgccaccatacccagtaagaactttaatttgaattcaaagatttttttttcctgaccttgaaagttaatacttagccttaactatctgttgtcctaactttgttccacttgttatctatgaccaaaaccactttaattagcactacaactagcagagcatcccaagttgtgcattgcataacttatgatgcagccctggtgactttaggagacacagaacacacaagtaagcagactgtcctgtctgcctcctgcctctctggcactagagtaagggctggctttcttttagcagagactccaaggctttggtgcactttgctcttggattccatttctctcctccttgcacctgtgcctctcagtgagcttgtgtcctctcttccttcccagccccaactcacaccaggagtccttactttttttttttttttttaacttcaagacagggtttctctgtatagccctggctgtcctggaactcactctgtagactaggctggcctcgaactcagaaatccgccttcctctgcctcccaagtgctgggattaaaggcgtgcaccaccatgcccggccaggagtccttcctaaggaggccttttcctttgtgaggaagtctcaggcttatcaaaaagcaaaacctaccattgtgattgcaatctattggctccttaggtacaaaagaagaggagaaaaagactaaattttccttgttggacaactcctggggctttggaattgcaggttttttttttgttttgtttttttttgtgacaaggaaggtcccttgtgaacagccaggtctcctccctgcttttttttttttttttttttttttggtttttcgagacagggtttctctgtatagccctggctgtcctggaactcactctgtagaccaggctggccttgaactcagaaacgtgcctgcctctgcctccaaagtgctgggattaaaggcaagcaccaccacgcccggcttcctccctgcttattttgcagctcagttatatgagcttgtgtgttttgccatcacatatgtctgtgcaccacatgtaagcttgaagcctgtagaggtcagaagaggacatgggacccctaggaactgcaattcctgatggttggatggttatgagctgctatgtgggtgttgggaatggaaaactcagattttctgtaagaacaactgctcttaagtgctgagcaatctctccagtccagttataatttccttttttatgttgtttgttttacagacagcatcttacttgttaggcctgcctagcttggaactcactatgttgaccagattggtcttaaacatgcaacgattctcctgcttctgttcatgagtgccaaggatacagagatgtgcagacacatgtggtttaggagaaagtttcattgtttttgtcagttaaagatatttaatttgggggggggggctgttgagatggctcagtgagtaagatcactgactgctcttctggaagtcctgagttcaattcccagcagccacatggtggctcacaaccatctgtaatgagatctgacaccctcttctggtgtgtctgaagtcagctacagtgtacttatttataataataaatatataaatattatataaataaatatatttatataattaatatataaataaatctttgggtcaaagccaggaagcagtgtcaactggagcaagcagaagtcctaagaaaactcagttcccagcaaccacatgaaggctctcaaccatctgtacagctgcagtgtactcacatacataaaataaataaataaataagtctttaaaatttttaatttctcagcctggtggagtatgcttcaatctagcactgtggaggcagaggcaggcagatttctgagttcgaggccagcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgctaggattaaaggcatgctccaccaccagccggccgaaatttcttttttttaattttatgaaatatatatgttagtgttttgcctgcatgaacgtctttgtacctgtgggagtcttaggagagggtgctgaacacctggagatggagttacagatgggtatgagctgtcatgtgagtgcttggattcaaatctggttcctctctaagaacagcaaatgttcttaactgctgaactatctctccatccctctgaaaagggtctttcaaaagaagcatgaaggccaggtgtggtggtacacaccttcaagacccttaattctacttgagaggcagaagtgggtagatctccatgactttgaggctagccagtgtgatctacatagtgaatttcaggcccaaacaggtgagcctccatctaaaaattaaaaaataaaaaataaatgaggaaggggagggctggtgagatggctcagggagtaaagaggttttgctgccaagtctcaggtccagagttttgaaccctagtgcctacatggcagaagaaaagaaccaactcccccacactgtcctctgaccttcacacccaggccacacataaataagtaaatacataagtaaataaacataaaaaataacagaatatggaaaacaaaaagatccttgcataggggtgcacacctgcaaccccagcactctggaagtgaaagtaggaggatcagaagttgaaggtcatccacagctctgtagtgaattggaggccagcatataagagtatgcaatagtaaatgaatgaatatgccttcctggggggggggggcaaaggcagactggtgtctgacagtttgaggccaggctaatgtacacagcaagttctaggccacccagaactgcatagtgggaccttgtctaaacaaacaaacaaacaaacaaacaaaccaaatctctctttccttttcacttatcctgggaattggatttgttgtttcccagagtctcttgtaaggtcttgccttgaagctcagctgtcctgaaaagggagagaggatagtcatttgccccaaagggccagaatttacactggatggcttctgctgctagttcctggtgactaagctagatcaagatgagtcactggtaacaaggaaggggcccttttccctgctgtctctcccagggctggcccagactatgggtgggagctctggaaggccggagctattgactaggctaaggataactttggttttgtagtgagaccgggtctcactatatacaaaacacagtagtaacagctatgcaatggtggcacacacctttaatcccagcactgggaggcagaggcaggtggatctttgggttcgaggtcagcctggtctataaagtgaattccaggatagcaagagctatacagagaaacccttccctcccccatttttttattaattttttgagatagatgaagatgatcatgaaggaagtaaaagtaggagatacacctggctacaactgagagttttaaaaaaaatctggctggtggatatgggagccccaatagagagaactccattttttttttttttttttttttggcctggctgggcattttgttttctttgccttgagtacccttccccacttcatttaacatcctaccattcaccctaggtcatcttatctgtggaccccttcctcttatttgttttggttttataatacagggcctcagactcacagggatcctcctgtctcaactcctgagaggttgggataactgtcatgagtcactttacccagcccttgggtctctccaggactacttagttgatttccttgtgtttctgccccccccccgcccccatagcagatgttgtttcctggtccctcccataggtgtgtgaattcagtgacttaaagccagtctgggtcagcactgcacctgcgcggcaaatgcggtatctgtggctgctcatagataacaagaacttcagctgacctcgggggaaaccgaaggaaacacggggaaaagaccagcaagtcagggagctttgagggcgactatcatcctcggaccacatcatcttttttaacttcagtccttttcttggtgttgctacttgtaggttctgggagaaaagaccggccgctaccaatctgtcaaacacggatcagtcaatttgtaggttgaggctccgccccttagacctagactccgcctccccatcctccgcggttggggtctgggcctggcggcgacgcccaggacgccgcatgcgcactgagggccccaaggactccgtttcccttctcccaatggcgggcgtcggtccccttcccggcagcctccctcgggtagagggcgcgtcatttccggtggggaaggcccgcggccgccgccgccatttcgggcgctgctgggaggctgacaccggagccggtccgctgggcggcgggcgccagggctggaggggcgcgcgtgccggcggcggcccagcgtgaaagcgcggaggcggccatggcgggcaacttcgactcggaggagcggagtagctggtactggggccgcctgagccggcaggaggcggtggcgctattgcagggccagcggcacggggtgttcctggtgcgggactcgagcaccagccccggggactatgtgcttagcgtctccgaaaactcgcgcgtctcccactacatcatcaacagcagcggcccgcgccctccagtgcctccgtcgcccgctcagcctccgccgggtgagggacaggcgggtgggaggcccgggcgggggtgagggccgtagaaccctggtctgctgcaggagggacgtgggcagagagggctagagtgaacctggcgggggagctgtcttctgagcaagctggttcccaccgatgagcgggattgtgggggaggaggagctgctcaccgaggcctctgggtgtgccttgggagccggggaaggggaactgctgcggccccggggtggggctgggcgccagggtcaggcccaagggcagggcagggctaggcaacttggggacaatgagttaatggggatgttacggggacatcatttggcagtggtactcagaatggctctgctaatcctacaagtggcttttaggcttgaaacgtttcctgcagtgttagagccgggtttggccatactcccctggtggccttcggtaggaagtcaccacgtactgactggctggctgggagggatggagacaccctcaggaagccggtcagctttttcctttcttgggcatttttccaaaatatctttaccgtgctcttcccttgtggaaggtggtgaactaagtgacttggtgatagaaaaaaaatccttctgtgaccagccccgcgtaattgaagcctagcaggcaaattgtgtccaagaggttttaagtgtccaaaaaaactgcccgctgcaactagagtttctagtttcaaagtgattagtggaggaagatttttttcctttagaaaacaaacaaacaaacaaacaaacaaacaggcataagccagtgagaacaaccttggaagtgaatggcacttcattctccctggatttacttaaaaagtgtcagacacgtacttctgggtcttttcttgctctctaagttggtgttgtggtcaaaatcttccaggatatgagaacagacctggctagcagataaacaccaagaataattatcccactgtttcctcgtcaaggaccattgagttttaactgtcttagctgtcttattgcagttgtcttggcaatgttaagggaattcatgcacttagcccttgacgtttatgagatgaacagtgattctgagatttctgttgtctctgtgtataacagcaccaagcttcttgctttctggatgtttgaagtgtaagctttttccttctagagctgagctagtctcatgaatggagactcactggttagccttgtagcagacttgcatttttgggatagctctaatttagatttactccctttggccacaaagtgggattcgacggttctttgtgttagcacacaagttaaggggaaaatttgagtattgaagtctttttagttaacagatatagacctttctacgtcttgttgttttttttttttttttaagatttatttattatatgtaagtacactgtagctgtcttcagacacaccagaagagggtatcagatctcattacagatggttggaagccaccatgtggttgctgggatttgaactcaggacctctggaagagcagtcagtgctcttaaccatctccagccccttgttggtttgataatataaaatcagataggaatattaatgcaacacaattgccctaaacaaagtaaattctatatttgtgctatctgtaaaataatctattgttttgtgctaagtgcaatagtaagatgaaatagtaagatgaaattcaattctcatccagatttcatagttcatgcttctaatcttggcacctaggaggctggtgcaagaagatttttaaaagttccaggccatcctgggaaacttagaaagactgcctcaaagtaaaagttatgtgaagggttgtgactggggatctagttgagtggtagtttatttgcctggcatttgggcaggctaggttttattcccaatagttgggggtgagggattcagtcctctgctttctctgtattttattagaaaatgtgggaaaagcattaggcaggcttattagtttaatagttctctatacctgggcattgtggttttatatctcagtagctccaccttttcaaaat

SEQ ID NO: 92 - DNA, 3111 bp, Mus musculus
ttcgagtgaccatggagagcgccttgactgcccgagaccgggtaggggtgcaggactttgtcctgctggagaatttcaccagtgaggctgccttcattgagaacctccggcggcggttccgggagaacctcatttatacctacatcggtcctgtcctagtctctgtcaatccctaccgagacctacagatctacagccggcagcatatggaacgctaccgtggtgtcagtttctatgaagtaccacctcatttgtttgcagtggctgacactgtataccgggcacttcgtactgagcgtcgggaccaggcagtgatgatttctggagagagtggggcaggcaagacagaggccaccaagagactgctccagttctatgcagagacctgcccagcccctgaacggggtggcgcagtgcgagaccgcctgttgcagagcaaccccgtgttagaggcctttgggaatgccaagactctccgcaacgataactccagccggtttggaaagtacatggatgtgcagtttgacttcaagggtgcccccgtgggaggccacattctcagttacctcctggaaaagtcccgggtggtgcaccaaaatcacggagagcggaacttccacgtcttttaccagctactggaggggggcgaggaggagactctccgtcggctgggcttggaacggaacccccagagctacttgtacctggtgaagggccagtgtgccaaggtctcctccatcaacgacaagagtgactggaaggttatgaggaaggcgctgtccgtcattgacttcactgaggatgaagtggaggacttgctcagcatcgtggccagcgtcctacatctgggcaacatccactttgctgctgacgaggacagcaatgcccaggttactactgagaaccagctcaaatatctgaccaggctccttggtgtggaaggtacaacacttagggaagccctgacccacaggaagatcatcgccaagggggaagagctcctgagcccactgaaccttgaacaggcggcatatgcaagggatgcgcttgccaaggctgtgtacagccggacattcacctggctggtcagaaagatcaataggtcactggcctctaaggacgctgagagccccagctggcgaagcaccacggttcttgggctcctggacatttacggctttgaagtgtttcagcataacagcttcgagcagttctgcatcaactactgcaatgagaagctgcagcagctcttcatcgagctgactctcaagtcggagcaggaggaatacgaggctgagggcatcgcgtgggaacctgtccagtacttcaacaacaagatcatctgtgacctggtagaggagaagttcaagggcatcatctccatcttggatgaagagtgcctgcgtcctggggaggccacggacctgacctttctggagaagttggaggacactgtcaagccccaccctcacttcctgacgcacaagctcgctgaccagaagaccaggaaatccctagaccgaggggagttccgccttctgcattatgctggagaggtgacctacagtgtgactgggtttctggataaaaacaatgacctcctcttccggaacctgaaggagaccatgtgcagctcaatgaaccccatcatggcccagtgctttgacaagagtgagctcagtgacaagaagcggccagagacggtggccacccagttcaagatgagcctcctgcagctcgtggagatcctgaggtctaaggagcctgcctatatccggtgcatcaagccaaacgacgccaagcagccgggtcgctttgatgaggtgctcatccgacatcaggtgaagtacctgggactgatggagaatctgcgcgtgcgcagagctggctttgcctatcgtcgcaaatatgaggctttcctgcagaggtacaagtcactgtgcccagagacatggcccatgtgggcaggacggccccaggatggtgtggccgtgttggtcagacacctcggctacaagccagaagagtacaaaatgggcaggactaagatcttcatccgattccccaagaccttatttgccacagaggactccctggaagtccggcggcagagtctagccaccaagatccaggcggcctggaggggctttcattggcgacagaaatttctccgggtgaagcgatcagccatctgtatccagtcatggtggcgtggcacactgggccggaggaaggcagccaagaggaagtgggcagcccagaccatccgtcgactcatccgtggcttcattttgcgccattcaccccggtgccctgagaatgccttcttcttggaccacgtgcgcgcctcatttttgcttaacctgaggcggcaactgccccggaatgttctggacacctcctggcccacacccccacctgccctgagagaggcctcagaactgctacgggaactgtgcatgaagaacatggtgtggaagtactgccggagcatcagccctgagtggaagcagcagctgcagcaaaaggcggtggctagtgaaattttcaagggcaagaaggacaactacccccagagtgtccccagactcttcattagcacacggcttggcacagaggagatcagccccagagtgcttcaatccttgggctctgaacccatccagtatgccgtgcccgtggtaaaatacgaccgtaagggttacaagcctcgcccccggcagctgctgctcacgcccagtgctgtggtcattgtggaggatgctaaagtcaagcagagaattgattatgccaacctaaccggaatctctgtcagtagcctgagtgatagcctatttgtgcttcacgtgcagcgtgaagacaacaagcagaagggagatgtggtgctgcagagtgatcatgtgatcgagacactaaccaagacggccctcagtgctgaccgcgtgaacaatatcaacatcaaccagggcagcataacgtttgcagggggtccaggcagggacggcatcattgacttcacatcgggctcagagcttctcatcaccaaggctaagaatggccacctggctgtggtggccccacggctgaattctcggtgatgaaggcttcagt

SEQ ID NO: 93 - protein, 1031 aa, Mus musculus
RVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHVFYQLLEGGEEETLRRLGLERNPQSYLYLVKGQCAKVSSINDKSDWKVMRKALSVIDFTEDEVEDLLSIVASVLHLGNIHFAADEDSNAQVTTENQLKYLTRLLGVEGTTLREALTHRKIIAKGEELLSPLNLEQAAYARDALAKAVYSRTFTWLVRKINRSLASKDAESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKPHPHFLTHKLADQKTRKSLDRGEFRLLHYAGEVTYSVTGFLDKNNDLLFRNLKETMCSSMNPIMAQCFDKSELSDKKRPETVATQFKMSLLQLVEILRSKEPAYIRCIKPNDAKQPGRFDEVLIRHQVKYLGLMENLRVRRAGFAYRRKYEAFLQRYKSLCPETWPMWAGRPQDGVAVLVRHLGYKPEEYKMGRTKIFIRFPKTLFATEDSLEVRRQSLATKIQAAWRGFHWRQKFLRVKRSAICIQSWWRGTLGRRKAAKRKWAAQTIRRLIRGFILRHSPRCPENAFFLDHVRASFLLNLRRQLPRNVLDTSWPTPPPALREASELLRELCMKNMVWKYCRSISPEWKQQLQQKAVASEIFKGKKDNYPQSVPRLFISTRLGTEEISPRVLQSLGSEPIQYAVPVVKYDRKGYKPRPRQLLLTPSAVVIVEDAKVKQRIDYANLTGISVSSLSDSLFVLHVQREDNKQKGDVVLQSDHVIETLTKTALSADRVNNININQGSITFAGGPGRDGIIDFTSGSELLITKAKNGHLAVVAPRLNSR

SEQ ID NO: 94 - DNA, 47882 bp, Homo sapiens
  misc_feature (1)...(47882): n = A,T,C or G
ctgtggtcagggcttggggaagacccttacatgacagcatatatgggctccaaaccatcacagggaagttagggagggagaatgctttgaaagagagaacgtgcatttgtgtggttcattaccaagtttgtttgtttgtttgtttgagacggagtctcgctctgtcgcccaggctggagtgcagtggcgcgatctccactcactacaagctctgtctcccgggttcacgccattctcttgcctcagcctcctgagtagctgggactacaggcgcccgtcaccacgcctggctaattttttgtatttttagtagagacggggtttcaccatgttagccaggatggtctccatgtcctgacctcatgatctgcccgccttggcctcccaaagtgctgggattacaggcgtgagccaccgtgcctggccctatgtttgtttgtttttttcttttttttttttgagatggagtcttgctctgttgcccaggctggaatgcaacaatgcaatcttggctcactgaaacctccgcttcccaggttcaagcgattctcctgcctcagcctcctgagtagctggggttacaggcacatgccaccacgcctggcaaatttgtgtgtgtgtgtgtgtgtgtgtgtttttagtagagacggggtttcaccatgttggccaggctggtcttgaactcctgaccttgtgatccgcccgcctcagcctcccacagtgctgggattacaggcgtgagccaccgtgcccagccccattaccaagttgtaagcattgctaggcacctgctgtccaaggcagattcagggacgcagtgtctgtggtctctgggatgggaataccacattccagtgccctctgaacactccttagaagagtgaaagattggaaatgacccaaggagccaacaggcagaccagggttagtcaaagttaccgcttcgtgaccacccccttgacgccctttaatttcattactgctctttgaagtaagtactgttatcaccccgtcttaacagctgaagaaactgaggcttagagaaatgaagtcacttgcccaggggcatacagctctcaattaacaggacggacccttcccccaactggtctctgattcaaaagtctgagctcaccactgtaacgccattctcctcagttgctagaatacttactcttttactgttgaagggacaccagtacattgggaacatttatttaaaatagcagttgaataggccaggcacggtggctcacgcctataatcccagcactttgggaggccgaggcgggcggatcacaaggtcaggagttcaagaccagcctggccagcatggtgaaacccagtctctactaaaaatacaaaaattagctgggcatggtggctcaacgcctataatcccagctacttgggaggctgaggcaggagaatcgcttgaacccgggaggcagaggttgcagtgagctgagattgcgccactgcactccagcctgggcgatagcgagactccgtcttaaaaaaaaaaaaaaaaaaaagcagttgaataaagaaggagacaaaaatagtgtttccaactgcgagtatatggagctgtaaacattaagattagacggacatttttgagggacgagcttcagcttgggtttttagtaagtgtacctggttattgagtacctgtgtgccaggatctgtgctaatgctgaggatacacaggacactccaacagctaagtccttgccttcagggcttacacctaagtgacatgctgagtgggaaacagaaaattgcaatgtagtgtaatcgtataatactggtataaaatgtttcagtggccgggcgcggtggctcacgcctgtaatccagcactttgggaggccaaggcgagcagatcacgaggtcaggagatcaagaccatcctggctaatgcggtgaaaccccgtctctactaaaaatacaaaaaagttagccaggcatggtggcaggcgcctgtaatcccagctattctggaggctgaggcaggagaattgcatgaacctgggaggcggagcttgcagtgagccgagattgcgccagtgcactccagcctgggcaacagagcgagactccgtctcaaaaaaaaaaaaaaactttggaagcaaaaagctaatgtctgggatggtttcggcaaaggcctctccctggtgaagaaaggtgttccaggcagcaaatactgcaaaagcaaaggtccagaggcttgagagagtcaccaaggtggagtgggtctggggaagtggtgtgagatgaaggatggggtggtcagactcctgagccccttgaaagccctacttggggactttaactttattctggaggcagtgaagatgccttaaaggttctaaaatagccgggtgccctggcacatgcctgtggtcccagctggtcaggaggcggaggtggggggttgcttgaagcccaggcatttgaagctgcagtgagttaggattgtgccaccgcactcagcctgggcaacacagcaagaccctgtcgatggattgatcaatcaataggtaggtagataggattcaacacagtgagacctgtcgatcgatcaatagatgagatagagtgtgtgagaccctgtctatagattgattgattgattgatccaattaggctttattactctgggttgattcaagaaaggagattgtccatgaagggggtggaacccagaaaccgcagctgtcctgctcccccgccacacacacaccccacctccaggagtcagagctgctggtctccaggagggcagggcctcaaggacaaggtggccttagaaactgccacagtagttgcttcggaaggctgggttatgggtcagagactcgtctttggtcaacttcagttacctagaggaggaatgcattttgtctccggagcgtattaccttttccaaacccctcagggaaactggcaagtgaagaacaggtgggaggtctctcagtcgactcctttttttttggagatagagtcttgctctgtcgcccaggctagagtgccgtggtatgatctcagctcactgcaacctccgcctgccagcttcaagcaattatcttgcctcagcctcccgagtagctgggattacaggcacctgccaccatgcctggctaatgtttgtacttttagtagagagtcaggatggtctcgatctcctgacctcatgatccacccaccctggcctcccaaagtgcttggattacaggcgtgagcaccgcgcgcggcctctcagtcgactcttgagaggaaatcataaaggccagtgtgcatggcgagctcgttttgcaccaagcactgtgctaaacattttatgtactttatctcattgactcatcctagcaacccttcatggtaactactgttattccctccactggcaggcgaggaagttgaggcctgagagaggttagtttagtttggtggttaagagcacatgctctgtggtcatgctggctggccctgaatcctggctccaccacttagtaccttgtgactttgggaaaggtgcttcccctctaagctaagtctcagtttctccacctgtaaagagagcatgatacacccaggcacagtggtccatgccttctaatcccaacactttgggaagctgagatgggaagatcctttgaggccagcagttcaaaactaggctgggaaacatactgtctttacaaaaaaatgtttaaaaattagccaggcatagtgccacgcacttaccgtcccagccactcaggaggctgaggtgggatcgcctgagcccagtagtttgaggctacagtaagctgtgatgtcaccactgcactccagcctgcatgacagagcaagaccctgtctctttaaaaaaataaaattaaatttaaaaaaaggtgtggtaacagtactgatcacaggcatcctctggtaagcatttcctaaatgcttcccttccctttcctgaggcatacttctagtatgcagggcagccaaatacaagctcaggtgtgtccagcctcagaatctcaaacctcagctgctttgatccactgctgcttttgctcaagaaagaagcaaagctttgaaatggaatgtttctgagtcacaatttgatccataaaaacatgagctagacatacagagggtcctggctaagtctgacaagggctggcatactttggattctgttaggcaccttcctgcctgctgccttgctccctccggctctggccccgggggtctgtggctgccagtagttgctggagttaggggctccagcaagctcatgtgggctcatttctgctcttagccaaccctttcttctttccccattcttcctctttatgccccctgcccctgcagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggaggtgaacttctgggctgcctgatacttgccagaggaatagctatgctggccacatccccaagccctccatccctggattcgaatgtcagccagtcccccaggggagacctgtggaggccatgattgcctttcctgccaggtcggatatcccagctcctcttaggagccgttgatggctctgtctgtcaaaaccgtgttcaaaccctttgtgaaaaggtttccatttcctttgggtattctcccttggggctaatgagttccattaggcttattacccaatgtgagaagtaggacttcttttatttgtcctaaatctatctggatcaagttgcaacgggcgctccctccatccctgcgtccttgtatcttgctatctgaatgaccaaggtggtgttggcctccttcaggctgctgcccctcagccttcacgttttcatacaggtttactggcgtgtgtgtgtgtgtgttagggtctcgttctgccgcccaggctggagtgcagtggcggtatcatagctcactgaagcctccacctcctgggctcaagtgattgatccttccacctcagcctccctagtagcgggactacaggtgcacgccaccacgcctggctgttatgtattttttgtagacacagggtttcactatgttgcccaggctagtctcgaactcctgggctcaagtgatcctcccaaactgttgggattatgggtgtgagccaccgtgcctggcccccgctggtatctgcgttgtgttcttgcacgttcacagctgttctcaccagagcatccccccatgtggggctttgggtcagataaggcgggaggcctgagagcagctgcctggccgcctccttaagcctctcagccgtgcctctgctctccgccattcctaccccccagcgctgggccccatgggattccgacagggccagccacccgccgactggtgttcggccctctttcctgatggccagccaaggtccgttggagcagcccagtggagttccatgcccaccccctctgggtgccccaccttccccactatgttggaagggcacagtgaggaacacttggcctcagaggagggaatgatgctgcgagattcagcccccttcccacccccgtgtctagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtgatgtggtggcaaggcaggaagtccatcagcgacagcccctggttcatccttcccgagggctcctgggagctgggcagatgctgacgaactcaccctcatccaccccagcggttcttctgtagctaaaggctggcagtgaagggcggcggggaggcacacagtacggtagccaggcccagcagggagaccatctcttccttaggacttgccttaggtcccatgtcctccctgaccactgatggcctgactccccctcacaggtggggctgcgggacgttaatgactacgtgtcctatgcctgggtcggggacagcaaggtctcctgcagcgacaacctgaaccaggtacgtcaccagcaccaggtacatcaccagcaggcaggcctgcctcagcactcctgtcttgtggaaggaacagagtgctgaataacttgtcactcagagctgggtggagcccagagccctggagctgaccccagtcctgtccatccccctccaggtttacatcgacatcagcaatatccctaccactgaagatgagtttctcctctgttactacagcaacagtctgcgttctgtggtggggataagcagacccttccaggtaagcagtgctggtgagggaaggggaagggtgagggcttgagctcatcactggctccctgaggcccaggcctgggagccagccggtacatgaggggccgctgcagtgcaggaacgggggtgatggaaagcacggaggaagacccgctctccatttccaccacctgctttatccctgcagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagtcattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttacacttgcgtgtgactgatgattggggggtgggggtacggtgatgggcctgggactagctgtagattccaggaacagggaccctgtagatcccaactagacttctgtgtctgagatttgcagaagtggccaggactggggctaggatgaggttctagaatggtgagcctctggggccctaaccaggtggagcatgccatctatgccggtggccgcttaatgtactctgttaagtcaaatgagctcttgttcatccctcctgacccgctgctctgcataccctggtgttgagccttctgcctgcgttaaccagtccagaatgccaccatcttctctttctgccccacttctcctcagccccttcttgctgagttttcccccatggtaacctatccctgcccccaacacatatacctagggacctccaaagccctcacttgcccacctgttccttctcacatgcacagccatcacgagggttactgcatggcacccttcattgggcagatgggaaagccaaggctcagagaagtggtacagtctcttcaaagttccaggcacctgtggtttcccacaggaccagaaacaggaatggggtctgaacccacccgcagagcggtctcagtagtctgtaaaatacagatgatgtccctattctcaagattactgtgggagaacaattgcagaaagtgtatcgcactagacccgcctccccgttctgattaatgcggccccggggcttgaccccaggggtccccccacatgctcacctcccccgtggtgaactgaggtcgccacacacccagcctcctgtgtgggaggggtgagcccagcagtgattgagaggcggaaaggggaatggggggtgctctccgtcctctgggccccagtcaggatatggccgttctgggtccaccccgacccactgggtggaaacaggaaataagtgagacctggtgtgcactgggtctacgcctggctccacggctgataagggccattgtgtggccgccggggatgagcctgctctggatagatgtgcttcccggaggaaggaaggaaggcttgctagcttttccggggcgggggaagctgtggggagagagaagggtgccggggggaaggcccctgcctatggggctgtcggtgccagcacacacccacgggactcagcccttcctatgccagcctctccctctggaaaggtctgtttcccctatccacttccctgttcttacttcctataaggaatggctggagactggagggctcagtctcaggccaggaaagtgtcagctgtgatttagcaacaataaaaatagaaaagcaggaacatcaggggtgggggtcacctgggggtactgttgaaacgcaagggatgaacagggctagaggttgcccacacccagggaacccaggaactaacctcacaagctctgaggctcagaggagggtaagccaagagcttcctcacagcgggacagccccctgtccgggccctgcatgaccaggccccagcagccctggtctctcaaactcatggtgggggctcacctgctgtggggggcagccccgttgaggggatgtgcaggaaagccagtgcctactaacgggtcctcttggcctaggggagggcatgccgtctggtttggggagtgggccccgtgctctctaggtggtaccagagagtgggcaggaggaggggcccagccatagagctgccgtggggatggggggaaggggaaaggcgtcctagcctttgacctggagcccagggtcccccatgggtggctgcatcggctcctctggttacctgggacaacaggcatttcctccatccccagcccctcctcttcctgctccaaccatccgggccaagaggcctcccagtcagacctggacggctccagccgtgtcctgaggagctggaccagccacatcccctggggctgcagttgaagcagaaccaagtggccatcccggcgttagaccgtaggttcctggtcccggagtggtcggagcccgccagtgggcaggcagctcttgctcacaggccgcggtgcccaggccgctggctctccgcagggcggaatggcgctgcaagtggagctggtacccaccggggagatcatccgcgtggttcatccccacaggccctgcaagcttgtaagctgggatgctctgggctgggaggagggtgggagcgtctccccaaggccgggcagcccctctcaggcgagccctcgggcaagagctgagcagcggggaggggttccgatccttggcggggccagaacagactgaacaagacggggtgagtggaagagtaaggatgcaagggccactagcagcaggatttttggaagtggaggtctgggcttgactcttccccggcttcccgaacctcagtgggcagaaccgtgaatactgggcacaaaaggcaagtgccggctgctgtgaggtcgaaggaccagggcatggaagctccaggctcagtcaacgccccgctcctctccagtccgcagggctgggaccgcccaagactcagaacagaaggacggtgtgggaggtgggtgaagggtcacgggtgggtagaaacgggggagcgcggccctggcccggcccgcaggaaggggctggagatgcaaagggcccggaggagggagaaagtcgggcgcccccacgcccccagcagcgcggcggggagccgggtcttcggccggaggggcgcgcgcgtgttcgctgtggccccgggaacgggccgaggcgggggccgcacgcaccgaggcttcgcggacgcggccggggctgaggcggggcggggcggggccggagggtgcgcggccctgcccgggatgacgacaggctgcggcccggcccccggcgggccctgggcggggagagtgcgcccgggccgcggatccccaagcccgccacgccgcccagcccggccccgcccgcgccggaagagccacgccggtgggtactcggggcgcggggacggcggccgcggggggcgggtgtggggagcgggcggccgggccgggagcccccgtgcacgaggcaggggtcacggccggggatcgctggggccgaagaacggccgcgtggacccgtgcgggggggggggggtcccacgacccggaggcgccggcgcagcctggtggagacttagatttacctgcggggagcgggaggcggggaagagcggcctgggctgcaggacccaggaccctgcgcgcccttcgggccccgcccgcagccctgctccgctctgggttccggagaagccgcctaaacccgccccttcccgttctccgcccctggggcccagcgcgccccgagtgtgacgggcggggggctccggggtggccggagaaggaggatggccacgcggccctcagtcctcacgctccggcctcccgcgcacacgcctggctttgagattcattcattcatccaggggtccgggaaggggtgactgagccccaccgtgtgcctcgctgcgtgtagggagtgggagccctctcctgggagggactgacaaggaaacagctgattcctgcggggtgcgataaggaggcgctgcgtgtttgggagaatcaggaaggggttctggaggaggtgacacctgagccgagtctcagtgaggtgggcagggagagtgccccgggctggggaagccgcaggtgcaggcactgaagcttggactggctggcgacggtgcgaaggccccctcctggggggaggggtggggggagaggggactggagcgggccatctggcacatcggaatgcaggagcagtggggtaaactggggacagcaggggggtctcgggagttcataggcagggtcctggtaagcagcagtgagtgtgaatcatgggcctggcatatggagggtgtcctaaaccttcactctatgaacatgaggtgttgatttgatttgtgttgccccagaggaaatggattggtaggaggaaggcaaggaggccagttaggctgctgtcttggcccaggtaaggagcagtgatggaggtgaggtttttgtttgtttttgttgttgttttgttttgttttgagatggagtctcgctctgttgcccaggatggaatgcagtggtgcgacctctgctcactgcaacctccacctgccgggttcaagctattctcctgcctcagcctcctgagtagctgggattacaggtgtgtgccaccgcgcccagctaatttttttttttttttagtagagacggggtttcaccgtgttagccaggatggtctcaatctcctgaccttgtgatccacctgcctaggcctaccaaagtgctgggattacaggcctgagccaccgcgcccggcctggaggtgaggttttagcaggtcgtgactacttggtgtgaggagtggaggcaggagagcaggcctgttaatgccaggctgtgatgaccagctcaaacagtgccacccttctctctacaaggacattaaacagggagtacaggttaggggtcaaaggccctctttttttttttttttttttgagacagtgtctctgtcactcagtctggagtgcagtggcatgatctcagctctctgcaacctcttcctccaggattcaagcagttctcctgtctcagcctcccaagtagctgggattacaagcgtgtgccaccacaccctgctaattttttgtatttttagttgaaacagggtttcaccatgtgggccaggctggtctggaactcctgacctcaagtgatcttgcctgccttggcctcccaaagtgctgggattacaggcatgagccaccgctcctgggccgtttacttttttttttcccccatacaaatttatgttaacatgttatgggtttattgctttgtttctttgtttgtttgacactgggtcttctggggtacccaggctggagtgcagtagcaccatcacagctcactgcagcctcaacctcttgggctcaagcaatcctcccaccttagccttccaagtagctgggaccacaggcacacaccatgcctggctaactttttaaaaaaattttagtggaggcaggggtctcaccactatgtggcccaggctggtcttgaactcctggcctcaagcgatcctcccacctcggcctctcaaagttctggggttacaggcgtgagccactcactgcaccttgcctctgttcacgtttgctggaccccccaggcagaggtgtctggcagccaaagatccatggttgtgtagctagaatggacagtccttgaccaaggccctgtgagcaatcagggtagagaccctaagtcgccactatctcctccccatttcccttcacaacaattccctgaggtctggaacggtccttggtgggcagccaggcccagatctaagatttgtttaataaacagaagttgaagccctgctctgtgccacccgtgagacaagctgtggctgcctttctgctgccttgggctcagtggacatcggtttatagcagcagtcccgggtgcctcagatgacacctcctcccagcccccaacacccctaccccacggcaagatctgtgtgcccttaggctgggggaacatttgagctttccgctgtccgcagaagtcaggcttgtaggcacctggcctataggagctgaagggcactagatagcccaggtctgctgggccaccccatcccctgtggttccagtaaatgcctccccaggtgggagaagacccagaggcagccttggggaagaagtctcctatgtcactcaggggccatggcctgcagggaacctctaggcccagagccaaaggccctggcccactcctaaagcccacatgtgacataatagaatcacacgacaccgacaggggcctgaacggtgtcactgaaggtcacagccctggtagccctgataaccgcacaaagaggctcagggcagccctgcagtaaggtgttccagtgcccgggttccagtcccactcctcctgagaccttgcacaagtcacctgcccagcctcaagttcttctgcattggagtgatgatacggacctcacggcttggctggcgtcactgaaaggagtaacccaagaaagcgcggagaacgcaggaggcgcctggcgctgcagcctcagccgcggcgtctttcccacccaggttccccgcttccctccccgcccggggctcgcgcttccgtccagtgaggaggggcaggccgggggttgccagtgctggagccgccctggggcccgcgagcggcggagacgccccctccttccgccgccgggcggtggctgcgggggcgccagcgggcatcccgggaatgcggcggcgcggcccgggaactggaagaagcgggcccgacccctccgcgcgcggattcccctcattccaaccgcgtgacgtggaggggcggggcggacactgcggccgcgaagctccgccccgtcctctggccgcgcccccgctggctcctgccacgcccccggcccgagtcccccacgcctcgcggggcagggagagagctgagcttccgggaggggctctcttgaccctctaccccgtcttctaggacgttccccacccctgggcgggctggaggctgggtcgcctccttgctccctctagattttccttgttctgttttgtttggagacggagcttcgctctgtcgcccaggctggagtgcagtggcacaatctcggctcactgcaacctccgtctcccgggttcaagcgattctcgtgcctcagcctcccgagcagctgggattacacaggcgcccaccaccacgctcagctaatttttgtattttctagcagagagggggtttcgccatgctggtcaggctggtctcgaactcctgaactctgatgatccgcccgcctcggcctccgaaagcgctgggattacaggcgtgagccaccgcgcccggccctccctctagattttaaacctgggggcaccgcagcgggcgtctcctcccgccctcccccgcctctgtccgagacgccgccattccccctcccccgctcccactcccccaccagctggtgcccccgctcgggggtccccagggccgccgctccggccgggttgttgcagtgacgagccttccccgcaaggatccggcccgcacctgccgcagcctcgccctctccccagggagcggggtccgcgagctgggggtggggcgctggggctttgggttcccgctctgcctaaccccaccagggcgagtctgtgtacgccgttgtgttggtggaggaggcaggtgcctgcagacgcgcctgaggctctccccaccggatcggaagcgtggcccacggcctggctctcagtaggcctctgcccgcaagcaagtgaggaatgagcgtccggccgagggaaggcggcgggtgggggcagcgaggtctatagggggtctggaggtgccttcacgctctatctcaggccacccaacggcccttctaggcctgtgttagcctcatgttagggatgaagaacagaagccgaaacgttaagtgacttgctcagagtcccaccgcgaggaagaaccagcccagccttttgcagactctagacgtccccgcccctgcccgcggtgggatctgagccaaggttcgccccaggcgagggagggtggtgcccgcagagccaagcgagggaggttctgccgaggccgcttcggaggtggggggcgtcccggagatccggagggactagggaggcccccttcaaagcagggagggagatgggccgggcgcgatggctcacgcctggaatcccagcactttgggaggccgaggcgggtggatcacctgaggtcaggagttccagaccagcttggccaacatggtaaaaccccgtctctactaaaaatacaaaaattagccgagtgtggtggcgcacgcctgtaatcccagctactcgggaggctgagacaggaaaatcgctagaacccgggaggcagaggttgcagtgagccgagatcgcgccactgaactccaacctgggagccagcgcaagaccccgtctcaaaaaaaaaacagaaaaaaaaaggagggagggaggaggtccgggcccagaggcgagtggggtgtcccgggtggggagaggctgtgggccccaaatgccgtgggcgggggggacgcgaatttcccagagggggaactgagccctccagaggggccgggtactccgcgcgctcggccagggcacccgttggccgtccctgtccctggggcgcgagctccgtgctgacgaggaaaaccaagatcttcctgggttcgaggctcggaccaggccccggcgcgtgtgggtggacggcgtcccgcacggagaacgctccgcccgccgggcgcgccggccgtatttggacattggttctatttttaactttcccgggactcgagttcgggggttgggggaggaaaatcccgcttcctctgggacccgcaggcctcggtgcccgcccagcgcccaggcccgccgcggagtgtagtcccaggcccggaagtgagttccgggtcggtgtaaacgcggcggccgcgcgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagggcggggggtcccgggcgtccctccccacctcgcggcgtcgcctcggcctcgccaggaagcgggcgcggcccaggtaattccgggtggaaaaacgtcccgggaagttgcagggggaggaggccgaggcggggagggcggcgcgggacgctcggacccggggccggatgaggagccgccggggacgcctgagaacgcggagacccctgacccgagggcgagggggcggggaccgcggccggatttggcagccgcttcggcgcgggattggagcggggcggtgaggacaagcctgggaggggcaggcccccggccgggccctgagtgacgccccaggccagaaatctgggcctttcgtggtcagaggacaccggcggcccctttgggatccacccccaatcaccaccaccttgttcttctctgaccctggatactctgggtgtccattttttggagccctgagaccctgtttgaagagggatccatctcagccctggttgtggggcgagggtcttgctcagcctgcaccaccctccaccctccagtaggacccagaggcagctgggctttccatggtaaagcccccatcccctgaggcttctcaggactctcagtggaggaggtgcctggggagcccagcagctggaggaaagggagtggccccagccatgcgagggagggcctcccccgcgttctggagtgggtggctgagcccagctggggtgggaggccctctgggggaacccctctggtgtagtctgggagtaacctcttgcttggtgctcgacgctctaccggtggaggtgggggtgggtctgggtgggagagacggccccaccctgcctgcagaattgaccctgagccatttgtcctccaaagcacctgtcacacgtggctcagagctgagggacctgaggtcacctggtctaactcaactcctcctcctttaggaggaaggaaccagagagaggaggggattggtccaagctcaacagagcagtctttctgctatttcaaggagttccttcttgtgaccccccctttctccacccaaaaccagcacctcccgggttctgccctctggtcctgcctgcgtccatgccctgtgtccgagtcccaagtggttcatgttgtctctgttctgtgcccgcagcctcggtgatccctctgctgccacactgggacccgggccctccacacccggctttccgcacccggcccaccacacccaggccctcagcacccaggccccccgcacccgtcatgctcatgtcccgtgtctagcccggagtccacaagcccctacgttccctctcagtcccacaggcgcagggaagtggccttgccccgcccccgatgactctgaccctcttctgtggcccattctctgcaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacgtgaggcccttgtggggagatggcaggggtgctggggtcacagacacaggcaagcggaggggaaagagacaccaagggtcaccgggataaactttttttttttttttgagacagtttcactcttgttgcccaggctggagtgcagtggcgcgatctcagctcactgtaacctcctccccccgggttcaagcgattctcctgcctcagcctcccgagtagctgggattacaggcacccgccaccacgcccggctaattttgtatttttagtagagacggatttctccatgttggtcaggttggtcttgaactcccgacctcaggtgatccgcccaccttggcctcccaaagtgctgggattacaggcatgagccatcgcacctggcccgggataaactttggaccctcttcccccgatcccagacctacattggccccgtcctggtctctgtcaatccctaccgggacctgcagatctacagccggcagcatatggagcgttaccgtggcgtcagcttctatgaagtgccccctcacctgtgagtgaccccagcccctccgggagcgacccctctgtctccatctgaggtgaccccgcccaacccttaccttactctgaaatgatcctggcgtcccgcgccacatctgtgaggaatcccacagtctcttgccccccagtgaccagagatgaatgtcgcaactcagctccatgtgggtgggactcagtccctaccccgactcacacccatgacttattccccaactgggagtggccccccaatcttagtgacctctgaaccccacctgcaaagaccccccccagccctacccgtgagtgactccagcctccacctaagtgacctccagcctcccacctgtgagagcctctcagtcctcccgctggcggtgacgcccattctcagctatgacggatctcccatggcccacacctgtgagggacccccagtccccatcctcaagggtgtattcgactcccacaagaggactccacccagatgtgggagcgggactctcgtggggctctgcttggcccccctccccaaactccctgacgagcctccgccccaggtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggagttaagggccagggagagaagcccagttcgggaggggaggggcagcagtagctacaaggcggggtggggagggcaggtggagagtgccaggtgtccctcatacccctgtccactcctaggcctttggaaatgccaagaccctccggaacgataactccagcaggttcgggaagtacatggatgtgcagtttgacttcaaggtaccatggatgtgtgtgtcgtgaggattcccattcagtaggctctacacgtgtgaagcacctactgggtaccagggactattccaggtgctgcaattccagcagtcaaacaaagcaaacaaaaatcctgccttccagggtgataaacaataaacagggaaattgaggccgtggcagaaaataaaatgcagtaaggagtggggggcaggtgcggtcgtattagggtaggcctcactgagaaagtggcattttaataaaggcttgacagctgggtagggtggcacatgtctgttgtcccagctcctctggaggctgaggcaggaggatcacttgaggccaggagtccaaggttaccctaagctatgatcatgccactgtactccagcttgggctacggagtgagaccctgtctctaaaaaaaatagaaaataatggcttgatggagataggagcaggctgtgcaggtgcctgtccaggcagcgggaacggaacggccaggacaaaggcctgagatacgagggtgctggaagtgttccaggacagcacggaggccacagcggccagagaagagagcaggggcccgcgaacagagagaggccaaacggtgcaggcccttttgggttgttgcaagaacttttttttttttttttttaactctgagtagaaggggagtcatcgggctgggtgaggtggctcatgcctgtaatctgagcactttgggaggttggggcaggtggatcacgtgaggtcgggagttcaagaccagcctggccaacatggtgaaaccctgcctctactgaaaatacaaaaattagccaggcacggtggtgtgtgcctgttgtcccagctactcaggaggctgaggcaggagaattgcttgaacccgggagttcgagggtgcagtgaactgtgattgcactactgcactccagcctgggtgaaagcaagaccctgtctccaaaaataaaaaataaaaaaatgactttagctgcttcactgggagattgggagtagacgaatagatgggaggggaaccaggctaagcagggaaaacggttagggggctgatgtcatcatgtaggtgacaggtgacattggctcagaccagtgtggtgcagtggaagtggcgagcagtgattggattctggatgttttaaaggttaaggcagcaggatgagctgcctgattggatgtagggtttggagaaacacaggcttccaggaggactgccaagtccttggcttgaacaacgagaaggatgtagtcaccactgaccaaggagggcagacactaacaggagcttgtttgaagagggagaaggtccggtgttgagcttcaggcctgttgaatttgcgatacctgtcaggcatccaggtggagcagccaggtcgttggagttgaatctccccatttcctagatgaagtaactgagtccagcgtgggtggcgtgcctgagccgacgcagctagtggcagggctggaattggcatccaggtctggctgccaaagcccaggagtgcaggggagaagaggggcaggtgggctcttttcccagtccccgtgacccggcctcatgccctgccctgcccacagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaaggtgagtggctggcagggagggcaggtgccacccagggatctggtgccagggctggcaacccagctgtgcccttcctccagggccagtgtgccaaagtctcctccatcaacgacaagagtgactggaaggtcgtcaggaaggctctgacagtcattgatttcaccgaggatgaagtggaggtgaggcctcttccgggaccctcgctttcctcctgtcacacccccaaaatctccttttttttttgttttttattttttgagacggagtttcattcttgttgcccaggctggagtgcagtggtgcaatctcagctcactgcaacctccgcctcctgggttcaagcaattctcctgcctcagcctcccgagtagctgggattacaggcgcccgccaccacgcccagctaattttttgtagttttagtagagacggagtttcaccatgttggccagcctggtctcgaactcccgacctcaggtgatccgcctgcctcagcctctcaaagtgctgggattacaggcgtgggccagtaatcccttttttttttttttttttttttttgagatggagtctcgctctttcgcccaggctggagtgcagtggtgcgatctcagttcactgcaacctctgcctccaggttaaagtgattctcatgcctcagcctcctgagtagttgggattacagacacctgccaccacacctggctaatttttgtatttttaataatgatggggttttgccatgttggctgggctggtctcgaactcctgacctcagatgatcctcccgcctcagcctcccaaagtgctgggattacaggcgtcagccaccgtgcccatcccacccgcagaatcaccttccacctttaacacccattcccacttccagccccttctctccgacacttcaccacccacccctgcatggccatctgctagttgccctcttggggctctctggcccctctcaccccctcctgcccccggcctgctcccccaggacctgctgagcatcgtggccagcgtccttcatttgggcaacatccactttgctgccaacgaggagagcaatgcccaggtcaccaccgagaaccagctcaagtatctgaccagggtgagtggggcgggcagagggcgacgggaggacggcgggggcgggggctgggggtgcaccctcaccgtgtcctcgcctgcccttggcagctcctcagcgtggaaggctcgacgctgcgagaagccctgacacacaggaagatcatcgccaagggggaggaggtgaggccgggcccttgccctcgggtgtggaggggcagctgttccaaggcagcccctactcccatcactccccttcgcctggttccctcagcaatgctggagggatggaaggaaggctgctcagagaagcagagtgagagccgagcgccgtggctcacgcctgtaaccccagcacttggggaggctgaggtgggcaggtcacctgaggtcaggagttcgagaccatcttggccaacatggtgaaaccccatctactaagaatacaaaaattagccgggcatggtggcgggcgcctgtaatcccagctactcgggaggctgaggcaggagaatcgcttgaacccgggaggtggaggttgcagtgagccgagatcacggcaacagagctagactctgtctcaaaaaaaagaagcagcacagtgagctggccagggtcacataggaagagagtaacagtccggctagaaccagactcccacctcgggaaggaggcctcctgtccctctaccaccttccctctggggtggccacctgtcctccctgaggtcccactaccagcacccctccccatactgcaggcttgctggagctgggagtgcagagtggtggcggcttcctggtctgcctgagcctgggagcaggtgggatgcacaggctctgtggcattcatctccttgtctcacgctgcgtccacagctcctgagcccgctgaacctggagcaggccgcgtacgcacgagacgccctcgccaaggctgtgtacagccgcacttttacctggctcgtcgggaagatcaacaggtcgctggcctccaaggtgagggctcggtccacactgctcccaaggcagaagggagggccgtcggcgaggcggggggtgctgcagggtggggctggcacgcgcagggggcccacgccttcggttgaatgactgccctaggacgtggagagccccagctggcggagcaccacggttctcgggctcctggatatttatggctttgaagtgtttcagcataacaggtcggtgccatctttcccccgtctctcctcccggtctcctgtcctgctccctctcttctgtcctccagcctctcattcctgccctgtgactccccagccagccggggactgtctctgtgtttctcacctcctgtgctcaggggcgtcgtccagcttttcccctctcctggtcctgtgtccccactgagccactgtgggctcttctccttccttacagctttgagcagttctgcatcaattactgcaacgagaagctgcagcagctcttcatcgagctcacgctcaagtcggagcaggaggagtacgaggcagagggcatcgcggtgtgtgctagcctgggggcactctccgtgggccacggggagcctgggtatcggggcccctgggagagggtgccaggaccccacggtgatcccttccttcccttctgcccctcagtgggagcccgtccagtatttcaacaacaaaatcatctgtgatctggtggaggagaagtttaagggcatcatctcgattttggtgagtcctctgcgcctccaaggcctggtgctggaggctgggtgggaggatgtcccccttctccgttctctccaggctggtccacggagggccagagtttggggctgagtagagacagggcagagctgtgaatggaggatggagggaggtgccgccccagttggaagctctctgtggaggctccctgtgatctgcccctcccctgtgtctgtgcctcccagcacggtgaccccaatcctctgtgcgctctgacctgtcccccatacgtccttccccctgtgccacaccccccaggatgaggagtgtctgcgccccggggaggccacagacctgaccttcctggagaagctggaggatactgtcaagcaccatccacacttcctgacgtgagtggggctgcggggctgctgggggcaagggctcacttgcagcagagcctgcggagtgcaggagtccctccgccatcacaaaacaccagccacaaggaggtgaccagggacggtgctgagttaaggacccctcacatgtgtccagaaactaagaagcttagccaggcatgctgacacgcctggagtcccatctatgcagaaggctggggcaagagcatcacttgagtcctggagttttgaggttgcagtgagctaggatcaacccactgcactccagcctgggtgacaagagcgagactccgtctcaaaaaaaaaaaaaaagggaaaaaaataaataatgaattttttaaaaaagagaaagaaggccaggtgcagtggctcacgcctgtaatcctagcactttgggaggctgaggcgggtggatcaccttaggttaggagttcaaaacgagcctgggcaacatggtgaaacccagtctctactaaaaatgcaaaaattcgctgggtgtggtggcaggtgcctataatcccagctactcgggaggctgaggcgggagaatcgctcgaacccgggaggtgcaggttgcagtgagccgagatcgcaccactgccctccagcctgagcgacagagtgagacttcaaccccaaaaaaaaaaacaaaaaacaagacactagtagcctggcttcctccttcttcttgtttgagaatgaaacttgctaagatttttcatcttccttgtttggaaattgatttttattgaaggaatcctctgaagtggggagaggtagaaacaggaacaagcgcctctgtccagcgcggtctgatgcatgctgtgcatgtcgtcgcttcacctgcagctgctccttgaggggttcttggtgttttctcactgagactccaagaggcgaagtcatttccccaaaattagctctcatctgggttgccgagctggggtcagtgccagggctgttgaatgccaaagccatgagtattttttgcataataatatattgaaaatttgtttctggatgggcgtggtggctcacgcctgtcatcccgacactgtgggaggcctaggtgggcagagatcacctgaggtcaggaattcaagaccagcctggccaacatggtgaaaccctatctctattaaaactacaaaaattagtcaggcgtggtagtgggcacctataattccagctacttgggagctaggagaattgcttgaacctggggggcggagcttgcagtgagctgagatggtgccactgcactccagcctggatgacagagtgagactccgtctcaaaaaaaaaaaaaagacttgtttctaggagtctctctgaatctattcgggtttaggggctgcctgattcattaaataataaatactaaaaacttgttcctgattataaaaataatattgcttattacagcaaagttggaatgtgcgcaaaagccacctgtgatcccgtcgcccaaaggccatggctgttaactgtgtgaggcatttccctcctgcctttttctatgcattttttttcgtagtcgagaacttgtgtataaggctcagggtaaatatcctgcacattttcccgtatcatcaaacaacattttcctcagaacacttcctggagcggttctgacccacagatactcccctctctcacccagcccttcggggcccctggccagcctcccaggtttctgctggaatcacaaggctgccacaaacatctccgtgccttcaatctttgtccgtgtctctggttagctgcttgaaatagttcttaaaagcaaatgggtgaaagggtataaacacgcctaagacttaagtgctctcttggggcagcagattccattctgaaaagtagtgcgcagctcaccaccccttctgagcagagcccgcagcggccgaagcaacgagagtttccctccctgcagcgtaccctggccgtcaggaggcccaggtcccggtcctggcactgtgtggccctggccaaggccatctacctctctgagcctccatggtccgctctgatcagggaggccactggccctgcctggcctgcctcagtgacccagccctgggggtgcacctgctcttttttttttggagtgtagtggcaccatctcggctcactgcaacctctgcctcccaggttcaagcgattctcctttgtcagcctcctgagtagctgggactacaggcgcccaccaccacgcctggctaatttttgtatttttggtagagatggggtttcaccatattgaccaagctggtctcgaagtactgactttgtgatctacccacctcggcctccccaactgctgggattacagccgtgagccactgtgcccggcctggggtgcacctgggcagctggttcctgctcctgaggccctttcagcaggcagagggcttggctcaggccggcagccatctgcagcttcctccctgtcacccccaggcacaagctggctgaccagcggaccaggaaatctctgggccgaggggaattccgccttctgcactatgcgggggaggtgacctacagcgtgaccggtgaggatcctggggctgtgtccccacaggggcctgcggggaggctctgtctcacctcacgtcggttctcccctcccagggtttctggacaaaaacaatgaccttctcttccggaaccttaaggaggtgaggaggacgtggggaggccggggtgggggtggggatagcccacagctctgcacctgtgtccaggagcctgtcctgcctgtccctgtgccccaccctgaccccggctctgcccacacagaccatgtgtagctcaaagaatcccattatgagccagtgctttgaccggagcgagctcagtgacaagaagcggccagagacggtgaggaggtggcgggaccaggcgcgggggtgcatgcgcctgagtgtgcatgagggcctgtgtgagcctgggagctggcagcgtgcgtgtgaacgcgtgtgagcccgtgcacatctgcaggtgtctgtagggggctgccttaggtgcctctttgcctactttttttttttttttttttttttgagacagggtctcgctctgttgcccaggctggagtgcagtggcgcaatctgggctcactgcaacctccacctccctggttcaagcgattctcctgcctcagtctcctgagtagctgggattacaggcgcctgccaccatgcccggctaattttttgtattttaagtagagatggggtttcaccatgttggcctggctggtctcaaactcctgacctcgggtgatccacctgcctcggcctcccaaagtgttaggattaccggtgtgagccaccacgcctgtccctgtttgcctacttgtgtgtgtgtgctgtgtctatagtggagtcgtgtgtcttcagtgtgggctgtgtctgtaggggaatccttgtgtacgtctgtctctgtgggtgcccatatgttgacagctgcctctgtgcggttgctgtcatgtgtctacccactcagcagacatttatagcagacactgccaggcactgaggtaccacaatgagtgggtgtgcctgcagcaacatgtgcacagggtgctttgcaaacttagaagagggaacagcaaacggcctgacggggcggaaggggtgaggggttggggaggctccctggaggaggaagcattggagatgacttgggaatgtcagatgaacctatagtgagggcccagtccagacacagagagtctaaaaaggccatgaggtgagcaggaaagcgatggcatcaaggagaaggaccgggggaaaggcaggcatggccagggtgccagatgcagggagggctccagcgagctgaaggcggaggtacggctgttgggcttggcaaaaagagggtcaggggagccccagaagagtgaggtcagtgagtccatagggaggtggaagccagactgcctggcagggagggcatgcaggcgacatgctgcccagggtgtggctcactgtgcccctgcccgctgctgccgtccaccccaccctctcccgaagcaccacatcctcccggccctagcgtctccctgctgaggatgcctacacaccctcccgcccaggcctctccagcaagccacagactcgtgtatctcatcctcttcccctaggtggccccagggcaccctagatcccactggtctataacaaacgggcccttggtctgcccctccaggctttctccttctttgacccagtcccccaggccagaaacctgggtgtcatccccttttttgtttttgtttttgtttttgagacggagtctcgctctgtcacccaggctggagtgcagtggcgcgatctcggctcactgcaacctctgcctcctgggctcacgccattctcccacttcacactcacgagtagctgggattacaggtacccgccatcgtgcccggctaatttttttatttttgtagagatggggtttcaccatgttggccaggctagtcttaaactcctgacctcaggtgatccgcccgcctcggcctcccaaagtgctgggatgacaggcgtgagccaccgcgcccggctccggccccctcgttcttttctctccttgtctcccttgtccagccactggatcttgccggagtacttagcagctccccctcagtccttccctgtagccacttcacccgcccctcctccttatcctttaaagctcagcagagcgtcatttccagaagacgtcacctggtgccccctaaccctcagactggatgaattgtccctttgtggggctctcagaacccacaggcatacacctgctactctcggaacaccgggattgtgagtctttgccaaggagcgtgctcctccgccaggcctgagatccttccaggtcccgcagagcagcatacccagatactagctgaatgcgtagcatgggacatgctgtttaggaacgcagccctgaagttctagaaagaaaaagaagggccactaaagggaggtgtagcactgaggttgctgggagacctgagcaggagttttaggctggagtgaggctcgtagactgaggtctctcgcccagccagaggggtaaggggtggagtctggccccctcctctgctgcgaggaagctgtggtgggaggagtaaggaccaggcagaatcagaggctgctgcgcgcgtcaccagccaggggagtggggtactcgctgctggggtcagcagctttagcccagctccggccaacctcccatgcctcttggctcgccaggtcgccacccagttcaagatgagcctcctgcagctggtggagatcctgcagtctaaggagcccgcctacgtccgctgcatcaaacccaatgatgccaaacagcccggtaggcccctcccacgggggacttcggggccgggcctcccctgcaggagacaggccgtcagcgccagcccgctgaccacggcgctccccctaccccaggccgctttgacgaggtgctgatccgccaccaggtgaagtacctggggctgttggaaaacctgcgcgtgcgcagagccggctttgcctatcgccgcaaatacgaagctttcctgcaaaggtgggggcaggtcctgctcggtgccagggaaggggagcgggagggtaggagcccctaggtcccatgagggcagacaagggttctcggccccattttagaaatgcggatgcggaggccctgggctgcccttggtggaggcccttggtgctgcggtcctgacatcaggctgggtggaaagaatacccggctcccccaggccgtgccctccaggagcacccggtcaggggtacaggaggcctccgtccacgtgccgggcaccagaggcagacagcaagccttgtagggcagcttccaaggggctccgaaagggtggagcagctttgtggttcttctgagtcgggggcctggggggtcaaactgaatttcatctctgccactttctagttacttggccttaggtagataagaacggtttcttcatctttaaaatgggggcagtgaccgagtgagcctcctgctagctgtgaacgagtcagtgggagcacccagcaggtgcccagagaaagctgattggggtccccagggcaggctgctgactggggtgggagccgcgtgcattcctgtccccaggtacaagtcactgtgcccagagacgtggcccacgtgggcaggacggccgcaggatggggtggctgtgctggtccgacacctgggctacaagccagaagagtacaagatgggcaggtgggtagtgtccgtgccgggtgcctgcggggaatgggagtggcaaccccgggctgatcactactgctctcccaggaccaagatcttcatccgcttccccaagaccctgtttgccacagaggatgccctggaggtccggcggcagagcctgggtgagagagaggcctacccttcctgctgcacggggtcccttctgggaagcagggaagtcactcccttgggctccttctccagggagtccacccctccctatcagctccagccccacgcccagctccagggagtccttctccagagagtccaatggccgacttggagcccctccccaccagctccagccccacgcccaccatcccacccgccgccccccttttccgggcagtccccacattcattcttcttcaccactctcctcctgctcgttggttccttcagccactctcccattcatgccactcgtggagcgcacacggcaccaggctcccagctggctccccgcgctctggccaattgcctttctttcccaaccgcagccacaaagatccaagctgcctggaggggctttcactggcggcagaaattcctccgggtgaagagatcaggttcgcgggcccatgggtgttcaggaggggcggggtctggggccagggggggccaccatggtaagaagatagagttcagccatctgtggtctccacgacagccatctgcatccagtcgtggtggcgtggaacactgggccggaggaaggcagccaagaggaagtgggcggcacagaccatccggcggtgagcgccagggtgccttgtgggggctgcagagcagggcgtggggggtggttcaccgccaggcccctcacccccaaccctgtctggccccccaccccaggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggtctgtgggcaccccctgccaagttagggaccatcatagtacacagcagaagggtctgatttcttcgggccaaaggattggtcagggagggctcacggagggcccggaccagagctgagcagtgaaaagtaaggtctcttttttttttgagatggagtctcacactttcgcccagggagtggcatgatctcggttcactgcaacctccgcctcccgggttcaagcgattctcctgcctcagcctcctgagtagctgggactacaggcgcccgccactacgcccggctaatttttttatttttagtagagacggggtttcaccctgttggccaggctggtcttgaactcctgagctcgggtgatccacccaccttggcctcccaaagtgctgggattccaggcgtgagccaccgcgccctgccgagtaaggtctcttgaccggaagcgtctccagatggagggggtgttacttatccaaaggctgcagtagcatatgttcgatgtcttcagagggaagggcccagggtgtccaggacctctgacctcactcctccccttaggcctcagagcttctgcgggagttgtgcataaagaacatggtgtggaaatactgccggagtatcagccctgagtggaagcagcaggtacggagagcggggctgggtgaggatgaggaagtggagtcagggagtcgcaagcattgctcaaagggtgtccgcctggaggggcatttaccccggtctaccgtatttaccgcgttctaccgtatttaccccgatctaccgtatttaccctggtctactctatttaccccagtctaccgtatttaccccgcctaccgtatttatctcggtctactgtatttaccccacctaccgtatttaccccagtctactctatttaccgcaatctactgtatttaccccgtctatagtattgaccccggtctaccgtattttgccctgcctaccatatttaccccgcctaccgtatttaccccggtctactctgtttaccccggtctgctctatttaccccggtctgctctatttaccctagtctaccgtatttaccccggtctaccggtgacctcagttggatgccaggccctgctgggcctcgtgtaggaagtggacactggagtacagctggggtggccagtagggttcatatcgtgggccaactgcccttgattggtagagactgctcagaaccctgtgttgaaaagtctgcgtcttcactcgggtcgattggtgatatctgccctgattacaggcattggttgatgtgccgtgtttttgccaactcagtattggatgatgctaaagggcccacccagtaaccttgagtattagtgatctgctgcttacaagaccccaagctggagctgagtctcagggccaccagggcctgatggggtggggaagcattaccaaggccagtttcaaaaccccgcagtgccttcatgaccctgctggggagtgcttggtggcggcagagggtcaggaagtggagggttgatgggcgtgtggggggcagggctcagcctcctggtgctgagccagagagggaccagcaagcgggtgagggaggctgtctcaggtcctaaggctggctctgcccccccaagatggtgctccccaccatgacactctcctcaccccccttgtctcctcagctgcagcagaaggccgtggctagtgagatcttcaagggcaagaaggataattaccctcagagtgtacccaggctcttcatcagcactcggcttggtgagcccctgactttccagcactcagacctttcgtcaccatcctggtcccccattgcctccactgacttccctccccgccatctgagttgcaggtacagatgagatcagcccccgagtgctgcaggccttgggctctgagcccattcaggtaagagcctgcctgcagccctgagtccagcagcacggtgctactgcctgagagctgaaggcaggtcagggcacgggcggagccttgggagcctctccccagccccttcagcctggcctctgtccccagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggtcagccagggtccagggctgcagggggagggccctgctctgaccctcgacctctgacctttgccctctcccctcaggaatctctgtcagcagcctgagcgacagtctttttgtgcttcatgtacagcgtgcggacaataagcaaaaggtgccttttcgtggatggggaggagtggcgggggttcctcaagttctgggcagggcctgacccctcctcctgcctggccccccagggagatgtggtgctgcagagtgaccacgtgattgagacgctgaccaagacagccctcagtgccaaccgcgtgaacagcatcaacatcaaccagggcaggtgaggcgcgggcggcccccggggacagggcgggggtggcgagggggctgtgtaggcacccagggacagggtgggggtccaccttagggttgggggtctgcctccatggaaaaaccctcacccaccccgttcccccagcatcacgtttgcagggggccccggcagggatggcaccattgacttcacacccggctcggagctgctcatcaccaaggccaagaacgggcacctggctgtggtgagtggggcctgctttcccgcttatggcctggctgtgatagccaagccttccttggctgtgcttggcagagcccgggcacctcaccatgggccttcatccagaggccatcataccacctcttccatcccttggcccacccatgagggccagagagagcccctcagtgcagaaagttgtaaaggtggcagcacggtggctcatgcctataatcccagcactttgggaggctgaggcgggtggatcaccagaggccaggagtttgaaaccagcctggccaacatggcaaaacccatctactaaaaaaatgcaaaaggctgggtgcagtggctcacacctttaatcccagcactttgggaggccgaggtgtgtggatcacccgagatcaggagttcgagaccagcctggccaacatcgtgaaaccccatctctactaataatacaaaaattagccgggcgtggtggtgcacgcctgtaataccagctactagtgggggctgaggcgggagaattgcttgaacccaggaggtggagattgcagtgagctgatatcatgccactgcactccaggcctggggaacagagtgagatgtcatctcaaaaaaaaaaaaaaaggccaggcacagtggctcacgcctgtaatcccagcactttgggaggcgaaggcaagtggatcacctgaggttgggagttcgaaaccagcctgaccaactggagaaaccccatctctactaaaatacaaaattagccgagtgtggtggcgcatgcctgtaatcccagctactcgggaggctgaggcaggagaatcgcttaaacccgggaggtggaggttgcggtgagccgagattgcgccattacactctaccctgggcaacaagagcaaaattccatctcagaatttgtatacaaaaaagttagcctggtgtggtggcgtatgcctgtagtcccagttgctcagaagcctgagatgagaggattgcttgagcccaggaggttgaggctgcaatgagacccaagatctcaccactgcactccagcctgggtgacaaaatgagaccctgtctcaaaaaaaaaaaaaaaaaaaaaaaggcagcacggcaatgcagggaagatacataggctgattgggggtgccaggagggaggacaggctcacaggctcacgctggccagggcggtgggcattcctatgggagtcaggtctgagtctccaggatggagaccactaggcccccaccactcctgcctgcatcgaacccatgaatctgagcgctggggctgggtgcggcggctcacgcctgtaatcccaactcttagggaagcagaggtgggaggacagcttgagcccaggagtccaagaccagcctggacaatatagcgagaccccattctccataaaaaggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaatgtggtctccttatgaatattaggaaacgaagagggccccggaaggcaaccaagggcctcgtgttgcaggtttttctcgagacagtctcgttcttgtcacccaggctggagtgtagtggtgtgatcttggctcactgcgacctccacctcccaggttcaagtgattctcctgcctcaacctcctgagtagctgggactacatcatgcgccaccacgcctggctaatttttgtatttttagtagagattgggtttcaccgtgttggccaggctggtctcgaactcctgaccttgggtgatgcctcccacctcggcctcccaaagtgctggggtgacaggcatgagccaccgtgcccggacacctctcgttcaaattctgttgcaagtgacaaacccagtccaaactggcttgggccaaaaaaaggatatttataagcattagcaccttagtcccagagtaaggctacttccaggtgctcacacactgtcaggaatgtgtctggaaccatcgcctggctgaaccttcctctacagtggcttctttcccaagcagattctcacctggaggtggggtggcagcaacagccacccacagctccaggctttcattctgtcagttcagcattggaggcagaaagaggaagtgcctctttcccaaaatgtggaagtctcagagcggattctcagtgcagcaccttgaatgaggcatccaccctgacccaatcactgtagccagggagaggaatagattctgattggtcaggcctggatcgagtgcctgcccctggagacagagctaccaggggcacaccggaacccacaccggaaaccacagaaccaagagtgggaggagatgactcgccaaaatgaaatcagtgtcgcctccacaagaaagagaatgagtgggccgggcgcggtggctcacgcctgtagtcccagcactttgggaggctgaggcaggtggatcacctgaggtcaggagttcaagaccagcctggccaacacggtgaaaccccatctctactaaaaatacaaaaattagccaggcagggtggcgtgtgcctgtaatcccagctactcggaaggctgaggcaggagaatcccttgaaccccggaggcgaaggttacagtgagccgagattatgccactgccctccagcctgggcgacagagcaaaaaaaaaaaagaaagtgcttcaagctgcaaccacggagctcgtcgtcagcagatggctgtgagtttttccaagagggcggcgcgctgtgggtggagggaacggtgcatgtggagcttagaggcaagaacaggtttggcccggggtcaggccagctgcctgaggagcttagatttgaaacctggggcagagattctcaaacaaggagataccacgcaacgtggtgttttgggcttgacacgatcctgtacgcacacctacattttgacacctctctccatgattaattttcccgaggaaaaatgaaaccacaattattcgtccactttatcagcagtaacgatgcctccaagaagctgatagataagataggtattaagtgcaattacatgctttataactgtgtcgacattcctttctctagcaaaccagaatgcacgcgagaatgacatcacagacattacccagacgtccgcctttttttgtttgtttgtttgtttttttgtgacagagtctgtcgcccaggctggagtgcaatggcacgatctcaaagtggtcactccaaagtggtgggatgacaggcgtgagccaccgtgcccagcctactctgaccttttgagaggtaaccaggactggtttgtgccctcagctcacatcctgagggaagtccagtgacctccaggaaatatctgccaattatgggaaaagctaatgctggctctagacaagagcttccgccagttctccattcatccttccttcattcaacccggcgctttgggaggccgaggtgggtggatcatttgaggtcaggagtttgagaccaacctggcctcctgaggcaggagaattgcttgaacccgggaggtggaggtggcagtgagctgagatggaaccactgtactccagcctgggcaacaggtttttgtttgtttgtttgtgtgttttgagacgagtctcactgcatcgcccaggctggagtgcagtggcgcgatctcggctcactgcaacctctgcctcctaggttcaagcaattctgcctcagcctcctgagtagctgtgactacaggtgcgtgccaccacgcccagctaatttttgtatttttagtagagacggagtttcaccatattggccaggctggtctcgaactcctgacctcatgatccgcctgccttggcctcccaaagtgctgggattccaggcatgagccaccgcgcccggcccattcaaccagtatgaattgaaggaatgcttgcaatgtgccaggatctcagtgaggctcttgggatatagcaggaacaacaaaaagacccaaatccctgctctcatggagcttacactctagcaaagaatagacaatacgtaaggaaaatacctaacatattagaaagagataagtgctaggaaaataagcaaagcagacaaggggagagggagtgttggtgtgtagtttgcagtcaggcaaggcctcacagaggagatgacatcagagcggggacctgaacgaggagaggaagtgacggctaggatctggagcaagagtggtcaaggcagagggaacagcaaggcaaagccctcgaggaacgtggagtctcctgagaggaaagggaagaaggctgggggcagagaagagtggcagaggaaatgggtaccttctccttgattctgcaagaaggcctttgtgtgagcagcttccctaaaagattggagcgatgagaggagtttgcacgcagcaaagcaaataacccattctcgatggtcccagaatcacattgccagtggggacatcttactgacctttcctggaaggcgcagcatcctgcctgtgctcctcgctccgtctctacccaagactctccttggagttcccctcacatggtgccccagagttctcttttatttctttatttagagatggagtttcactcttctcacccaggctggagtgcagtggctcgatctcggctcactgcaacctctgcctcccgggttccagcaattctcctgcctcagcctcttaagtagctgggattgcacgcgcccgccaccacgcctggctaattttttgtgtttttagtagagacggggtttcaccatgttagccaggatggtctattcttctttaaaaaattcttttttggccgggtgcggtggctcacacctgtaatcccagcaccttgagaggccgagggaggcggatcacctgaggtcgggagtttgagatcagcctgaccaacatggagaaaccctgtctctactaaaaatacaaaaaattatccaggcatggtgatacatgcctgtaattccagctactcgggaggctggggcaggagaatcacttgaacccgggagatggaggttgcggtgagctgagatcgtgccattgcacggcagcctgggcaacaggaatgaaactccgtctcaaaaaaaaaaaattatttttcttgtaatttccgtatgccctagggagggatctcagagggactgctttggaacaggcagtctctgggtaaggtccagagctcacagaccagccagaattcacactgggacggctgcttctgctggctcacggtgccaggctgtcactaagccagggtcacgatgagtcacctgcagcaggaaaggtgcccttgtgcctcccagtcccccaccccccacttccccagagcaggcccaagggtgtgtaaggtgagtccagcaggactgtgttattccttagaccataatccacagcttactgcttttttaaaaatgtagatttctgccaacccttcctcccaattcctatctcagaaaattgagggtagagcagagtgaccatagctgtctctccttccaggatttgaaccctagctcctcactctgcgaccatgtctctctggacacattacttaaactctctgagcttcagttttctcttttgtaagatggggatacttgtcaaataaggttgttgagaggattaaatgagatgacccatacaaaggcagtcagcactgtgcctggcagatggtcatctctgcatcaatgttagcggtcctgaatgcttctggagcacctcatagactagctgcttggcctttgaggacatacacagaactgcaaatgaaaaattacagtaaaatgggtaagagctgtcatgggaataatttggacatactgctgttgatgaagagagggagtgatgggatggttaagaaagggaagacatttgggccgggtgcggtggctcacgcctgtcatcccagcactttgggaggccaaggcaggcagatcacaaagtcaggagatcaagaccatcctggctaacacggtgaaaccctgtctctactaaaaaaaaaaaaaaaaaaaattatccaggcgcggtggcgggcgcctgtagtcccagctactcgggaggctgaggcaggagaatggcgtgaacccgggaggcggagcttgcagtgagccaggatcgcgccactgcactccagcctgggcgacagagcgagactccgactcaaaaacaaaaaaaaaaaaaaaaaaaagaaagaaaaagaaaaaaagaaagggaagacatttgaatttgagactccaaagtgggtagaagaacattccaggaaaaagaaacccagcattcacataggagcagttaaacgagactgtggaccagcacagtggtacctctataatcccagctactgaggaggctgaggaaggaggacccctggagcccaggaattagagtccaacctgggcaccataagaagacctcatctctttttttttttttctgagacggagtctcactctatcgcccagactggagtgcagtggctcgatctcagctcactgcaagctccgcctcctgggttcacccattctcctgcctcagcctcctgagtagctgggactacaggcgcccgccaccacgcccagctaattttttttgtatttttagtagagaccgcgtttcaccgtgttagccaggatggtgtcgatctcctgacctcgtgatccacctgcctcagcctcccaaaatgctgggattactggcgtgagccacagcgaccagctgacctcatctcttaaaaaaatgatgattattattttagagaggtggtctcactctgtcacctgggctgaagtgctgtggcatgatcatagctcaatacagcctcgaactcctgggctcaagtgatccacccgcctcaggttcctgagtagctgggactatagctggatgtgccaccacgctcggctataaagaaaaacaatgttttttgagatggagtctcgctctgtcgcccaggctggagtgcaatggcgcgatctcacctcactgcaacctctgcctcccgggttcaagtgattctcctgtctcagcctcccgagtagctgggacttcaggcacctgccagcacatccggctaattttttgtattttcagtagagatgaggttttgccatgttggccaggctggtctcgaactcctgacctcctggcctcccaaagtgctgggattacaagcatgagccactatgcctggccagaaaaaatttttaattaaaaaaaaatgagcctggccaatatggtgaaaccccgtctctactgaaaatacaaacattagccgggcgtggtggcgggtgcctgtagtcccagctactcgggaggctgaggcagggataatcgcttgaatccgggaggcggagattgcagtgagccgagatcacgccactgcactccagcctgggcaacagagcaggaatccatctaaaaaaaaaaaaagagagagagagactgtggcccaattttatgctctgagctaaactgggagtttgaacacctgaagactgttaaaagttttacacaaggtagcaacacattcagatttgtatacatatatatatatttttgagacaggatctccctctgtcacccaggctggagtgcagtggcacgatttcggctcactgcaacctccgcctcctgggttcaagcgattctcctgcctcatcctcctgagtagctgggattacaggcgcccgctaacacacctggctaatttttgtatttttagtagagaccgggcttcaccatattggtcagcccggtctcgaacttctgacctcaggtgatctgccagccacagcctcccaaagtgttgggattacaggcatgagccacggcgcccggccagatctgtattttagaaaactcagtgggagttgtttgcagtgcgattaggggcagccagacgaaagagcaccagcgagcacgacactcgtaggaacacagtccagaggcaatcatgagggcagtgagagtaggagatgcccctggctacaatttagtgtttagaattatctgggcaggtgaccccaaagcctcaaaagagaagagaactctgtacttcacgtggcttggtacactctgctccctttgctttgaatgtccttccccgccgagtgcggtggctcacgcctgtaatcccagcactttgggaggccgaggtgggcggatctcaaggtcaggagatcgagaccagcctggctaacacggtgaaaccccatctctactaaaaatacaaaaagttagccgggcgtggtggcgggtgcctgcagtcccagcaactcgggaggctgaggcaggagaatggcgtgaacccgggaggcggagcttgcagtgagccgagatcacgcccaggcactccagcctgggtgacagagcgagactccatctcaaaaaaaaaaaaaaaagaaaaaagaaaaaaactgaggcttagagagcattgcagtaacttactcaaggtcatacaattagtgatggagtcagaatacaatccaggccaggtgcagtggctcattcctgtaatcccagcactttgggaggccatggcgggaggactacttaagtccaggggttcgagactagcctgggcaatacaatgagaccctgtccccacacacaccgaaaaaataaaaaatcagccaggtggctgggtgcagtggctcacgcctgtaatcccagcactttgggaggctgaggcaggcagatcgtgaggttaggagattgagatcatcctgaccaacatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggtgagggactgacgggacggcgggccctgggcggggtgagggccgcggaactcccagcctggctggctggtcctcgagagcggaccctcgggggtcgtgggcagagggctgggtgaccgtggcaggggcccgccggctgctcgggctcgctctcacccggggagcaggagtgtgggggaggaggagccgcggaccgaggccccggggtgtgcctggggagggcagccgcggggaaggggaactgcttcggccccagggtggggctggctcccgggccaggcgcaagggtagggcagggcaaggcaacgtggggacaaagagctgagggagatgttggcactgcgggggcatcacttggcagcggcgcccagaatgaatccgataatcctacaagtggcttttaggctggaaacgtttcctgccgtgttggagagccgggtttggccgtgctcccctggtggcctttggtaggaagtcaccacatactggccgggagggatggagacaccctcaggaaaccggtcaattttttcctttcttgggcatttttccaaaatctttgtac

SEQ ID NO: 95 - DNA, 4016 bp, Homo sapiens
ggcggaatggcgctgcaagtggagctggtacccaccggggagatcatccgcgtggttcatccccacaggccctgcaagcttgccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtctta

SEQ ID NO: 96 - protein, 1039 aa, Homo sapiens
GGMALQVELVPTGEIIRVVHPHRPCKLALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 97 - DNA, 233060 bp, Mus musculus
  misc_feature (1)...(233060): n = A,T,C or G
tcatgctggggtcctctggggtcgctagcaggactgcagccccttcctgagaagcctgagccagaggctgcagcaggctggagttacacccctctcagctaggtgctagggacccatttttcccaggcgcctgtgcgcatgcgcacgaccaagagcccacatttgaaaaagaaagcagagccttccagctcagcgaggggacttccgcctgggatgtaggctttgcagggacccaggcagatggggtcgatcctagttgaaggcaatgcagggctgcccggggactgtaaggccgctatggcagcagcaagtccctctggcaccgaggctcttcaacttaggcctgtctgccttcactgctgggtaagctgagaggcggccatgcaggcgcagggcctgggcagggctcttgccttccctttagtggagggagagcgggcttccctgggtagccctggctagccttgctcggtggaccatctgcacagctgggtcacaagagggcgtggcgccaaagttctgcaggtttggagcagtgcaggaagggccttgatcttggggtgtggagagcctccacggaggcaggaatgctgcgtcctcctgagccccctatctggcaaaaacagtgttaggatgaccctatcctttggtgacagagcaagacgagggctcagaggagcggtgggtcttgctttctgcctgtgcccgacggagaccgctgcccggaggccttccctgtcccctctcttgcccctcaggccccaaaggccatgtcggacggcccttcgccatcctggttcttcacaaatgtcccaagcttccccttgtacatcggggtgttgagttagcgcgggtttggtggggtggtaggggcgctaggaataatcagaagcctgaattgggctcagcccgcgcgagagtccctgctccattaagaccttctccactggagctgctgtcagcccagcactgcgacgacatgagcctccaggacaaaaaaggaagagtctacgtttggatatggccgccctcttatcccttgtgctgttgcccctctacttctgcattcctccttatgtcaagacccctgggaactgccaccaaatcacacagaggctcccacatccacacactgaggtctccccgaaatttacaggtacacaagcacgtgcacacgtgcacaagcacacacacacacacacacacacacacacacacacacacacacacacacacctcctctggatcctcttgctggtcctgggtgggttgatgacatctgggccttaaatgtgtgcagccagcttgtgtactgagatatctctctctctctctctgtctctcttgcactctctctctctctcttgctctctctctctctctctccctctctctctctcaatctttctctctctctctctctctctgagtgttcctcaagtgttttccagagtccagtaggttcccactagcctgtcttgccagaagccttttccctgagtttgattctacctcctgtttggtcagagccagaggtttcccaggcacccaccttggcttcaaggccttaactcctgcagctagccacctgtctgtctctatggggtccttggccagaaccctgttctgactctattcaccaagtcagctggcttcttggaattcttgcttggattttagatggcaaaagataagggaaagtgggtccacaaattcttgctcctcttgggacagttgctttgctccctggagctgtgctgaagtcacctctggcaagacaaacctgcaacctgagctcgatggtgcatcctagcggtgtgcatccctgtatttcgtggccagcctgaactagagaactgggtgctgacaggtgccctcttgttcccagaggaggaggctatgtgtagtgctggcctcccaggacagggcacttctttctaggcacagtgtgggccggccatcagtcccatagtaggtcattcctcaaaattgattctccactcggtttgtcatgagtgttgtcagtgtttctgtgattcccaaacagattgtcagcaagttcctctggcacataaactcttagaccttggcttgtcttccttcattcctttaaatcatgagttatacctgttccattacacatcctatcttacacgcgttcgtgccactggccaggaagaacgcaacaaacctgaattttctgcgccaaagctttattgcttacatcttcaggagccagagagcaagagcaagagagcaagagctctattgcttacatctttaggagccagagcgcaagagagcaagagagcaagagagcaagagagcaagagtgcaagagttttattgcttacatctttaggagccagagagcaagagagcaagagagcaagagtgcaagagttttattgcttacatctttaggagccagagagcaagagagcaagagagagaatggcgaaaccccatcccttttaaggagaattatcctctgcctaggacgtgtcactccctgattggctgcagcccatcggccgagttgtcgtcatggggaaggcagagcacatggggtggaaaactacccttggcacatgcgcagattatttgtttaccacttagaacacaggatgtcagcgccatcttgcaatggcgaatgtgagggcggctcccaacaatcctagactgtgtttttcctcctatttttaattgggttttgagttcacttagtttcccttgctagccttgacagagtgaaccctctcctcttacctcatctatggatgaatgaaattgcaagtaccactttttctcgctgtacattttttgtgtaggtgtattttgaggttatatctcaaatttgtgatggattttggatggttcatttccattaacatttaaggtggatgatttcttgctttgcattctcctctctgattctctctctgtggactggagccccagattttggtgcttgactacagaaagcttctatgttttgttcagtcgtaacttttccagtggtggcttataggcaaatatggaagctataatattcattgctggttgtcaagttgactgtatctggaattgtctacaatcaagtttggaagtctcatctgtgatcctcatgttgaggctgacagatagctttttctcacctggattttggcatgggagatcttgagacacagtggctatgactcccaggagactaaggcaaggagatttctcagtacaagttcactctgtgacaaaacaagtcccagacacaggcttggtggtacacatttaatctatgccacaccttctactgtagacccacataaggatattagaagaaggaagattttctcctctttggattccaagctttacttgccagcacatctcttagaatctactagccttttgggactgagcaactcctagatccttagacttcctattcacacctgagcattgttggggcattggactacagactttaagtcatcataacaatttcccttactatatagagactatccaaaaattcacttactctagagaaccctgactagtacagaagtacagccagtcttcagcagagatctagtgtgtttttttctgctctcatcctgtcttaggcatctctgtcacccactgaggcttgtttacatctttcttcattcattttcttcgttctttatgtttctcaatgaagctcacgatattcaaaccattaactctggatgtgtttttcttcttctttgtggatttgtcccaactattcaaacccacattactttggaggatgtagtagaccttgctgggtcccagttcactgccacccccctgcctctggatctaggctcaaactaaatatgtattttattcccataagcaaatgccttgctgttttttgctcttgtttgctttcttcttttatccacccacttatttctcgtctatttgtctatctatttatatagctatcttctcatcggtgttctattcctcttcaaacatatgtctgtctctagggcactttttcaatctggtggaatgtttgttctgcatgctccaagtctcaggtgctgagattccaggtatgtgatatcacactggaatgctctgtgttctgatccattgacagacaaacaacatcccccctttgtcaagttgatcctgaacataatataagtccatttgtagaaagggtgtatttagtatattcgttgcattgtaaaagtcataggctgttctgtgatcattctcttgttcttgtttttgttttgttttgtttctttttgtggtgcatgtctttttttccctaccactgggaatgacgagactgttatatcttcatgcttctggacaatctctttaatgcctccaatatccgttgactttcaggagtacattgtcccaataaaataccattgaattcaaattaaagtacacaatgtttttccaagtcgaccccttgacattctgaagttctgagtcatttacattgaagacaatcatcttggggttctctggaatcatttgtaggagggcagtgccttcctgagaagtctcagctaatacagttccttacattacaccttttactgcttggtgctttgttccttgtttcccccaggtagatatgcacatgcccaatcaaaaatattcactgtaatcacaaaggaccagcctcaggctcagcctaggatcttgaacctaggctctaggtcttgcagagtcccgtgcataacctcagtgtaaggatatctagttctacagctttaggccaatgtagcattccaagtccccatcctaaaaagaatgatcacagtgtcacttcaatgtagcctactctgtgcataccactgaaaatattgagaagagtgtgtggggatagataaattttcatttgtcccaaggttagcttctcccatcaaagaagccaccagagaacaggctggccaggagagggaacagtccatccagcacagcatggtccagccctcttgtattatactagctcccatttgccttttttttttctggtcttgtgtgttactccttaagcagagaaaacttatcagaagcaggaactcacaccttccatcttgctctctgtgatgtttggggcaagatgatgacttgggtgcaaaattgttgatcagctgtgattggtagccagttgtggtcctggagacatttacccacctgtagttcagggtggtcttccattccagtagttattccttgttccccaacttcatgccttcttcctaacgctcattttgtgggggtttttttcttatttttcagagtctaagattatttcctgtcactctgactccaaagtgtctgtctctctctctctctgtgtgtctctctttcttttttccaggaaccactttccatttgtttactctgccccccccccccgtataagctataaggcacacacacacacacacacacacacacacacacacacaccaccttgtaatttatccattagaaataggaaacccttaatgtaaaaaaaaatcaataaatagtccaagatattatgatgaatccctagaggcactccaaaggcactgtgtgccaggagaggtgtccgtggactgccatctcagcaatggtgatgcggtatcaggatgcttgccttgagctctgatcatcctggactatagaactaaatcaagtcaagtacactcttgtcgctaaggaagtcactcatgtgcaagactccccaggctagagcatttcattatgttcattatcctgtcaaaaaaaaaaaatgttttcccagtagtaagttttttgttcgttttatttgtttgtttgttttgtttgagatagtgtagccctggctgtcccagaactcactactcacagatccacctacctctgcctcccaaatgctggattttttgttttgttttgttttgttttgtttttcgagacagggtttctctgtataactctggctgtcctggaactcactttgtagaccaggctggccttgaactcagaaatctgcctgcctctgcctcctgagggctgggattaaaatcttgtgccaccacgcccagcccaaatgctggaatttaagacatatcccacaccgtctggcccatattaggttcttaagaagtgattttatagtcactgaagttgctggctgcagtagcttggtggatattttagattctatttggttttccagagttatatttggttgggcaagcttttaatcccagcactggggcaaagcaaaggtaagcaatctctgttagttcgagactagactgatgtatatgtatacaggtccagaacagccatggctatgtagtgtaaatatgaggaggacataacctttttaaaaaattaaaaatgcaaaaaataaaaataaaccttgtttcaacacctgtactctagtactaccctgggaatttgataataattccgtagtactgtagagtcactcgcaggaaaatgtaatcttccttacaagccccaaaatgcttacaggttagccttagtttcgccccgttattgcggttgtggggaccctttttctcgttgttgttgtagtgcgcatgcgcgccgcgcttccgcgtttgtgtgggctgggttattacgtcattgggccgcgcggcgcggctggggctgtggttgccggaagttgagcggcggtaagtaagccgtggttgcggagcagctgccggggctggcggggttcacttaggaaagctgaagccagttttgggctggtctggaatattcttcacctgtctatactcggtcccctcgtactccggcagagagtgttgcgatctccgggtcgggaggcgcctctggttgctcattctgtgaagtgctgcctttggcgtgtgtggacgggccacggagtaagcttgtgtccccggactgtgaagggacttgatcttgttacttatgaggaggacataattaaatcttttctactagaggttctgcatccccttaaaggacccagagattacaaattagtactttataggaaatcagcctggtgaggcaaatgcacttgtcagaaagtttctgagccaggcatggtcgcggagagaggtgaccccagccgcagggaacctgagccaagagaactgctatttagaaccagcctaggcaatcggacacaaacccttttgcaaactggaaaacgggtgtgggatgtagttaagtcccagagcggttcttcagcgttccagggtcctgggttcaattaccagcacatgccaaattgaatttgagatgagaccgaatcaacctgcgtctgcaattttatttaattctttaaaattatttgtaactttgagtgcgtgtatgcgtgtgtggtctcatgcctccagagacaagacatggcggaccccagcagaagtggagctccaggcaagctgtgcctgatatgggtgctggaaaccctacccaggtctttgtaagcactgagtcgagtcagctttccagtataaattaatttatttttttaagactgaatgccatgcaccccatgctgtctttgaacactcagtgaagcagaggccggcctttgagtttttatatttctacttccacctccttgagtcctgggattacaggtgtgtaccactacgcctgtttttctgatgtgttcctgcatgctgggcatcataatatcatggactatttattgattttttttttttttttacatccagggtttcctatttctaatggataaattacaagacggtgtgtgtgtgtgtgtgtgtgtgtgtgtgtgtgtgtgtgtgtgtgccttatagcttatacaggggggaaacaggggtaaacaaatggaaagtggttcctggggaaaaaaaaagagactttggagtcatattgacagcaaatactctatcatcacctcagagcttcactcccatatcaggcatcctatttataaatcctggtcacaaatgtgctttccctttcaaacgtgctaatttggtggctttttatgttggtttgactttgtctttctttttttaaaacccatgtaactggtaaacagacctgtctgccttgtagacttgagggctctgcctcgggcttttcctttcccatagactgtttatttgtttattttttattttattttattttatttattatttttttttttggccttggtttgtgaaagctcatgacttcctgttgcttccagcttgcctccacccagttcttactcaaaaaagtcatgtgaggagttaaggactgtggcttgcagtcacagcccattgcccaattagagtcatacttgcttttagttgccccatgtgtatctttgaaaactgctagactgccttcctctctcctctgtagctaaatgcacttagttctttatagtcagttctactgtgatacaagacttttatattattaaatcctaacatacaaagcagtgtctggtatatatgtttaacaaatatgcatagatataccaagtaaatggcatacttgaataccaaataaaagacacatgcgaatgcctattatgtaccaggctttatttgtaagttaagtgtcagtgaattgtacactttaaatgaggtggtagtgattatctttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatctccgagttcaaggccagcctcatctacagaataaattacaggggtagccagtgctattcagagagaccttgtctttaaaaaccaagagatcaatcttctgataggcataattgtacaatcgtttcatctcagtaccttaggaactggagaccatcctgatcttcacagtggggctttgtctaaacaaataaaaaagttgaggcctggagcaatgtttcagtggcttacccatgccatgcaaacacaaggatcagcgacccagaatcctcataagtaccaggtgggcttgatgacctgtctgtaatttcagccttggagggtagaggctggctgtgcagagcaagctggctagctagactaatgatatggaatattgatgagtcctgggtctgattgagagactgcttcaatggaacaaggtggaatgtgatggaggatgactcccaacttcaacctgggcctccacaagaatgtgcacatatgtgcacccctgtgcacatgtgccctcccataatgcaaacacgcatatacatacatggacaacacaaccacatgaaaatggacaaggaacaaagccatcttcagctgcatgccttggtcaaggccagcttgggctacatgaagcccagtctccagaaatgaatgaattagtgacagaatacttctaaggagtgggaggtgcttcaagtcctgggtggttgtataaaattccaggtaacaggatggagagcaaccaggagccatttggtttctgtttggatttgaggatactatttgagaatgtgttgaacaagaataaactctgaggacatagtatttgagccaaacccaaacaatgaaaactatcttcaccccagctttgtcccccagttttcttacactgcttacagttgtcttgcatagagctctgccctcatctgcctggaacatctgtcttcagatttatgtggccaacttctgtgtgatttttggaaccttttaaagagtagaggataggactttattacaaaaccacaggatcaaggttcattttctgaaggccaatatagtggcacatacctttagtcccagcattctggcagaggcaagtagatctctaagttcaaggccagtttggtctacagagttacaggacagcctgagttacacagagaaatgcttttgtgggcagggaattcaggggaatccttttctgtccttagcgtgtctctctctctctctctctctctctctctctctctctccctctctccctctctcattatatctaagtacactatgatataactgtcttcagacgcaccagaagagggcatcagatctcattatggatggttgtgagccaccatgtggttgctgggatttgaactcagaaccttcagaacagtcagtgctcttaactgctgagccatctctccagcctgccagtatcgcattaaagaaaataagcatggatctgcttagtgccttacagggccccaacatctgggaatgcaaagatgagggatgtatgtatcctttccctccaggagctgacttgtgacaatctggcaagaaacttgcagagatttgagggaggaggactttggttgcaggcaaatcaggctggggatacacagccacgctggcactttatcctggatctagcaggtatgtccagtgtgtgcaacccaccacaaaactgcagatttatttaaaacattagattacacagacagcatgaactttataggtgaccgcacactgttctggtgtcaaaagtgtggacccacttggaacagtgcccagggtactccggataaagagggtttgcaggtgataagaacgaggccctgggtgacactgcacggcctgaagggaagcagagccatggtagggttgcaggctaaaaggtgtctgagaagcaggagccacattatgcatgccccgtaggcagtgccattttaagcacagaggctgcatgccactcttctaaaagttacttcctgggcttcagggtcctctatagaatatggaggagaggtctggtgcacatcatacatgaagccctgagttccatctttatagcagatttgggtaaattaataaaagaatgtactgtgtctacaagaaggctcagtggtgagaggtgcttgctgccaagtctaatgacctgagtttgacccacaggacccacatggaagatgagaacatgccttctgatccccacatgcatactctggcatgctcttcctacaggattaaaatgtgataaaaaatatagagtgtatagaaaaattgtgttttttttttaatgttgacatttcccagttggacttggtgtatgcctctcctcagaaggctgaggcctgaggattgctcattccagaccaacctggtccctgtaagaagaccttgtctcagaaagcaaataaggtagaacgctattttttttctagtttctatcatagttcttttttcttgtttggttggtttgctttttcaaggcagggtttctctgtgtagccctggctgtcctggaactcactctgtagatcaggctggccttgaactcagaaatccgcctgcctctgcctcccaagtgctggaattgctggaattaaaggcatgcgccaccactgcccggcactatcatagtcctttcttctgcaccatgtatgtgtgtgtgtgtgtctgtgtgtgtctgtgtgtgtgtgtgtgtataatagtgacagtgtaaaaccccaattgaaactggagcttcagaaaaacacacttttttttttttttttttagagacagggtttttctgtgtagccctggcaattctagaactcactttgtagaccaggctatctgcctgccttccaagtgctgggattaaaggcgtgtgccaccaccgcccggccagaacaaccactcttaagtgaacctcgttcactaagaagtatagagtttgagactgaccaactgcttaagtggctgctttaacttggttttagttgtgagtcaactaaaataaagcaaatatataaagcaaataaaaaggccaattattggatgtgttttaagattagggccaaggatgccagaggcaaagctacatcaccaggctctgtccctagtatgaccaaagggtgagaggaagatgaggtaaacattgcccacttagccttgcctgtatggactgctggctgggaagtttggagacctttacaatgtcattgtggggtagggtgcagcgtagtgctcaggggaaaaacctgctggagtcacttctgtccttcctaactcctggggaatcaagcaaaggtggtcaggcttgcgggcaagcacttttacctgctgaatcatggacttttactttgaaagcgctggagtaggaagtggagagctgaggaagtttgagcaaggagggtgtatgctgtcatctctaagtcactgcacaaggcaggtcaacctgaggacttgtcaggattctgtggcagtaatccaggtgacagaggacaacagctggtcagaatcactggctaccagagaaggcagtagatttttgagaaaggaggtaggttttgctggcctggctcagaagaggaagacgacaagactcatgttgggggctaagttttttgcttaagggctctggttatatctgccttctctgaggttagacttagagtcagttggcctcgttttccatctttacccagggaagtgaaacccactgatgccttcctcttcctcgtcctgatttcccctccctctcccagagtctgaaggctcactgtgtagtcctgggtgagatgagacagaaccccagaattccaggtgttcccaccttctttacttaggccctgccctttgaactggcatgtgttcattaggttggggcatatgtggaaaggaagtctctttcaggggatccagccatgtggggaaggggcgcacatgccttggcgtttcctaaaggcccaccagtgacctagtagacacatgatgttcttcctacaatcgcactctgtgtctccagcaaagtctggatgctacctacatggctatgggatgctcttgaccatttcctgagtcctcccccacagtcctcagccgccctccctgcctcttgcttcaccatgttacacccatcagccaagactcttctttctctgttgcttctcacccactctttttaagccttgtccattactttgcacttaatttctaatctggggaaagatagtatgttagcaggggcttggtggctaatgctcatttgtaagaccaccactagagacaggcagaaggattatgacagttgggggtcaggctaggctacataccgagtctttgtttgaaaaggaggatggacaggaggaagagggactcaggaaagccaggaagaaatcatggactatgaggctgattcctctgtgaaatcctgtcttaggcttttattgctgtgaagagataccatggctgaccaaggcaactcttataaagtaaaacgtttaattggggctggcttacagttccagaggcttaatccattgttgttatggtgggaagcatggcagcgtgtagggagacagagtgttggagaagaagctgagagttttacatctccatccacgggcagcaggaagagacagtgagcctctaggactcttctgagacctcaaagcccacccctagtgattcacttcatccaacaaagctatacttcctaacctatcggggccatttctattcaggccaccacagatccagtcttctttccctgagacctgactgcattgtctgtccattttctttggtctttcactatccagttccccctcagtagcctcggtttctctcttcttgtggaaaaagaagcacagcctctagccattgcctacccttccagccacggtgttggtgagagcagtgtggagcgctctgcttcctcccaccttcactggttgccatgctttctgtacccagcacccaccacactgcatccccaagcagctgacagcattctgccagaggtccccagttttcctgcttcatctccagacttcttaacattacctggtatatatgcattgctggtgtatgttcattgctggcgttatcctgtgcttaccagcctgaccattttcctcttgattacatccatggcctctctcccttctactctgagtactagttttcttcaaggctgtacccacaattctttgaccttctcacatacaactttatgctaacagacctgtgacccctgttgtgtgtcttggggaccctcctgcaatgccaccctggatctctgagtcaagatggaagcttgttactgttcctgtaaacctgctgttctttctgcatcctttaatttgccatcatctttttcctcagtccttgacgtagattctcacgtctctcttgggtgttccctcccttgcagagtctccttcctgagtgactcttgacgagttgtacctgctgtcctcctcactgccttccctccttgccttgtccgcatgcatccccaccctgcctcctgctgcttggcccaccttagcagtctagccttgccactgtacactccctttctggagtacagagccctgctggaatggaagtccctttcctatcaggccctgcagcgtgcatatagctctgcctactccggtgaccaaaggttttagctgctctgtcctcacgcctctccttcatcctggccaggctcattcctgttcgcctgaacataccctgctggccattcattcctagaccttgtcatcagcactgtgagtggttcgggactcaggcagatgctcggtaagcagtggtgggaacatggaaatcagcacagttctttttgaactttgcttccaggaaagacagatattcatcatgtataaaatgatggccatggtagtatgctggccctcccctggaattccagtgctcacaaggccaaggtgggaggaagttgaagcctgcctaagctatatagtgagactgtctcaaaaaataatattcataaattactgactgtacggtgaagatgaggtgcagaagtgcttttggaaggtgcagtgtctgtagaaagaatggcgaggctgagatgtgcacggggaaaggagatacctgggtgaatgtcgggcaggaatgttccatgctgtgcaggagccactggaggatctggaattggtgtggaagcaaaacagcttcctttcttttttctttaattttgaaatagcatcttactctagtataggctggcctcaaactcatgatcctcttgcctcactgtccccagagctggggttgcaggtttgtgctgcactccccagtttacccttctccttttgctctatcatagtgtgtaagtgtgtgtgtgcctgtgtgtttgtgtacgggtatacacatgcaagtgcatgcatggaggtcagaggcagacaatcagtgtcttgcctgccattcttctccttattcctttgtaccaggacctttcactgaacttggagctagaatggcagccagcaagctccagtccctccacagcataccgaggtgcaggcatgcattgctgttgctggttttttacataggaggtggggatgcaaactcagatgttcatgattgctcattaagtgctgttacccactgaggcgctcactcagtcccagtgtagcttcctgatctagtatttgcctgccacctgccctattctcgggatttagaagtgtgtgggctgttttattttactgttttactttgtaatgataaccacaggatgtctctttccctttttcttttaattgagagggaaccagctatgttcaacattttgtagtgtaaggctcagaagaaaaaagttattccactcagcctgccctaggcccctgttgagagtgctcttccagtttgtaaaagcttggctgaagggtcatgggaaacagtctggcctagttaatgcatttagacacgcctcctccttcctcccaccacaccagtgcagacctttgccacactctgcagactgcgcttggctcaattccaagctgcgctgctgttgccagcatggattccctgacagttagctctgaaggtgggcctattgctgcctaccaaaccctgaaataggcatgcagggtgggtgggggcaagagatcaggtaagtgtttgctgaaaggtaggaaacctgtatgtctttaacatgttttgattgtattagctcatcgttcccatattggtactgaacccagggccctgtacttgctaagcagggacttcatggccacattaaacccccagacccattgctatctgttttgtatgcctcttatacagcaactatttgcattttctcgctgttagtacatcttgtgtacacatgtagaaaagtctcagaatttgaaagatagttgggaagggaactcgagtcctcagcctgtgaaactgtcctccctctcatccatcctacagcgcacgaggctgtactgtgttcctgcctgtaggttttaggtctgtttgtttgcttgttggttttttgtttgtttgtttggttagttggtttggtttggttttttgtttttttcgagacagagtttctctgtgtagcccagctatcctggaactcactctgtagaccaggctggccttgaactcagaaatctgcctgcctctgcctcccaagtgctgtgtttgcttgtttttatttttttagaccaagatgatttggttttaccctaggtccctgggctatctagtctctggttctctagtttcaggtatgggttccatctggtgaagtgagccttaaatcagttattggttaattacttccataagctttgtgctactattgccctagcatatcttgcaagcagtataccactgtagatcacagagtttgtgccagccctgaaacttttaaagaaatatgtctgcactttgtgtgtgaataaaggtacgggtatggagatcagataaaaaccttaacaacctcaggtgtccgctcttgccttccaccttgtttgagacagtctttgttggttttccactgtgtgtaccttgatagctggtggggaagcatctagaaattctcctgtctccgcttctggtccctctcccagctaaagctctaggccctgaaggcaggcaaggcactttttagccagagttagagccatatttgtggaatgctgtaggctagcacaaagagggactggaaaatggattgcagctctgcctctgcctcctggatgccaggctctggggcaaacattcccaccccccttccttttccagaggcatcctggcttgtgacatcggctcacacattacagatgggaaaatctaggtttctcagctagtagcaagtggacccggaacctggctcctagggggcttcaggccgaatttttcacttcatcctgccaactctgcttctggcattttttctctgaacctctaaaaacttccaaactctctcaaagcaatcaaacaaaaagcccaaaacacacagagaagggactgtgaggctacagtggggcccggaggggggtagactggtgtatttctctgctcccctctccagctccactttctttgcagagggctttttgcttctctagctgctaattttctaccagtgtgcctcctttgtttctgacaatctactactggtctgcaatttgctgtgtccaatccaattagacccatgctgacaggtaactgctaagcaaccttaccacaccccagcaaacacatcttctaatcattttatgaacatcaaagcccatgccttcttcttcagcctgtttcgtaaaaaattccagaagagcagtgcaaaagtactaggtcatggaagtgctaggtcatggaagtgctaggtcatggaagtactaggtcatggaaatgctaggtcatggaagtgctaggtcatggaagtactaggtcatggaaatgctaggttatggaagtgctaggtcatggaagtactaggtcatggaagtgctagatcatggaagtgctaggtcatggaagacagttcttatttgaagcaggttcttctgcattaaaaggaagtaagtcatcacctgctaacccaggtggagatgcgaaccctggggttcttggtaggtggctttgtcttgacattggaggctttcttcatttatattcagattgcacacacacacacacacacacactgatcatgactgtgtctttacaaaggttgatggggcttgcctgctctagagtaaagctatgtgtccaggtggtaaaattagtctttccagcagaaatgttgctagaagagcctgtttatccctttcctagaaactccattcagggaggtgtgtgtgtgtgtgtgtgtgtgtgtgtgtgtgtttgtgtatgtgggtttttgtttttgtttttgtttttttttttttttttgatgcatgctctcatcatatagccctgaatttactgtgtagctcaagctgacctcaaactcacagcagtcctcctcctcagtcgcccaaccagaactggcatctcggccccctcagctttccacgtggttttacccaggcagccccttagtgaagctgagcctggttcccaccctttccagttgtgtcttcccactccctcagtttgcagcagagcttcagtgggactatgacaccttggcggttgtcagcttgtcctggtcatccattttgcagaatgcttttcagtttgggtttatttgatgtttacacctgcccagggcatccatgttgttctcatgcacttgacagatagcacagactgtctgctggcattaactttgacatcatcaacagcatttttcttttaacgtgctgggactggaacccagagctttgaatgtgccaagtgcaggccacaccactgggccataccccagctcaaggtggtgtcttcttaatgaccaggttttgtccccatagtcactttctttcttcttatggttttccttttcttttcttttcttttctttttttttttttggatagctatggtgaggctcaagggagaccccctgaacttccttttttcgggagcactttcacaagcacatcctctcttttgcttctgtgtgtagtatggagcaagttaagttgacttgtgaacactgagatcctagtcctcaaggaaggacagtaggtcagagcccttacatcagttagcagctccccgtcctatgtgttctttaggcttgtcgccactgtccatggtaataagcttctagaatcaacagtctgtcttcccagacatagagacgcttgctcctatgtctctcaagggagattcccagaaaggaatctagaattcatcccagtgacatttgtttttacattcttgtttgtttattaatgtgtgtgtgtgtgtgtgtgtgtgtgtgtgtgtgtgtgtgtgtgtgcatgctggttcgtgcgagtatactttcatgccatggcactcacgtagaggtgagaacagttgcagggttaattctttccttccactgtgtgtgtgtgtgtgtgtgtgtgtcctaagaatccagctcaggttgtcaggtttggtggcaagtggctttatccatcaaaacttctcaccagccctcttgtctcactgagagccattttgcaagggattagcaatatgggaggtgtttggcatgaaccatgatctttacattgggagtttgcaagtgaatggatggagacagatgggcaagcaaagaggtgaacatggaaccagatgcacaggaggcttagcggcagcagcgcagtgccacctgtgacactatgggctgagtgtctccaggttcttggcctcttaatcatgagtaaaatagagctcatgcaggtgacaaggtagtgaggaaactttaatcacagcaaagtaacagaacaggtccgagtgtgcggcaagagcgaagtaggaagagtcacatgagtggagatactctgcctggggtctgaggaaggggaggctgctgctaaggggctttgtggttcagatggttctctgtgatgatgggttaggtcagataacctgctgcacatgtcactgccagtagaatatgtactttcagttaggcacaggtgtaagatggcctagaaattccttggaggatgcagttttgcctttctgtactaaaactggttcttatatctggacacaaagagagcacaatgaactggaatctgtctgaatttgaccgttgtcaagggaaggagaaaccaatttgttggcagaggagtagtgagtatgtgtaggttgatgcatgcgggggtcctaggttgctagcaggttgccagacccattgttgagagaggtgtgtttatgagtgcatagtataggcaggcaaatgtctcaggctcccaggtgcattcttagaagcaggaggaggggtatgtataccctttaccaagtggagtccatgttactaaactatcctctactctcacttgcctcagtaagcaagagttgggagaaagaatgagcaatcctttggcagggagagcatcagtggggcagctgaaagtaggcattagggcacagtaggccatttaccttttgcttcaagaagagcatcaagtcagagatgcagtgagacggggtcaggtgctgagagtgaaggacttaaaaggcagtggcaggaagcaaaaggggtgaaggaaatccccaggatgcgcaagtgtggcggtgaggtatggcactggagtcctgctgactcagtctttcaaggtgtcaccaagtctcaataaattttaaacgtgcttcatctaatgctgagagctggctgagtgttctgcgtagactgtatttacctgatcataaaaatgcgtttacagagagcagggcatggtggcacatgcctacactcccaagcactcagaagattaaggtaggggtgtgagttcaggggacagcttggtcttcatagaaagttcacaggatcctgacatgcccctctgcccagtatgtactatattacaaggtcacatcctagatcaatcgattgtggcctttgattccaaccttggaaactgcttggcctttggcaggccttggtcctttctgatgccatgtaaaatattatggcaaaaatttcagtctctctaaagcataaaaacaaagcataataataattttttaaaaacagatttttttttcactttcagaggccagaggaggacattgattgtcccgctctatcaccctctacctcctctccttgaaatggggtctccagtgaagctgtagtttaccagttttgatgactgtcctgccagtgaacttccagtgtccacctgtctgctccccagtgctcacactcaggttcttaggtggaatctagagatctcagctcaaccacgtgtccccacccactgagccctttctctagcctctggcttatacctttacaaggttgaaaaaagggagattaatataggcaaaactatttgtggcttgcagtttctaaaatatttactttgtagccacttccagggaaagcttgctagccctgatgtggcaggcacagcatcatttgacaaatgatcatcaaagcgacattcagatgcttccactagtggaaggcatgagccgcccatttcctgtctggacagctcaggcaacattagtcattttgggttctgatgggctttgccttactgtacgtcatctgcacattggcctggagtagagacgagaatgtggatttcatgtgagagtttgtcaagggtcttctgtactccaggtactgtgctcagctgagggaaggtgaatgaaacaattttaattttaaaaagtacttattagatttaattccttaacattaaaaaattaaaacatggccgggtgtggtggcgcacgcctttaatcccagcacttaggaggcagggacaggagaatttctgagttcgaggccagcctggtctacagagtgagttccaggacagccagggctacacagagaaaccctgtcttgaaaaaaaaaaaaaaaagaaagaaagaaaattaaaacatgacaggtaaaagatccagtttttagggctggagagatggttcagaggttacaagctctagatgttcttgcagagaacccaggtgtggtaccttatagctgtctataaccccagttctaggcgatgccctcctcttggcttcctgaacacctgtacactgtatactcacagcaaacacacatgtgtataaataaaaactaaaaaaaacccttagattcagttttaagtaatttttcagtctttaaaatcaacagtatttaaaatcttttgttgggggtaatatttgtattagatttctacaacatcctttatatagtatattagttagggttctctagaacagttctctctcaacctgtgggttgtgaccactttggcaagcctctatctccagaaatatttacattatgattcataacagtagcaaaattacagctatgaagaatcaacaaaattaattttatggttgggggtcatcactacatgaggaactgtattaaagtgtcacagcattaggaaggttgagacgcgctgctctagaggatcagaactgataggatgaatctatcgtatatgtacaattgacagtgggttagactatgggccagctagtccaacaatggctgtctaccaatggaaagtctaagaattcaatagttcagtccatgatgtttcaattgtatatatttcttcagtattctctggaatcccaaagaagtaggctgtaaggccagtgaagagtagactggccagtgagagccagggcaagcaggcagagagcaagggcttcctccttccatgtccactatataggcagccaccgaaggtgtggcctagatttagggtggatcttcctattttaatgatttaattaagagaaatcagtcacaggtgtacctacccagctgcttgggttttagttaattcaagttgacaaccaagaacagccccaacagtttccatctttaaaaatatgtacacaattctcctcatatctgacacaattgccaaagcctttttttcttctcctatcagtggagcacagggccaggaggtgctgacgtaatcagcagggatagctctgacagtgctgggtaactcctgccctgccaaaccatcctcaagcctgtccatacagacagtcagtttggacagaaagaaacctgctctcaatttccttatttctgtattgctgttacagatacataataccaagttagaaagattcagagatgatacagtgtctctgttagtagctgacccctgacccctggccttccacttcttactctccagcctcctgccccctgctttctgctcaccacccctgccacctacccccaccctcaacttcctccttatccttctgcatcctgcttacagttctcctcctgcccaggcccccacctctagtccctggcccctgcttcctactccctgtcccttttcccttgactcccgatcccccacctcttgtcctccacttactgcctccttttcctgtctcctacctcctaccccctgtgccttagccttccccgccccgctccttattcccatctcacctccccagtttctttctcttggtaagttaggtcataagctttggataagtgtcatgctgtgacatctgtgctcccacatgtaagtcactgggtgtggctctgttgatagattagcaccaggactctgtggcagatgaagccctgggaggttgttgcccaaccatgctgtcatttcctttcatcttagctgtggtttggctgctgggattcttttctgttacatgccaagccctcatcaaagcctgtcttctttcactagaagcaacacagtcccatcgggagacttgggtttgacccacactcagcatcgggcccttgtctgatcacagtgcccaggtataggtgtgttcagcttctaagatgacaagaggctgaggtctctcctgctctactcagagctgcagagcctagctcttcaggaggaatgagagccagggagaggcaagactgactccacccctgggtgcacttgttcctcctctaggtcccctgctcttcccatccatcttatgcatggttagatttcatgctgttagattcctcagaagtctagcctgtcctagatgcttatagcaaattcctttgttgggttactgtgggtgttccaccctcctgtcacaaagtgaaacccggccacaccctctgtgaagtcaataggatcttctattctgaccagattttctcaaagccgcataagccataaaaagtttgaaccacgtgctttttatgctcttttagcatgcctcttattgcctttggggtttgtttgttttccctagtacttccctagctttacagaggtgtaaacgacattctaagtggtcactcatggtgaccttcccagcccttaaagctatagaggcttttttgtttgtttttaaatttgtgggatccacctcagcaggtcaccagagaacagtcaggggaaagtgagttgggcctgatcttggggagggagctatggacatctgattctgcaggcctgagtgcaggcctttgcactgctgtggctcctcggcctgtctccccttacattaagtgtttagcttatattggaaggagatcagtagcaaatgagtatccaaacacaggttgttggttagcttaagagaggaaagaataaagattctgaaaaggtcttttcacacagatcctactgtagatggtatggcagttgtcattggatggctgcatacaatgtatagcgtatgcttgatgtgtatagaaagatgcttaatgcttggaagaatgagcatcaagggagaacacttcccattggccaattatgaggttttgtaaagggatctgggaagatcacttagcaaagggcatgaagaccagagtttgcactccagaacccatgtgaaaatactggacaccacccagcaaggtggctcagcagtgggaaggtgcttgccaccaagcccaacgacctcattcattcagtcccagaacctacaaggtagaaggaaagaaccaattcccacaaattgtcctctgacctccttgtgcatggcatgatacactttcacaccccatctgcctagtaaaaaataatgtaaaaataaatgctgggcttagtgctgggtcgcaaagacgagaagaggcctggggctcactagtcagccattctagcctgtgagttccagggcaacgaggtgggtgttgctcctgataaaggtctctaagagatagaagggagttgtcccagcaaagaggggaaagatttcttaagaatacagggaatggcagccatggccatcagccccacggtagcaccaggtatccatcggcataacctgggctgctggtcaggcttcctgactcctggacaccaaccttgttttttgtcccctgcataggaagatacatgggacccaggcaactcaatttttaaaaaaagatttatttttctctgtgtgtcagtgtgctagtttgtatgcaagcatagtgcccttgtgggaccagaagaaggcatcagatcttgtggagagctggagttacagaccgttgtgagctgccatgtgggtgctgagagctctagtcctggaagagcaatatgtgcttttaaccactgagccatctctgcagcctcacacacctcattttcccgaatctctcattagggtggtgcacacctataatcccagcactcttgaggctgaggcaagagaatcaaaagtctgtggacaacctgggctatgtaatgagaccctgagtgaagcattgcccaatatatgatgctagtctttgtaatcagtgaggctcaccagttctataggaaaaggattcattattttcatcctttctgctgtgttctactgatttttctcaacttcctaggcctgttgagagtattccatccagtcacgctggggctcttgtgcccaagtgtactttgaagtgggcagaacatgaagtggcctgtagaaagtagttctccctaaggctttcatcagcaaagtaacctagccccagccatggggccacaggcagctcttgtggtgtcctttgtccttgctcttctctaagggctaaccaaggctcctccttcctctgtcctccttggtgggattaaaggcatgtgccaccacagccaggccccttttcaaagtataattatcaatcagggtatattgcactttgtaatggactgtactgggccatctcaatacaagtgggtgttgtgctttggtattcattgtacctcttttaccgcctcttctctttcctttgtagtcttctttcttgaattgaaattccagcttctgcagataagcggaaacgtgtgctatttgtctctgtcttctttaatgatgactcttagttctatcgatttttatgcaaacaccctgatttccttcttctctatggctcaccagcactccattgtggctatgtagaagttttctttctccattcatctgctgattccggagattgactgatgtgtacagtgctgcgataagcagcttgcttatgtctccagtatataaggtcatagagcctgtggtacatgcccaaggaacagtgtggctcagttacatggtagttacatggtgcctttttcaggaagcatttggctgcagctgcatgcattcatttccaggttcctgtattttattccactggtctacatgatgtattttctcaatacatcacactaattttgctactacatataactctgtactatactgtgagtgtgtgtatgtaaaaattaatagaaagggtatcattgtatagctgtgactggactagaactctgtagaccaggctagccctttactcacagagatctgcctgcttctacttcctgggtgctggagttaaaggcacgcacctcgcccagcttctatcgtatattttgaatttaggtaccgcagtgaccccaacattgctccttttgacaggattgttctgactttaccgggtcttttgtgtttccacataaatttggtttattttgtttgagccatgtctgggcttggcctctcaattctcctgcaccttccttccctgtgctgatattacaggcacacccatacccaggtgtgtgctttaggatttttctctagcttcataaagaatgttgctttttttattggggactgtggccaatgtaagccttgctgcagtagcgtggtcacttgaaagcagtactaactgtcctgactcagacacgagaagtctcttcactgtatggcagtgttctaggtttcactgttggagtcttcgcctcttcagttggctttattcctgggataatcttgttgtgagcagtgacagtggttgttttctttcagtctcagtgagttcactactggcacatagaaaagctaatgatttttcaacattgattttgtaccctgctcccttgctggatttgtttatagattctaagagtcttggcagagttgtaaggatttcctaagaacagactcctgccatctgcaatcagggataatctgacttctcccttcctgttgacatcactttctttttctttgttgctgttctggctaaaattccaagtactgaatgagccatgagtacagacaccctcatcttttctgtcctccgaggctgcaagcttctgctccctcagccaaacagaggtcctaggatgtcccatcttgcatttatcattctgtagtacaagggttctgtatcttattttctcatatctttgattgggaggtgtgatggtttgaatatgcgtggcccaatgtaaattgggaacatggcactattaggggatgtcgccttgttggaaataggtgtggccttgttggaggaagtgtgtcacggtgagggtggactttgaggtatcttagtgctgaagctctacccagtgtggagaagatgctcctcctggctggctggcttcatatcagcatgtgaaactctctgctctttcagtatcatatctacttgtaggctgtcatacttctctccatgataataatagactgaacctctgaaactataagccaaccccaattaaatgttgcctttataagagttgcctcgatcatggtatatcttcacagcaatagagccctaactaagccaggaggagatactgaattttataaacatcattttctgcatcagttgtatgatgcagatgaatcagattttatgcttggtgttgaggtttggtttgttgctctgcattgcagtgctaaattctgtacctgaaggtctaggcctatgaatttaccagcttttgttgggccaactttgttccttaatttaaaactactggttaaataaaaatggctacagccaattattggagggaattgagcagaaagaaggagaaggaagcagagaacgaggaggagagaggagaaggcaccatgaggggagatgtaccatgagcacttagccaggagaaacagcaagtatttgggaacactgctgggaaggcagccaggccagtagttagaagactagattagaggttactctccagtaattttcaaggccaaataaaataaccatagtctgaatctcttttatttgtaagctagttgaggataagcttaaattggttgtgctacacttgggagctggcctatggggctacaccaacttaaagagcatccacaccgaaagagacacctacagaaccgagagctgtgctggccacgcatctgacagaggcttcttgtgcagaagacctggcaacttcagtgaaatcaacaaggaaaggacaggttactcaaccacagaatggcaagcaaagttctcaacagagcatgacagataataagtatataaaaatattattcaatattggtggccattagggaaaggcaaatcacaaaacaaaacaaacaaacaaaaaacccacacattgagattctatctcacctcggtgccttttcttaaaaattcaattcaggtcaaagccctgaagcttttaagtacttgaaggggagcacccatgttctgacagaggcagtcatcccctccatgaacccagtagctcctaccgcttatctctctgggtcaccttcctgggctcaccttagtttccttgtctctcactaccctcggttgaaatgtctgtgctgcgtttgtatccctgtcttgacactagctccccttcctagctctgcatgcgtgccactcacagggcttgccgttgttgctctttctgtttgtttttgctgtgctggggatccaatgcaggtctcacactttcaaggttgtaccacaactgcattccttgaactccataagtgaccatgtttggtcacctttcctaagtgtccccaggtaggatccctcttttcttttctcactttctctgccctactcagctcctcatccgttcccagcctcttttcttttctctgcagtgctgatggagcctagggcctcatgtatgctagacaagaagtctcctgctgactgagctgtatccacatccagccctgtactgccctcacctcctgcagacctttgctgctgcaggtgtgtggtgctttgtgtgtacctgctgctagctccatccgggattcttgagcctgccccatagcttctcgtgtgctggtgtttgtaaccagccagctttgtgccttttggctgtgcttgctcagggctccactctgggatggttgcactcctcccactcctacaggagtcgatcctccgtccctttcccttggatccctattatccctgcattcagccttttgaagctcttcggtgccctgctcttcctttcttgcagccttcctgtcagaactccttctttctgcttctaaactccaaaatggcggggaaactgggcgtctcaaaaactttggcagaaaaattgtgcaaaacccatctggatgataggaaaggtgtctgcttgaaggttttattatttatctgtatttgtgctgtctgagtctgtgtcacataagtgcaagtgactgtagaggccagatagggctgttggagctgcagttataggtatttgtaaaccaattacatgggtgctagaatctgaactctgagccatcttcccaacccctgaattgtctttaaatagtgaataaaattattggaggcagtcattatgatcacagagcatgagaattactagcaaacatgaacactgagcctttttatctcatgggagctcacccctgtatgaacaacctcagtttcctgagatgttgttaggaaccagcatctttcctaacagtctaaatgacctttggctgtagtaattcctgaagcagatgcctccttgttatttaaaatgacacataattcctgtaaattatacgtcatctcacagtcaaggcacgttgttaccttcccaagccagagccttcattctgaattgcgtagagaataccgaatgctgcattttacatcttctgtgaaatgctcaacatgggctagcattgagtgcaataaaacctgctttcgacatgtctctcagttattaaaaatgtttcttagtaggtcaaaagttgagtttttactaatctggaagaccaagaaaacccacttttcattctgtattgttaatttctacaggatcctatttaaatgcagtcagccctaacccataggtagcaaggcatgatgggtattgttttcatttgtgtctgacagattcaacctagtgcatcataataaataaataaagtgtcctggatgctcggggattaagaccacgcgttgaccttgcagaagacctggcttagattcctcttctggtctccatgggcacctgcactcttttgtgtatcaccccctccccaccccagagacacattcgtaattaaaaataaatcttagttagtgttctagtttgttctcatctaataaatggtaaaatttaatgtataccaaagaattattttcaaataaatttcttcatgatttattatcagtaaatgtttgatttctatacctactatatatctgttgcattatgcactttcccctgtgatagaatacctgatggaaaaactgaaggaggaaagggtgtattctgctgtagttgatcatggtagtgacatcctggcaccgggagcaccgggtggctgtttaggttgtgtccacggtcagggtgagggcaatgagtgttgacgctgcactgtttccttttccatggaaaggctcccagcccagaggatggggccagccatatgtagagtagatcttctcatctcagtaagtccagcctagaaacctcacagacttgcctgggcttgtcttctgggtgatcattaggtcaatattagtcatcacaaatccatctcttgtcaacttaagacccaaacatactacttttaagttatcaccatgcatctgtcatcctcataggtccatggccatcattcctgcagatgtattctgtctaacttaagagtccccatagtcaggactggcgagatggcttagtggataagagcactgactactcttctgaaggtcctgagttcaaattccagcaaccacatggtggctcataactactcataataggatctgacactgtcttctcgtgcgtctgaagagacctacactgtacttatgtataataataaataaattaaaaaacaaaaaaaagagtccccatagtcgtcatcagccctaacccagtttaaaagttcaaaatccagaatctcttctgggtctcaaggcagcgaggatctataaaattaaaaaagaaaggttacatattcccaatgcccatggcacagagtcaacatctgctccagaagggaggaatagcagcacagtgggaaagatcagcctggaacaaggctgaggcccagcaggctgaactgcagctccacatctggtgtctggagctctcgatggaatcctctgtgccccagaaggcttaggtagccctcatttgtggattggctctcatccctcattcacattctcatagtgagcatctctattctggcatctccaacgccctggtggcaccattgaagttagggctcaccttcactgccacaccttgcctggctgccatgacctagaactttgacacaagttccacgagtcccttaattattgcatctttcatgcttgtaaaaccagccttcaagttcttcagcgagctcaggctgtactctggcttccaggaccacagttgcagctgtccctcagtgccctgtcctcaggaaacacttcctaggcccctgctgagagcagggaactccttcacctcttgagggagtttgtattttcccaggttgaggccctcaggaatgcatgcgtcctcagggtctttactgttccctagttcagagcacagggtttctccttactggttctagtatttgtaatacttacaactgattctctgtaccatcttggtgggcaaatttaacctctctctaccacatagcacattttaaaaagtccttttctctccctgtcctgctgtagctctagataagagcagtgagtagggaccacagtgtggcctgagtggctgacatgccactaatccattgcttttgaattctgcttcactccagttcccaggacatgggtggaatgaacccagcttctttgccagtgtgaacaacctgtggcacagttcccaattagagctcttgcctcctgaaacctcatgggcttggcctcctctgtgcatttatctcttggtgttctggtcttccaaactcccaccaaaacgttcactatgctctgcttacagccatcttaggcttttccagcccagagttccaaatctttccccatgtatcccccagctttgttccaaaggcccagaatccacacaatcaggattgtcacagcagaagccccacattgggcaccagtattctgtattagtatttttctcatctttgcaacagtatacccagtaaagcaacccacggaaggaaaggtttgtttgtttgagtatgaagtccattctaatggtgttatccattttacccgtgtgtccaattgtgtaaaattctctaaaatgcaccatggttgcaagcagaaaaactttaagaatccttgctatgtagaatattaaagaccactcattaaagggatttataaaggctttaaagtagacactattttcagtcctggtaaattaaaagtattgtgttagctgtttatatttaaaattctcccagaaagcatgttttgtagacattttctaaactttatataaaaagcaaaaagtttcagtaccgagttcagtttgagttttaatctagatttggaacagagctaaataaatcacattataggaaatgagaagctcagtttgctgataatgaagaaagctataaataccaatagcaacaaaaagcaagttgtcgaaaatgtgtggttaattgcctgcaagctagctgaaatatgtatgttttgtttggtcattaagaaaatgatttgtaacactcactgtgacgtttgctggcctagtttaaacgccaatgggtgcacaatgaacagttctttcactttttcttaatagtgttttttttttttatttttggttgtttcacatatttgtgcaatgcctgttggtctgtctagccaccactacacctctagcttcccctacagcccccacctcatctcccctctagctttatgtcctcattttattctttaactacctgattccagttagtgccaccatgtgcacgtgggggtgtggccacccactgaggcataagcaacctgccaaggctacatcccggaaggagagtgagtggctcatcttttttcagagaaccagaagcttctctaaaagcagtggggtatcaggggcttctgcatccaagaactccccatgtagctcatagtatacgtacctcagcattcccagtgatgggattgcaggcattttacatggggggggggatttcctatttaaatgtccagtgtccatataaaataatcaacttcaaaagggtggtggcacaggactttaatcccagcacttgggaggcagaggcaggtgtgtctctaagagtgtgaatgaagccatcctggtctacatagtaaatcccaggccaaggatacatggtaagaccctttctccaaaaaataaaaattaaaaaaaataaaccaacctttaaaagatagttaattcataacagattttaaataaaacatttcagatttagctcttgccataaaattaattttctagcttttagattagcttctattctagaaattaaagtcaatttctaagaatgcatagcatttctttctatttctagaaaatgtagaggctgtctaaaagcggggtcatctgttctggggtgtaaaaaccaatgtgaatgtatgcctggatagctaagagactaaactaggctagactaagactagacaaggaatatgctttcagccagaagccaggaaacagtgagaatgcactgcctagtatgaagtaagcggctaataaccaagtcaacccaaataatcctgggccatattgggcaagtcagcccatattggtggtcacgtgtgcagtaagtgaagtaaatgaatctgaacccaattggttctttaaatagacacatagccgggcacaggcataagcagctctttggcaaacaacattgttgctaagttgattttcatttttcctttggcgcagacagcattaggattttaaatgtgtgatggtaactagaagcaatgcatacaggcctctggaaaattcccacgagcacagtggtgaggccaactccacactgctttcctgccatgaggctttcctcatctggatgtgagcacctgacagtgaggtacacagtgtggtacacatggggtgtacattgctgtgttgcacatgcgtggttcacaagcatggtatgaatgggtggttcacagcctgctggtgcacatacattgatcacgggtatgcacatgggtgttctggtgcatagacagggttgcttgtagttcacagacgtgcacatgtgtgtgtcacagttctggtttgacttacaagaccacattcacttgatgacttgagtgaagaaataagagcactatgaaacataatgaggaatacaaaaattccatctacttaagagatggcaacaatccccacactagcacagatcctatagggagggaaaaatgagacctaatgtgggagtttaaaggagttcagactcatgcacagtggctgttactcctcagctgagtgctcagcaccgacctcaaacaggcagacttccacttaaccttctagatagctgtccttgtcctccatctctcccttcttgacttccttttcttttgcttccctccttcccttctaacatggacttacattatccagattggccttgaattcagtaggtagccaaagatgatcttgaactcttgatccccctgcctccatcttccaaattctgggatggcagaatgcttcagcacaccaggatcagacaggcatgttctgactgatagactattgattcataggattgtgacagtcttcaaggagtcagtccctagctgactccgatgagaaagggatggagctgagggtgtagttcgggactctagtgcttgccttgaataggagagagcctgggtacacatccagcaccaatataacacaaaaaaagttaatgccagaaaggttgtttataaaattactcctacaaagagactgaacttgataaattctgcaggatgttttttaagttgtttcttaggtgaagtaagcccaacattgaagtgtaagtcacgcatgagtccccctctctaagggctctctggggtcagtctcacagtgacagagtggttggtgctggggccctgggagagggccagggagctgctctttaagggtgcagagatgagcatggtggtgcacacctttattcccagcacttcagaggcagaggcaggtggatctctgcatttaaggccatcttggtctacatagtgagttccaggacagacagggctatatatagagaccctgtcccaagaaaacaacagtaacaataatgatgatgatgacaattaaaaataattgtcaggagtcagaatggctctagaggtctgtgattgacccttaaactttgggactgggcatgccaacagtcagcagagtatgactgcagtcttaaagattggctgtgtcttaagagaccttatgcctttggttagctgtttagaaaaaacaaacctatctatctatctacctacctatctatctatctatctatctatctatctatctatctatctatctatcatctatctatctatctatccatccatccatttatttagtatgtttgtgtgcacatctgtgagtttatgtgccttgcattcatgcaggatccaaaggaggccagacaagagcactgaatctcctggcactggagctacaggtaggtgtaaggcactgcgtgggttctgggaaccaaacccagtcctctgtaagagtgatgagtgctcttagccactgagccccaatggtttacttcgattaagctctattttttctgtttgttttggtaggctggtaagaacagtagccatgggggaccctggactggccaagttgcagttcgccccctttaatagtgccctggacgttggcttctggcacgaactgacccagaagaagttgaacgagtaccgcctggacgaggcacccaaagacatcaagggctattactacaatggtaggcagtccccaccttctcacccccatccatatattcctacctgtcctctgtggaatcagcaaccctcattaggttgttattgctcatggggtgctggggatagagcccagagcctcctgaacaccagacaagcctcctctaagggacgtgcttgtctttcttttctcaagtcttcttttgccccaagtcactttaaaatttttaaatttaaatttaaaatttttcttttccatctttgaggggtaagaggagtggtggagcgcagacactgctcagctagcttccgggtgggaggtgtgtagacatttctagggcatccgttctatattggtcacagccccttcctgtcactctctctcaagatccactgttgtctgcaagtcatgggtcagcagactcacatagggctccttgggctcaactttccaataaaaggacatgactagccatagatgtttttgccatgatactgccactctggcttgtccctgagatgtgaaaatgcttccacacaggtgactctgctggtctgcccacccgcttgacgttggagttcagtgcttttgacatgtgagtattgatttgtgtagagtctaaaggaccctgcttactctgggcaaggagtgagcatcctcttcaggtgggcttctgagcagccaagcaagctcccatgaagtgctgcagctaaagactgtctgctacagttgtctattaggggaaagatgagccttcttaagagcctgccatgtgcctgctagtgcagagatcggctggtgctcaggcagcagctctccagatcagcactatagaatattttatgagtctttcttagcacctatttgttctaaagatttgatctttttatttatatgagtgtctagctcgtaaagcttaagttctccctcttatgaaaactgcctagtgtgatggttggttagttcatgtcaacttgaaacaaactagtcatccagaaaagaaaaaaaccaaaaaacctcatttgaagatttgcctccatcagattgtcctgtaagaacatctatgtggcattttctctttgctgattgatgtgggaggacctagcccatgggcagtaccacccttgggctggtggtccaagatagcaagctgaatgtctatatatgaatgtcttttcaatatatgagtgtctgcctgcatgtatgtcagtgcatcacatgtgtgcagtgcccatgaaagccagaagagggcatcaggtctcctggaactagagttacagatggctgtgagctgctacatgggtgctgggaatcaaacctgggcctctacagaagtagccggtgctcttaaactgttaaatcatcatactagccctttaaaaaatatttcaagttacattttccttattattacatgtgtgtgagcatgtgggcatgcatttaccacacatatttgtcgaggtcaaagaacaacttgtaggaggctgttctctctgcttgcaccatgttagccctggtggttgaacatagatggttagtactggcagcaagtacctttagcctctaggtcatctcactccccactcccacccccttttactaactgtctcaaaatactaatgtactttatttctttatccccctcaagttgcagtttttaaaagcacaccataaatgcagaacaatgttagtgtttatatctatattgtgtgtgtgtgtgtgtgtgtatcagcttgtctgtatacataccacatacatacagtgcccaaggaggccagaagagggcatcagagcccctgaaactggaatgacagatgtttgtgagccaccttgtggatactgggactcaaaattgggctctctgcaagaacaaccagtgctcttaactgctgagtcatctctgcagccctcatcttcacagctttttctctccattatacttagtttctaaagcaaactaaatcccagtaattcccagtgggagcctagtcatgtggtcagtagcttgtctctgcctgctgttgccaggagccatcctggcagtgtctgtgttcttggaagtagcttcagtccctcagagcagggctctgtggtagcttgtacacacctgagatattgggacaggttggacaaagtcccttgttgcactgtgccttgtcccagcctccttccctctgcctccacattaactccatagagctgtctgatgagggagcctggcaagtgaaggctctgcctccctctcctctccaggcccaaattagccctgtatgatttctctctcctcaagactgtcttcagtgccttcctctggcctggacaaggaattgtatgatttctctctcctcaagactgtcttcagtgccttcctctggcctggacaaggaattgtatgatttctctctcctcaagactgtcttcagtgccttcctctggcctggacaaggaattgtatgatttctctctcctcaagactgtcttcagtgccttcctctggcctggacgaggaattgtatgatttctctctcctcaagactgtcttcagtgccttcctctggcctggacaaggaattgtatgatttctctctcctcaagactgtcttcagtgccttcctctggcctggacaaggaattgtatgatttctctctcctcaagactgtcttcagtgccttcctctggcctggaagaggaattgtatgatttctctctcctcaagactgtcttcagtgccttcctctggcctggacaaggaattgtatgatttctctctcctcaagactgtcttcagtgccttcctctggcctggacgaggaatgctcttttagtagaaaagcgtggtgacaggcagcctttgatgtgctgactcgtgactctccagggagaactctggcccctgatgatcccctacagccaaccaggacttgacatttaaggcttacagctggcatttagcagagccatcattactcatgggcccctcctgacctgtcctagatagagatctctttccaccaggtcccctgcagctcctttgtgccctcacatggaaagatatgaaaggacgctgagtctctgatacatgtgctctcctcagagtgatgagtaatgggcccgtctctctgcaagttccacacagcaacaacataaagcgctaatggcagaaatatttctttttaaaaatatttagatttaattatttattttatgtggatgcgtgctttgtctgactgagctcaaaagatgtatatcctggagctcggaagagggcacagatcctctgcaactggagttacagatagttgtaagtggtgctgggaactaagttctggtcctctgaagagcagccagtgttcctaacaactgggccatctccagcaacaggaatattttctttaagatcagtactatccaaaattcaggccagccacttagagataacagatgtgtccctgtctacacctgtgtttagagtcaatccatcttcttcaacttttatccctccaattcctggggctgggaggctttggggaagtggagtggttataaaccatgtagctagtgccctggattgacagtagtctgggcatcctgcattttatccatggccaacatgataatggcagccatgtgcagagctgtgcagtgtgggtctggcgggacaagcaggaaaagacatattcctgtctcctggaaagctgtttgtcttccagagtatttgtcgccattcttgaaaatgtactgagatgctaggctttagcaggaacacgggagctgttgcccagagtttgtggactggagccagcgcaggggctggggactgtacactctgctctgtctgtgagtgtgtgaccccagctgtcctagtgttgtgtgaccccagctgtcctagtgtgctttctattactgtgacagacagcatggctgaaggcaacatgggaaagaaagggtttgtacagtcttacagttgtagtcccatcgtgaagggcagccggggcagagacctggaggcaagaacagaagcagaggccatggaaggatgctgcttactagcttgttctccgtggctcactcagcttgctatcttggaccaccagcccaagggtggtactgcccatgggctaggtcctcccacatcaatcagcaaagagaaaatgccacatagatgttcctacaggccaatctgatggaggcaaatcttcaaatgaggatttttggtttttttctttcctggatgactagtttgtttcaagttgacatgaactaaccaaccatcacactcggcagttttcataagagggagaacttaagctttacgagctagaactcagccctccctttgcagttcctggttcagccagttcctccccccccccaggttcattatgggaatgagctttctttgagaagattgggaagctgagagctcagggcacagggtctccaggcagcgcctgcttgctcgtgcttgagcaaggaccagtgaatcactggtcttctttcaccatcttcagtgctatcaggtttattgtaaccctgagccccagccgtgctgggtaactgtgtttctctctcatctaggagtgcctccacgcctgcccactgctgcccggccatgggaaccctgcacaacaccaacacacttgaggcttttaagacagcagacaagaagctccttctggagcagtcagcaaatgaggttagctgcatagccacattggcttcgttgtatttccggggtccaggcaagtgcgctgtatctactcaggcacaggggtgtgtcacagaggtagcctataagagatacacagaggcactggtgactttgaggttcttccacccattgtatttgtgttctatgagtcagtttagtaaaggaccttctgcaaggcccactaacagtaaccacaccaacatggcagagaaacatgagagagagacgatccttctctgtgtgagtcccagtggtcaccccacacacagtgagttagatctcactgcatgaaagaacaaagcctgtccttgaccagactcagacttctccgggggtccctcccacattaatcagcaaagagaaaatgccacatagatgttcctacaggccaatctgatggaggcaaatcttcaaatcccaccctaccccagccagctcatcaaaagtggggttcactcttctgtggtccagtgcctccatgcggtgatgtctgtttattttcctctcacacctgcttgtggggcatgttcttgttgccagcatttgttgtggccttcatagcaacatgcagtttagcaactgagctatgagaatcttatgaccagatgatgacagcccaggtcttacctacagacatagggctagcctcatatacatagagaccatgccccttgccttatctctcaaggtgagaggttctccaaatagagtttaaagaaacccttgctgaagggatgagtgtgatgctgtaggcataggtgtgatgctgtagggataggtgtgatactgtagggatagatgtgatgctgtagggataaatgtggtgctgtagggatgggcgtggtgctgtagggatgggtgtgatgctgtagggatgggtatgatgctgaagggatgggtgtgatgctgtagggatgggtgtgatactgtaggaataggtgtggtgctatagggatgggtgtgatgctctagggatgtgtgatgctctaggaatggatgtgctgctatagggatgggtgtgatgctgtagggatgggtgtggtgctgtagggatgggtgtgatactgtaggaataggtgtggtgctattgggatgggtgtgatgctctagggatgtgtgatgctctagggatggatgtgctgctatagggatgggtgtgatgctagtagggatgggtgtgatgctgtagggatgggtgtggtgctgtagggatgggtgtgctgctgtaggcatgggtgtgatgctgtacggatgggtgtgatgctctagggatagatgtgctgctgtagggatgggtgtgatgctgtagggatggatgtgctgctatagggatgggtgtgatgctgtagggatggatgagtgtggtgatgtactcctttggtcccagcactcaggaacacacagaaaatctgttaagtttgaggtcagcctgtttagagcattttagactagtcagggcaatagggcgggggaggaaggaggcgagaaagccacactgtgtatttaattcaaattactcatttcagagccctcttcctcccccctagttcccaattcttgacaggtcaggtgtcctctcgggaactctgtgcttctgtgacaggagtcctgcatggagctgaacctgtacttttatttctgtagccatgacatgcatggcacccagcagacaacagtaaatcccttcagatgggcatctcaaaggtctgagtgtctacttgcctcccctgtgctgagggcccctgagggaaggtgccaggtactctcatggactgataatgatggagcaaggctggtggagaggcagtgtgaagtagcagggagaggtaatgaaccacttcagcgtctgagagcagtggcaggcttgaggggaagaagctgtgctgagaagctcagcggctggacagagatatcagcagcccaacctaacaccttcctttcttctggcagatctgggaagccataaagtcaggtgctgctctcgaaaaccccatgctcctcaacaagtttctgctcctgaccttcgcggtaagtaaatgagtggaagctgaacaaccctggctcagccccccaggcctgcaggaggctctcctgtctctaactgatccctgggaatgtgtgctaaagagcagctttctgactagtgcagatcgtgccggcacctatgagcagcgcaggaccagtctgtgcctcttgatcaccctacagccaccgtataatttctcaaacatggtgacctaacaactcctgccattcagcataggacaaagcagactcagggaagagcggcttcactgttgccagataatgcaaggtcctgtagccaggtgtgaccccagcactcacgacgccagccttgtatatgtagtgaatttcaggccagctaagtagcgacattctgtctcaaaaaaacgagcaaaggaaaagcaagcaagtacccagcgtgctttccaggcccagcgtgtcactttccttgttatcactatgacaacacttataaggtggctgtggtttcagaggcgttggtctacggccacttggctttactgtgtttggtcctgtggttgtagagaatatcacgatgagagcacggaccaggagctgttcacttcatggtgcctgggaagcaaagagagccgggaaggggctgggtggccagtgtcccctttaaaggcatgacctcagtgggttaatttcatcctattaacctccattcccctaaaccccacccctacctcctaaaggtcaacgggctctcagctacaacctggggaccaagattttaacatatatgcccttgaagacactccagatatgagctctcagaagcagaactccacactgcagagggcaaaggagcttcagggtagaggccgttacaccacacacctacacacagtggttaaccaagagggaaagaaaactttcagtacatgagacatgactgatacaaaagttcagtgcagcctcgaagtgggggtgaaatcacacctgccaactagttaaaaaacccaaggtctgccttccctgtgtgctcacacacaacctcggagctgagaaaggcacctgtgtatctgtgtacgaggatgtctgtaaaacactgctgtgtctgtcaagcagacagtctatagactttgactaacattcaggatcagatttctgtcccctagtgggaacgtcacttccatgatccacagtggccagattgacacttgcttctactggctgagtccctaggcatagtaaggtccttctcggtgtggtaactatgtccctttgccacagctcataggccctggagatcaatctccttccacacattcgatctgtttattactgagtaaagttgggtatgttaagaaaatgttttcacatagacttaggcatacacattgggagaaaggcaccacactggttacttttaactgcgtcttgtttctccaaatgtcctctgtgtctcctttcaggtgtaggtgaggctggcagggtataaacctcagggaacctgacggtcatacctatggaggcacgctttccagtgagttagggtgggagagaaggatactccagggctctgtcaggttaccaggtgcagcttggatatcaaccatttgtctgcttatgagttccttggtaggatagacttcttaatattgctaaaggtatcagagtttgttacttaaacattagtgcctttttatactaagagttcttgttaattaaacattaatccatttttcatacaaagaatcctaattgataatttcggcttaatgagaaaataacatcagttctcatttcacgtttaagcagtttcttggagtcagtggttatctcccttgctgtccctttttgcaaagtgtccttagccaggctgtataaaaacataaaaggtcctttaaagacttcagacacaaaaggctttatgtttaatttgttcaagatcctttgtgtcatgaaaaaagaaaaaacacaactttaagaaatgaaaggccctgcttctgaagatgctgataagctggcgggttgtgtgcggtccccatcttgaattgcttaaccttttgctgaagatcagctgtgacaagtcgcttacgcacaggggacagcagggtcgcaggccttcagctttcctttctgcggttctcaggcctcacagggccaggcccctcattattgtcaattgacgtttgctttgccattgtgaaaaggggttctctttcttcagttcatcacttaggggccaaactgggcactgtggaggctttagttattagtctctcatctagaactgcatcccatgcatatttatattttaaaagccagccagtggttccctttctgtgaaaactctgggacaggcacgtccacagagaatggcttggtgtgtccaaaggtcatggaggattggggaaatgggccattctgctcttagagacagggtttcttcttagaataataaaaatgctcaagaattgtcaggggttcagccatgttaaacaaccccccccccccaatcatatgtgtaaatgtgacacatttatgtattttgagttatgttttgataaaagaagcctctgggagctgggggatggcttagtgtgtaaatcctcagtgcaagcatgaggacccgagttcagatccccaggaccacataaaagccacctacaatcccagggtatgaagggcaaagaagctggctagtcaggctgcctccccagtgagccctgcttgctaccctgctatagtatttaaggtaaaaaaggaagacacttgatgccaacctcaaccctccacacatgtgcacatgttgcacccttgtacacacacacatgtgccaacaagcatgagaacatatacacatatatgcatatatagcacgctcattcatatgcaaaggcaaaaacaaaatctaaatcaatttcacatgacagctctgcagttctcatacttagcaagactcaatacaagtgattccttagctaaaggactgcatcagagccctcatcatagacagtgaggaggctgtccgggacccacagggctcaggtcctaatgccatgggaattgaggccagagcccttggactgagtgggaggtcagttgagaacagctcagaaattacttccctgcttgcaggagaggccagctgttccctgcatgatgccgtagtacctcagtacttggagcctcctttaactcagactgaaagtcacagtcacagactcactatcccagccagcggctggtagctacgactgaggcttagtcattttattgttgagtgtcctgatttgtcatgtacagagtaggcatttaatagttgctgatttatacttgaccaggaagacattttggaaaacagcaccaaacagggaaatatccttatctgaaagccagaaatgttcccaggtcaggagtgaatattgacatggtagcagaagagaaaattccacacttaaaatgctgctgcactaaaaaatactgtataaaatttcatgcaggtcatggagatggggtatgtatatcataatgaatttcctgtttaggcttaggtcccattcacaagttatttctgggtatatatgcaaatagtctgaaatctgaaaaaaattgcaaagtctgagtaatgttgaatgtcaagcctttggtgtaagggttccctctggtgggtagaggagactggagggcagccctttctcaggactgaagagtgcagctgtgtttcttggtgaggtcttcatgggagcctgtggggtggttccttctgtaacctgggaggaggtgcttcctcatcatttagggagaagggtagctttctcctgaagcatgcaagagtgcagggttctgcttcctcctctgagtgaaaaagtctgttattatgaggtgacacagacaggaagcctgaggtccaggcagaaactgtgagctcgctctcagtgtctgatggagacaatcaggacataccagctttttaatgcatctgcttttcttgtggtggtttttgaagctggattttatgtaacccaggctgacctctaacttgctctgtagctaaggatgtcctccctcctctggggtgttgggattacaggcatgtcccactgctcctggtgtcatatattacactagcagatgcgtgttgctttaattcatgggatcaatgttgtatacaatttcgctcttattttttttccctaggacctaaagaagtaccacttctactactggttttgctgtcccgccctctgtcttcctgagagcatccctctaatccggggacctgtgagcttggatcaaaggctttcaccaaaacaggtatggcaagtcaaacaaatgcagatagaggggtctggctgtgagagcaggtggaagatgagccagggcagtgagaaaagacagctggggagcgagcaagcagcagtccagatggctctggaacagtgtttaccaagtgctgataaggtcattgtgtagaggaggagccactatcctccaggtatcccatggaatttggggaaatgctaagcccacagggggggattacaagagcatttgaaagactgaaaatttaccaaagtgtgtttttcattttcagtctggggaagacaaagccacagcctgtgcagagagcctgtggaaccatcacaggccctcccctgccctcagaccaaatggcaggacctcttctctggaacagacgtgcaggtctagtccttccttcaaggaggccgtcagagattagtcccatgaaaaattagcatcaggctggcagaaggcagacctagctggagaattctgatcatttttttaaaaccttgactgagggtcaagctgatgagttccagaggtctgtcagtcaataagatgcagaactgatgcctgcagagatttaaagacagatggggatggggaaaggactcagcagttaagagtgcttactgctctggccatggccccaggttcctatcccagcagccacacctttggcaactaaccatatgtaattctagctccaggaggtccagtgcccgcttctggccagttggtacactctatacataaaatacacagacatacatgtacaaacatactcatatacatacaagaagaataaataaaccttcattttaaacaaaagatttaattttttttttttttgcaaaggatttttctaagatgaaacctaacatgaggtaatacattctatcaggagattgaacgttcatgtttaaggaggattaaagttctcaagtcatctcaggactacacaaccttgtaaacatactatcaaaagaaaaaaaaaagatagttcttgggctggaaagatggctcagtagttaaaagcactggttcttgctaaggacctaccccatccctaactccagtttcagggggtctgatgctctcttcaggcctccatgggcattgcaggcacctggtatacacacataaaggcaaaacactcacacacataaaacaaaaataaataatgaaaaaaatttcaagacatcatagattctgccccctaagtgggtaaattgtagggcatgtgaattggctcataataaactgtaaaagatgatcatgaatttcctccctggatggaccatgctgtgttattacagaagaatgcttggttacctctgttaacctctgtgattgacagcttagacagccatcattttatcccatacccctttgtgtgaaggcatagcacagggaaaatgttatagaaatgaggtgctgtcagtgggcacttgaggagtcacgtgttccaagctgccccttggtggttcctttgatcaggtctggtctttagctcggagctgtgtttcccagagcgcgccttccccttccctgttttcagatccaggccctggagcatgcctatgatgatctgtgtcgagccgaaggtgtcacggccctgccctacttcttattcaagtacgatgacgacactgtgctggtctccttgctcaaacactacagtgatttcttccaaggtcaaaggacaaaggtcagagtctgtgggtatcattttgctaggcagttaaaaaattttaagttcatgttataatagaccactatcgatttgaagcttagtcttccttagccctccacggtatgttctagaatgtttccttctctgtcctctcctacccccattgtttcagctcaactcctcctcgctctctagccagctcaccctcactctctcacagcttggtggtttggactccttgatcctgttagttagatgaagaaatctgcttttccccctggatatgccatacgtccacgttcaacttcctagcaaccccactgaagcttgccttgctcctgggccatcttcttacttccatcagctatggaagagtcctcctcagactgctcaggtcactcgaccctccaatgagcggagcctagggggtctttctgctgggcccagtacctttctgcctatcctctactagtcttcccataaaccattgctctaactaagcttgcctactttcctccagactctactccccctcccctgcccatcaccattacccaaccaaacacacctaagatctttttttgtctgtttttccattcagtgtcatcttcctgtcagcatcctacagcactcagtccttagtggtccctctcccactgcagagcaccctcacaggcgagccatgtatggtctttccttgtctggcctccctccacacaaaacccagtcagaaatgccgttttgtagcatgttggactgttaagcagagccctttgatcagtcagtgtctgtggagaaggagtgcctgtctgaggccctcaaccaaactcttctgaatgagtaagagtattgcaaaaaaaaaaaaaaaagaaagaaagaaagaaagaaagaaagaaagaaagaaagaaagaaagaaagaaagaaaagaaaagaaaaaaattaagtaagcagatatgtagtatgcaatttgagccatacatcaagttgtgcaagtattagggagttgtgaaatcaggtggagtgatgtgagtacaatgtatgattgttgagaaagaaacccttaaccaatggccggtcattcattttgaacctagagcccaggactttgtgaatgttaagctgaactccatctgcagctaggatatttttattttaaaatcaactacattcacattttctttctctctctctctctctctctctctctctctctctctctctctctctttctctctctctccctttctttctttcttttagaggaaactcctcaaggaataaagatataacttttaaaattctccttttgtccagtgataataagatggtaattgtctaatagaccaagcctttagtaatttagagtttacccggttgtatgggacaaatgacagcaggcagggttaagctacccgaggtcacggtgagggcagttaatagagtccaccagtctttcacaggggttttcagaacccgaaaacctcataatgaatctgtgaaatcggtatctcactgcaccccttatacaagagaatgataccgcaatcaccttgtacccatggcagcttccaagaaccctgcaccctctgcctttccatctctacattgttctggtcagcctgcctctgcttgatcctggaactttaaatagacctggctctgatgctccctcggtgctggcatctgccagctctgctcctggggaagcagagtggcctttccttgctttggtatttctgtcaaacaccacagggctgctcttttcatgacttggtgaaatctaaacgtgctaatgggaataaaatgctcagcacaaaactcaggtgtggtagtactcgcctgtaagcccagcactcaaaggcagaggcaggaggatctctgtgtcttcaaggccagcctggtctacagagtacattccaagacagccacagctatgtagagagaccttgtctcaaaacaataacaacaacaacaccccaataatcagtgcatagtgggcattcatcatgtagcaggccctcagtatgcagcaggtgcttagcatgtagcaggcctccagtatgtaacaggcacttaatacatacccacttcttttcctcctggtgttttcttccccgtattccctagcatattctaagagactgtgcagctcttgagtctctggacttctctgcaggagatcattagaaccaagaacctatgtagccaggactgttggccttcacttgcttagagctaaggtcaggtctcaggaagcgtggatcactcagcacatgtgctcactggctcctcgtggacagaacccagagtcttacagggcagaagaggcatcagcatgaaaagctaatgggaactgaaggaaggaaataaaaggcctaaagaaatgagatattgataggctggttggctacctatgctagtgcatatgctagaaaatgtcacagcagttgtgcacacgggtaacctcactggagtttataaaccctctagcctgtggtcttgagtgcccccatcccccctccatatgctttctccagcctgtggccacatccctgccacattcctgcagcccttccagacgtgctatctttaggataaagctgaagtgttctagcctagctgtgcctcatctccctctgcccctcaaggtgaagcctgtgctctgactacagcatgccccctaatacagtgagtttagtctgttctctggtcagtccttccctttgcctctctcctgtcactggtgccttactcacctgtttcagaagtgatatctgactcagtatgctgtctcctgtcctcatctggggtccaactgcagcctctttcctaccccctgagctctaatacaatgcttatcctctggcccaggtcccaggcagcctgtgagcactgcatagcagcagtgctgtgccctctctgtggactccatatttactgcagtccaggtgctccagaggcagcccctcctggtaaaagtggatgaagggaaaaggccattatggcctggtgccatcctagcaggcttcccaagaaactggggctatggtaaaacacacacccacaggcacacaacaaatgatttctggagagtctaggtgatattaagcactgctgattttattaccttagccttagtttgctgtttagataattccattttcccgtgagtgttacttgtagcatggtattaccatgagggattgagcctattccaagaacagatattcattatttcagtgtgagctcctgaagtgtgttgtcccttcaagtggtgctctatttccctaccagcacatcacacctgcttctcctcttccttctctttgatctccaccccgccccctctgaccctgccattttcagtactcagaatctaggacaactcacccagtctaggcaagctctctctggctgacctatgccccagcttctcctccccttccgaggtgcattttaatccagaagttgctcttctcaatgagcctcctgcatttatgggaaagatggagaagtgttgagaccctccagatgcctgccctgggtaacacccacatgccatgacgccagtgactgactgtcctcccgccatgctgaactcggcaccttccatctgaggctgttgctgctttagatgcatcatgacctcagaatggccatgcttctatcttgctggccacctccctgtccctcttcacacagtggctccttgtgcctcttaggttctcaacccctcggtctccagcctgtacctgtctgccatcaccccaaactaagggttacttttcctctgtgccactgagtgacttctggactctgtgggtctaaggtgatctttgatttctccctcacagtgtctgactttatcttccgtggtgcttcccaaatgagccccacaagtctcttcactctgagcttagctaattacagagtatcattttaagatacaaacatggagtcacagaaccctgagtggggagagatgatcaggtggggctctcacaagcctgttggagccatgtccagattgctagtgttagcgaccactgtcccgtgctgttgctctccctcccactgtgtgcttctcctgcaccggatgctttatgtttttacactcttgacaggcttgggaattgccttcatttaagttcttatttccttcgagaagtgttgatttcagctggacagagttgatccatagtagcactgcgttgctatggaacatgtcccttccaggcagttcctgtgatgatgtggagggcagccagttgcagcatcccaccacccgtccacagagattgctttgctcatcttcctccagcaccattactaaggagtgcaagatgctctgtaatttcagcaaggctcccttgtagttcctgggcttctatctgctgagagctggacctgctcttcacttagctagcacttagtgtcggctttgtgtctttgttgctgctgtgaccttgaaaagcacttaagactggcattttcttccctgtgcttttaaaaggagtgggtctcctgttcattgcctggcatatcaagtgtttgagtgttagaggcagccgtttgtatgggtcctcacaggaaagcctttggctggaaacggtcaggttgacttttgtgacctcttgtggttttcagcagtttgcttcatggacagctgccagatccaagctgtgccacttcaatgaaaggcaggctctcagcaaagtaaaaaggaacacttatttataaacctccaagacagtcttactttttaattgtgtttttctgctttgtcataaaaagaagtgatggccaagttacctttgtggcaaagccaggtttagaactgagaactcttagtcagggtttatttctgtcattaagctggttacctagcactgcctgatgtcatttctgctgtgactaaggctccaagttagctcctgaaacaccaagagacgccgggatcatgttcaaatccttaaagaaagattaaatgctacttagtacttagcccatgtcaaatctcccgtgtggtgcatgtctgccccctgcatgcctgtctccataggagagcctgtttcaagcattttcatcctgacacccctctgtgggtacatggcaaatgttcctctttaaccagtcacccctgttctatctagctcatcttaggtcagggggttctaagaaatccattcctggtcacttcttcttaaagatttcttatctcctttctacccagaaatgcaccggaggctgggcatctgctgcagcatggggtatatataatactctaatttattccatgtattggttccagctctacatctgtggatgataaaacttaagacccagagagtgtcgatcacttggctcttttttttctctgccagttataaaagggcctgggacttaagatgggggccagtctgtagtgatgagctgaactagacctgaagatggggcagtgtgaggtgataagctggactggaacgggatgtggggagatgattgcagctgagggtgtccatggcgttgccgtggttactgctacttggtgatagcgccattctcagttggtgctggatgcaggtgagaatcacttgagagttgagaaaattaaagctcagggatgttcagtcagttgccataggtcacggaagagtgagcagtacaggacattctgcacaggcccacattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgtgcaccaccaccgcctggccctaaaatacgtcttgaatggctcttagaccctgtcgggctgagcttcactgcacgctgctgttctgtccccagctgtgatccctgtgattctctgtgatgtcatccacaattctccacaagaaatggatctttgaaacaaaacaagtcagcaacgttccttttctctgcctccctcctttcctcactaccccaccctgcccccactcctttcttctctccctccttcccctcctttcttccttccatctgtttcagtgctagcggtaagatggagtctcgtagtccaagccggcttccaactccctctgtagccaagaatgatcttgaacttctgatcctcctgcctccacctcctgagtgctaggattataagagtgcaccgctactgctactctgcgttctgtggtgctgtcggttgaaccaagggcttcctgaatgctagacaagcattctgacactatgtctccagcccctcaaccctttcattttggaggcaaaggagaaattttctttcggtctcaaaatgagttagctgcagttagcacacacctgctgacagggccagtgctttttcctcttgtgtaagcccactgcctgaatgtaagccgttctggtgtcacggaacgagggaagccactttctcttctctccccacttcttgctgcatgaagggaaacattcaaaggaggggcaggtggcagtgtggcaggcagccagaatagaagagctcagggagatgcctgtaatgcagatctcagagccctcctgcctgctaggcaggagaagtccagtgttaagactgacaccgaatgaatgctaagagcagacagcgaaggaagtggagttcgaggcgctgcactgtgtttctgtatgcgagattctggtctcagtcactcagagctgtatgcgactctgccatggaacaccactcagtactgctagtgatggttgtagaatatccacaggccaggaagagctgatgagagacagcttgagctcattactgtttagaagtcgtaatacaaatatatttgtatgaataataaagttaggggtagttatcttagctagggtttctatcactatggaaaagaccataaccaaagcaatttggggaagaaagggtttgtttcatcttacagttgtagtgtatcatggagggaaatcaaggctggaacctggagtcaggaactgaagcagaggccatgaaggggtgctgcttcctggcttgctctccttggcttgcttggtttgcttcctacacatcccaggaccacctgtccaggggtagcactgccaacattgggctaggatgggcccacaccaatcattaatcaagaaaacgcactgcagacctgcctagggacaagctggcggaggcgttttaattcctcttcccaggtcactctagcttgtgtcaagttgacaagggaaaaaatagaaagccagccatgacagtagttatgcatggagatatggacagaggttcctttagctgttgataatgtggaatggttgtgggtttttcccccaatcagaatgttgctttagcttctgtttttggcttagaccacattgagcattctgtgaaataaatacatgaatatctggctaatttaaacaaaaagtaggacagacctaggtatactggcacacacctttaatcttagcacttgggaggtagaggcaggcagagtttgaggccagcctgctctacacagtgacttccaggacagccactgttatggtgaagccctgttgcaaaaatgaggcgtggtggtggtaacatggcttagtgggaaaaaggtgtaccgtgcaagtctggtaacctgagttcaatcccccgaacccaaataaacgtggaggaagagatctgactccacacagttgacctctgacctcctcgtgcatggtagcacacacccatttatccccaaagtacatccatctctacctctccccctcaacacacacagaaattatatttgtgtacatgagtgcacatcaactgtttttatttcatctacatttgcttataaaggaaacctttggtgtcgtagttctcctccagccatctctctgcctcctcctctcagtcccacttccttcctcccactcacaggacctacacttgctggacaaatgccaaggcccgccccagccttcattcattcatctttgtatcatttaataaacatttactagacagatgctatatgtctaagatcatggacaataaagggattatctgtactcttcagacactgggcatcatctttatcattaaaacctaaacttcagatttatagaagatagctgcaggaactagagagatttctcagcggttaagagtacccactgctcttccaaaggtcctgagttcaagtcccagcaaccacatggtggttcacaaccatccgtaatgagatctgacaccctcttctggagtgtctgaagacagctacagtgtacttacatataataaataaataaattttaaaaaaagagagagagcacagactgctcttccagaggaccagggttcaattcccagtacacacatggtggcttacacgcacacgtaaatttagtttcagggagtctgataccttctggtacttcacacacagtgcacagacacgcatgcacttcctattttctggtaatataagatggtccaggaacgacttgtattttctctgtcccagccctaaaataagccccgtgtccaaggtatcctgtcttcttttgtttgaaaatgatttttagaaatcagtatctgggtgccaggtgcccagtgtcttttgacagagaggagacacagagatatagcacttcacctccagtgtgtgaaggctcctgagaggagcgcagcttggtgcctccccaaagaaagcaaatgaagtcctcaagaaggacagtgctgtgaagttgagtagaattttccagatggaaggcagggttagaggagcactggggagggaggtgggaggagtatgtgttcccaatatccaggcatctgcttttaacttgaactgactatagacttagggcaatggatgtgttctgattttctcttgctcatcacacacagatgagccattcttacagcttgcaattctctaagaggactctcccctctaagtcctgaaggttgcttgtcctctgccctctacctctgtccctccctcctcttctccctccatttgtcccttccagtcctttttctttcttttctctacttcctgctctctccatggcccaggccaggccaggatgcgcaggggggagatgttccagtttctgccttttgtctagggtgagatcctaagtcttcttctctttcctccagccttctgtcaagtgtctgctgtccgtacagtgctagtcatgtgtggaactgtcaaactgacctggtgtgcggctctcagcaagtgttttctgttcacagataacagttggtgtgtacgatccctgtaacctagcccagtaccctggatggcctttgaggaattttttggtcctggcagcccacagatggtatttacatgtgtgttcatgtctgtgtgtcttgtctgtatgctccccacaatgggtctgcttatgtcagcaagtttccctatgtgcattgatttcattcctgtcacagaaaatagaaaataagtcaactaaattgttgtggtccagtttctatctctggtgctcttaaacaggtctgctagggagccccatccccagcttgtactatgctgaagatacttagactgtggtgaggtcatacagccagaggccatgacactaatgtgctccagccctcccttcctggttttcaagaggaatttcctatcactgccactcctgcttttaaaatttttcctaatcctaaaataataagaagtggtattgggaagggccaacttacccttgataagatactcagcatcactgggtatcatgaaataacattaaaaactataagagataatcccattaggactaggataggtttaaggtttatttttatttcatgagtgttttgcttccctgtatgtatgtgcaccacatttgtgccttttttgcttttaaaagacagagtcttacagggtagctgtatttgacctggaactcacagagatcttccttcctctccctcccgagtgctggaattaaaggtgtgcaccaccacaaccagctatggatgggttttcaaacataatgttgagtaaattaagccagcctgaaaaatacatgcttccatttacatagttcaaaacaggcaaaaccactgtgggagcctagcaggggatggcctgggataggtgtggtcagggttagagagagagattgtgtgatttttctttgtgtttgctttaattaagtagaagtatttactccaaaataaagctagataaatattaacagaccccagagagcctggttatgtggactctcagtcattccgggcacatatgctacaagtataaataccctgggaaggccagcttctggctggtggtaaagggccttgagggtcccttgttaagctcttggaagcatcccacccttagatttaaaagcttccttttccagagctatctatctgttgtgtgactgctataggaaattcacctggggcaggggagggggagtccagctaatgtggcagccagactgtaaatgcacagacagaggctgcctgcacggatgtgcccaaggtccctctcaggttaaagaggtcagacgagagtgattgcatgccttggattctcagcagccactctagaaagcacttatgcctgctctttttcttctcctttcttaatcatatgaactcaatgcaaatccatcgcggacaacaggagcggcagtttccagtccgttgaagtcctctgctttcgggaccgcaccatgcagggagctagagacgtgacacatagcatcatctttgaagtgaaacttccagaaatggcatttagcccaggtaattggcaaatctttgccagtgtatgtaatgacgagtgaccagagacccagcttcctgcctacagcctcacggtggcagagaaggcagagaaggcaccgctcccacctggatggcagtgtgagcacctgcctggcaccggagcagaggctgagctctggcagcttctctagcgagctttctagtctggagggtttcccagccttgtaacatttgttcagtctcaatcgacatgaactcataatttattcatgcctcttcctcaaggaagggtgaagttattggttacttaacatgtttattcattgagtacttgaaggtgtgtgtgccccttttctccatacagagtatcagtcagcaaaggcatatctctccttccacttatagtttccctcagccctgtgtagcaggtgttagcttttatccacgttttatagattaggaaacggtctaggaggcattttatagactgtgctagatgtatctgtatgcatgcgaatgtgcatcacggtgcatatctatggcatgcaatgcactcaaggtagaatccatgcccaagcttgaggggtgaagaaagtgcccacctgtgaagcatgtgtcctgtgaggaggcctacagtgctactcactcgggcccctcttaagctgagtcccctacagccatgggataggcatctccagtgcacctccaggtagactgtgcagcccctcctcctatggcagttctcttagtgcatgggtgtgccttagtgtgtgcaaatgggggggggtgtgtggcaatgcctcatctcttctaaagtgctgaaatcagaagggctcaaggttgcctgtttgttgttgactctgtgctccagcctggagatcttaagtacaatagaagaggtgaacagagccgtctgctctggtccagggaggaagccatccggttcaaaggcttttcgattaacttttagcttggcgccctcttctggtgcatcctgaaatagctcccatggcacacccacttaagtgagtttgttccctttaagttgcaactcaaagatggggaggtggagtgtcactaaaaagtgaagccaggaggatgcagccagcagacccctaccccatgctcctgattttaccctgaggacacactgtcttactctgtcttcactgagccactctgctcccctctctggtgtggctcatgcttcccctaccatcccaggcctgttcgatcccaagtgatgaacatctccatcttcttggtactccatgttgaagagtggttgttcattttagaagggatgttttcctcctgttttacatacagtgtttcgacttacctgcacataaagctctatgataaacattataaagacatacttagcatcatgatgtgagtccaaggcgtttccatagccacacgtgacataacgatatcacaccacatagcacaatggtcccttaagagtctgttgcctagggatctcgtggccacttaatttgtataagtacactctgtggtgttctcagagcaggacagtcagcagcctgtcatttctcagaactcacccctatgattaagcaacacgtggttctccatccaaggcatcccatagttggaacttcagtgacgtgggaagtgctaaagcctccatggctggcagaaagctgctctggacactggatgaagcaggagtggcccctgctgggtgtgggctgcaatgccagcttcccatccccaccctgtgcttattcttagcatgctcttccttcattcggacttatatagaagcacacgtatagattcctgatcttcacatgtagtagttttcattactaataagcttacagtgcatattggctatagccaatcaagcacttgggaagtagaagcaggagctcatggtcctgaaccatgcaaatgaatgaataaacgggtagaagagaaggggaggcttgagtatgctgatgttgccgttgacacttccagtggtgtgtgtaaaaggtatggctgctatcctggcagcagtatcttaaatttaacatacgaatggtttagaatcatgaaactgagtgaagagtgctggagccctttgtccttggtaaaggaatcctggagccttcatctgagcgttcgcgtaagcaggtgcatgagtttgtgagtctgtgtgcatgctgtgtgcacgtgtgagttctgtgtgtccttaaaagtgagcatgtgagtgtgttggtgtgtatgtgagagtgtgtataagcaagtgtgcaagcatgtgagttcatgagggtttgtgtaattgtgtgtgcacacacgtgtctgtgattctaagagtatattttatatgtgtggtttggattattagtgtttatgggcatgtactcatgtatgtgtatgtatgggtttctgtgagtctgtacttgtatgtgagcatgtataagcatgtacatatgaatgtgtgtgagtatgaaattttatgtatatatatgtacaaatgtgggggtatattttcacggatgtgtgagtgtgtttatgtgtatatgaatgcacacctgtgtgagtccacatgagtatgacggtatatgagtatgcatttgtgagtctgtatatctgtatgaattggcatgagcatgtgtgtagggagggagactctatcttagtgtgagagagtgtgtgcatatatatgtgacttggcaaacttgtaagtgcatacataagtgcacatttctctgttgatatgtatacatgtgctagtgtgagtgttggtgtgcactatgagactgtatgtttgactattgcatgttggcttatctttggaagtgtgtgtaggtgaatgtatgtgtgcatgactgtgtgttagtgtatttcttagtgtgtgaatgaatgtatatgtgaacgagcttgtatatccatgagcatacatgtaaaggttacactgtcaggatgagttttgtcaatggacatttgtgagtgtcttagtgtaggtgaatgagtgtgcaggagcttctatatgattatgtgtgtgagtatacagtgtgtgtctttgtgttaaaacctatgcattgtattttggcatgtatgtaggatgttcatgtgtaagtgtgtaaatgtgtgtgttactgatgatggaacccagttctgtcattgcacctttcacacacttgctctactaccaagatgtaggcacgaccacagacacagacacagacacagccagccaaagacatagtcacagcccagccacaaccccagccccaaccccagccccagccccaaccccagccccagccccagccccagccccagccccagccccagccccagccccagccccagccctagccccagccccagagctttacttaaagcagacattggaagtgatactgaaatgtaaccagaggctaagttctctgctcaggagttgaagctttattctgaaaagaaggaaatctttgagaaaaggagcaggcagaagtcccacaacataaggaattgtgttaactccaggatgtgacaagagtacttcacaaagtaacagaactgcaggagtggaaatagcaaagctctgggactggggttccacgggctgtctggctagagaggtggctcagtggttaaaagcactgggtccaattcccaccacctaatggtggctcaaaactccagttctagcagatatgctgccctcttctggcctctgagggcactgcatgcacgtagtgaacttacatgcagacaaaacactcatacacaaatttttttaaaaggtttaagaagaaggcagtcatattgaaaaggagaggacaaaggctaagtcgggggaaggagaaggtttgttctgtaaagtgtttggcacataagcagaaagacatgaattcaaatttgtttttacttccccttttagtaaactttatgttttatttgcaattaagattgtcctaaagctgttggctgggagaagaaccagaaaggaggcatgggtccgaggatggtgaacctcagtggatgtatggaccccaaaaggtagacgtgactggggcccccttgtctcagtgggtgtggtggcaatgctgttcctgcgtagctgagcgatcattgtgagggttagcatgatgggagtcctgaggcatgcacggtgatttactcttgtttccagctcagactctgaggcacctgggcctcaccactgcctttttgagtttttattgttgctgtgttattgtaaagagcacgccagtcctggctggcctggaagttgcagaaatccacctgcctttgcctcctttcctggttctttattcctggttgtggacctctcttccacttgccaccacagaaggatattacaaggaccgttgcatttgtggagaagccattctgtattaagactgggagagtgtctggacttggaagagcattcttttaaacctgcacctcagcttgtgccagcttgatttcccttcacctggctgttgggagctccagataggaattttgcccccatcccagaatcacagaggacaggggcttgctttctgtgtggtgacctttctcctccctgttgcctacgagtttcatcttatttctactgtgattctgattgcccagatccctccatcctgtccctctctgttagaaataagtctgcagcacaggtgactcacgggcacatgggtcttgtgttctgatcttgtgttcaggctggctgagtcatctgtggatctgaatctcaagctgatgtgctggcgattggtccccaccttggacttggacaaggtcgtgtctgtcaagtgcctgctgctgggagctggtaccttggggtgtaatgtggctaggacactgatggtgagttggtggcctcctggccgctgttaagctgtgcctcctgttttctagcacatgcttgctgcccatctcctaggttccctgtgcctccctcccattcctttctcttctcctcagcatctgtgtattctcagcatctgtgtattctaagagcaatctgtagtcactgtgagacaaaagcagagaacgcacacacacacacacacaccagcctagccccagttccagtcccacagattgtcagatttcatacatgaggacatcaccattgttccaggattgtcctgtcagaaggaaatggaggcctttcattggccttgtcattacccattcatttatatttataaaaactgacttacagcctgctgtttatgaaagttttctctgtaacttaatagtctaactttaaagctatgtgtttcctaaactgagggaatgcatggggctggagggagcctcggagcttaggactactgctgctcttggagagacctgggttccattcccagcacccacccagttgttcctaatagcacacgactccagatccaggagatctgatgcccttttctggctccctcaggcattacgtgtatgtacttacacacatgaaggtgctatgcataaaacaaacctttaataaaaaggtttgcagaaatgctcttgtgtatgaaagtgatgtccatgacaagacatcttgcatgaaaatacagactcgttttttaagacccagttataagcaagatttctccagcctggagaagtactccaagaaggtactccattgtttcacatggggacaacttacaagtcaggtttctgaagacttaattgagattcaaagtgagtttccagaggacttgatatttatacttaattacttattaagagaaaccaaagacatctgcgggctctcgctaatcctgaaacaacaaggtagaattattctagcatcccctggcaatcttcctctcatgacacggccaaaattagcacattgtgagtgagaattactgtgacagtccttggtctaatgaccgtggggatctaggccccggcatataattatgtcatcttctaaaaagttgacattctaatgatcaaaaattgaatttgtacagttcaatttctgtagtttcctatgacttaatgtccctgccgctcaaaatcaaaacccttcctagagacttctaaaagtatgtgctagtacgtgctcatcaggtctcctgtttccatgcagggctggggcgtcagacatgtcacctttgtggataacgccaagatctcctactccaatcccgtgaggcagcctctgtatgaatttgaagattgtctagggggtggcaagcccaaggccctggctgcagcagagcggctacagaaaatatttcccggagtggtatgttgctgatccagggggaacatccatgtggtttttttgtttgtttgtttgtttgtttgtttttttcctgtaaactctggaaatgtttaagcccctggaatcccagggatcaaggctctgtggtattggtgactgaagatcagacacattttacttcttacaagactgtcatcatatgaccaagcctgccacctcacctctatgatagcctctttaagacactacagagagagagaggggtaattggataaagtgcttgctatgtaagcctgaagccagatatagaagtgtgtgtgtgtgtgtgtgtgtgtgtgtgtgtgtgtgtgtgtgtgtgtgtgtgtaaggaggcagagacagaagaggccccagaagctggctggccagccggctcatctgacccatgcatcagcaaacaagcacaacccaaagatcctgctcacacaaggtggaaggtgaggactgccacctgacgctgtcccctgacctccatatacacaccatggtgcatgtgcacctacacactcatgtgacatacatacacatagcagtcccacacccatgtcaacacacatgcacatgcatgcaaaccaaccaaagaaaccaacgaaaaactaaaatccaactagagccagcctgtagtcaggtgggaaagtgtttgcctagtatgaattaggctatcccccgcactgcacagcaagtgcctcccagaaaccccagcagaaaccaaatggacaatgagtgaagaggtgtctttggagctgtgtgttttcactctgcctgcctgtaaagtgttttctggtggtgcagatgtcgggtattagttttcgtctgtcaccagactacccactggctgaagagaaccactcatgaatttatactgactacatctatgcagaaggtctagtagaaagttgaatcctttgctggatctcttgctacttctgagtcacactcacaatactttagacatgacagatgaaagacaaggcactcaccgttctcctttgctttcttttgcttatgtggcttacatatcctcatcacagtctatcactgaaagaagtcaggaattcaagcaggccagaggcaggatcatacaaagatgctctggcttgctcagcctgctttcttagaaaacactcctgcaccatgtagcccaggatagcatcacctacagcaagatgggctctaccatatcagttgtcaatcaagaaaatggcctagagacatgcccacaggctagtctgattgaggtaactccttagttaaggttccttctttcagacaactcaagtttgtgtcaaattgacaaaaactaaccagcatattcaactcacttgaataaaaagtaagttttgagatgtttttaaagtcattcagcaagagtcctcccattgaatacgtggtcattttatttagcaggaatcacatgagcgctctttaaggtttctttttacagtgctagcaagagtggcatcctcagccctagccatggaaaagcttgccttccagaaatttcttcctttagtctttcaatattgattcctgtgtttactgaagcctcctgttgtgatgatttacaagcatctctcgggagcattatttatcaagtggacttgcatagcattgactgagaatccactgttcccagctatgcattgggtagtcaaagcttcaccacagagatgttagttaggtctctgctggcacagtgtggcatgtctcagctgcaagtcgacgacacttcaggtatgccagccggcggggtgagctgataggcaaggctggactcagcttccagtccactttatgtgtgattgtttcaaaagggagacttgaggagtcacagtctcctggtcctgtggttcctcggaagagtagaaggccagagagtctcaagtcagcctcatcctcagcacactacctctcttccattgcttaagcaagtcatggggtcaagcacaggcttggaggcattgggcactgtgctctgtagtcccagtgggaggcttgaaagtcctgtggaagaaggcacagacctgtcattctatcctagggtggacaagcatgcccacctgggagaacattctagtctgtcactggagagaaccatgaacctccatgggcccatgaagatgttgctttgagtctgagctctgccacttagttcctgaattttccaacctgcaccccacccccagccatctttccagtcagtgttttggccactctgggaaagctgatgttttcacacttgcctgtggccagtggcatgcagagcattgagatgcagttttcatcctttgccttctgtggaaggtaaatctctggctgtgcggctcctgtgactctgagttccatcctcagtgacacacacactcatgtacacacacacacacacacacacacacagacacatgtacacacagagacacacagacacatgtgcacacacattcacagacagatacatagaaacatgcacagacagatacacacacacacacacacacacacacacggctcaggggaattggagaaggtgcagagcagagcccaggtatttgaggaaaagagtggtagcactgtgcaaagaggaattcctataatgtaactgatgtaagtggggtcattgcttccccagaatgccagagggttcaacatgagcatccccatgccaggacaccctgtgaacttctctgacgtcacgatggagcaggcccgcagagatgtggagcagctggagcagctcattgataaccatgatgtcatcttcctgctaatggacaccagggagagccggtggcttcctactgttattgcagccagcaagcgaaaggtggagtgtgtcttatgctacctctgtctggaacttaatgagccacccaggaaagacgtgtccacagcccaccatcccccaggaaggagggtgacctgtgtggccctggagctctttacttcctgccatcaacctgcaatgggtgtgcttcctaacccagcagtcctttgcaagtgctaacgttggtacatgtgaagttcaagggcctgtgatacttaattaagtttatatagccattctcaggaagcttttcaaagaatggtaataagaaaatgccatattacaagataaaatagaatatgaatgttatgttacacttgtatataataacatgcatgtctgcctttaccaccatcacccctcatctgtctgtcggtcatttatcatccaccttctgtctatcatgtacgacgcaaaggacaaagcaggaaggggagaggaggtacaaaaggtaatacctcagagtttatagacccccagagctgcggttttaattttctcttctccagtgtgccttttcttgattctttcaaactttgtatataaccaaaaatttgggagaacgacttaaatcctaaccaagaggaattcttaaagtacaaaggaggcttccctttaaaatccacatggtaagccagttggtggtagtgcatgcacgccttttatcccagcacttgggaggcaggggcaggcagatctctgagtttgaggccagcctggcctatagagtgagttccagggcagccagggctacacagagaaaccctgtctcgaaaaaaaggaaagaaaaactccacatggtgggaaaatcatagcttacaaaccgtgacccagtgaagctttccaaggaactaagagggtgtggcagagtggtgtgggcaaccaccaacttctggtcatagttccctcctatcagctctataatcctgggacacaggtggaactctgaccgttgacatactcatctataaactgacaatatttgtaaagggtttaaatgagatggtttatcttagcagtttatcaagtctcttgcatgtttcatatggctattaaagattagttacactcacatgaaaaaagaaagcaatgtgaaggtagccagccacatgtgaactttgccttggcctgagatgtgtttgtcctgactcctttttcttccttcactgctaacagctggtcatcaacgctgccttggggtttgatacctttgttgtcatgagacatggcctgaagaaacccaagcagcagggagccggagacctctgcccaagccatcttgtagcacctgctgacctgggctcctcactttttgccaacatccctggatacaagcttggctgctacttctgcaatgatgtggtggctccaggagatgtaagtcgggctctgtgttcctgccctggctacacagtgctggttaaagactgtctaataaagagcattctctagttgtggggaggggaactgtcccactatgagccatgttggcactcttacctgaatggctgagccacagtcactgcataaatgtggccacagcctgtgacaagctgattgaggaatcttccgtgtagccagcccccttgtagtcttgcatgcggtcctccgatgatccagaggcctccttttccctgtcactctgcagacagggcagggcacgggcttgtcacactgtctgcagactgaatttcaggtaaacagcaagtgttcttttgggggtttttgtttgtttgtttggttggttggttttgattttttttttaaatacatagatagccctttacagtagtcaagagctgcttggaaaaaaaattcttgtttatctgaaattgacctattaactgtgcctagtgtatttttatctgacgatctagacaaggaacccccacccccattctgagcatgctcactgatgggccagtggaatgtgaggcagtcagcagtgcctctagctgggttctgcagcctagtgagcttgcaggaataggcctctctcagggctcagcggcagacctgctctgtgaactgccctgtttccccttctgctgtttctctctctggaatgactggcttctcccaccatagagaaaagctgctatctcctttggtgtgaggaaggaggcttaatgatcttcataaggtgctagaacatgcaggtgtcctattggtcagtgggtgccatccaacagggttgagcccccaagcagggcagccatgtcttttcattacattgaagtttttatagcattaaacaaccctgggatttgcccctgtttggaagattaggagtaacagcttgtgcatgtagccaggtagtaacagatgcttgcagctttgtactgaagtcctcagagcacagccagggtaatgaggcagtgcacaggaacagaggacagagggtagagattgtggctcctgccccagtcagggtcactctgagccactacctcaggcaggacagttatcagccattcgtgattgtttctccctgtgactctgtctgcagtacaagagaggtgatggattccagttgaggagccatggctcagagccaccatgaagccatgctgatggctaatgtctcatctctgtctctttacagtgcacatcctgttccaagtagtgccttgtttaattacacactgttttctcccaagacaagacagggtgaattttaaagctttatcttagggagtttcaggttcacctaggtctggctgaattagaatattctatgcatgtctgtggttgcttctctttagtcaaccagagaccggactctggaccagcagtgcacagtgagccgcccaggcctggccgtgattgcaggtgccctggctgtggagctgatggtctctgtcctgcagcatcctgaggggtgagtctggagcccacagatgaacatttgaaccaagtacttgctggaaatggctggccactgtctcccccacactcccttggtttcctttggctttttttttttttttaacctcaaaacaagactaaaaacacctaatccagtcagcatgtgatctctggggtatgtccctgtgccatccttgggggtatgcccctgtacccctcttgaattcttctgattattttggtagttgataaggatgaaataagactttaataggggcatttggtcttttacatttctcttctgttagtctattatggttttttagccctggacattgtaaatgtgtacactgtatatgtagtatatataatgtgtatactgtatgtattgtatatataatgtatgtgtctgtgtcactaggaactatatcagctgcctgtcactgaggtctgtgtccaggaacttggccaattaaagtttaaagtccacgtccaggcttggtccagaggcttagcatgtaccatttagcctccctgcctacaggcacaagatgctgcactccagtgtcacatctgtgtgacagtgtctactcacagacaaatagcagttattttaataacaaactaaaagccactggggctcgagacaaagggattcctttcatcagttttccttttctttatttaattaatagatttgttcctggatgatgtcatacatatagataacatggttatagtgatgattattctcccgtccaccactgcccatctcctgcttccaccctacaagtatctttctcatatacatgaccttttgggttggtttggtttgtgatccagtgagtttggccaggccagctgtgtgaccagggtgggtttagggttagtcactggagcctgctgggctgagcagtcagtgcacatctatgtacttactgtgccttcctccctcccagaatgcatcagttggtgagagctcagcagtgagcaggaaggcctcttgttacttttctccaggaagcattttcagatgactacagcttaaaacaaaaccatacgaaaggtcacatctggtcagtgtcactgtcactggctgtcagattgtaaaggaaatgtccaggggcaagtgtcactggccactattgaaatctcacttttaatcgttcttaactggcgcccatgcccatcctgctactcagccttagtacctgtcttgtcatcagctgcttccccagaacagcagccctcaccacaaagcctgtgactattcccagttctagcctggcttctccagcatggtcatttgctggtgataccctgggaagggtaaatgcaccagcagccttcccctgcctgcctagtgccatctgggatgcactgagtaacctcttctctcaggtcactggacctctcaggccacaacttccctcccgacaccatcttgcaggcctggtgctttccttgttgctcctgagtgtagatctcacctgcttagtgcatttttccaccggggcaacacataacaagcgaagcataaagctgctggctgtcttgacagcaggcccttgtggttattagcttgtatttctaagtgcagcttcactactctgcagacactccagtctcacatccagcacacagccctggaggctgccaggtgctgttttggttgcctagtccctaaacactgttccctgtgctaactcggactacagccatgagcgctgttccctgtgctaacatggactatagtcatgagcactgttccctgtgctaatatggactacagtcatgctttcctgtcacagcaaccttggaaaatagaccagcctctttcttcatgggtcccttttttttcagacagctgccttgttgctgcagaagtgtgaactgcctcttaaagacccttgtcagaaaatgcagtcttagattcaccttgaaaagaatgctaagttgttagctttgtcatctgggcctgttgcctctctgaagaaagtcccgagaggcagaagaggagagtaaacattggctggatgaccagcacggtcttcatgtttgtttttgatattttctttacatatttaatccccagaagatattgctacacagctagtattcatttagttttgctaacattattcatttcctcctgtgtctctaaacttgtggccctgaggcattatcttctgcctgcagaatttccataagggtttcagttttcctttttctgaaaaggtctttgtgtttaaggaagtttcttatgtttggtggaattcaagactggcatattctctctcctcctcctctttttcctcctttcttcttcttcctccttctcttccttcgcctctttctcctcttcattctttcttccccttccccctccccctccttctccccttcttcttccctctcctccttcccctagtgacttaggaggcaatctccctgctccaatttattctagctcagccttcttctgcatcatctgcatctctgatgtaggagttccatctgcagtgattctctgccctgtccctagagcgccactctgcctaatcctcttgtcctccatgctctttctgagacccccagctgccctatctggtcccctgtgtaccttgtgtgggtcccccttgctttagcccgttgttttctgttggcacatgattatagagctgtgcctgggaaaggttaaagccatcaaggttttcagtgtcattgttacgtgtcaggtttaagctttccatataaccttattctcttattctcctatgaagttgagattttggcctgagggcaaacaggtgcccacacctgactagactatagatgctgtgtttcatttctcaaaagtttgtgcaaggccctgctccaagcacattagaactgtcgactcgtttaactagcattcgtgattttattgccgttgtttttggactgagactgcctttgtatttcagacttgctgcggactcatgtagcccaggttgccctcacactcactgtgatccttaatctgcccagtgccagcattacaagtacatgccctggctcattagtcccatttctggtggtggagctgggcttggcatctcagactcatggcttgtgagtggcagccaggcttgccccccccccccagcatctcttcaccctgctttggagagctgtgctatatgtgccattggcagagcaggcagagaatcaaatttagaaaacacttatttctcatccaaattgaattccaagaaaggcaatggcagaaagccacagcagtgatctgtttatcatgtgactcagagggcctcagtggctactagacgaggcaggaaggggggatgagcagctgtgtcctcccctgccttcacctcccctgccatccaagtttcttcctacctctagtaggaagtaaaatctgcacctccttgatcccaaatccctgccttctttgtccttgtaacaggttaaaaaccagttcttctgggacataaatgaacattgaccctctcttgggaggggccggtacatctcccacccagctctttccttttatatccccttcctccatttttgtggcatttagataagtttagcaagttagaggaggctgtggggaggcacatcccactcccagctgctggaaggaaggctgagctggaggatagcccaagccaggagttaaggctacccttcacagagtagtgaaagcacgtgagaggaaggagtgggggtgggagggtggagaaggcaggcaggccttgcacttggcagtttatctcacatgcccctaatgcttcatacagcctcctccctcctgtttcacggctgatggacccaaagcacagaggagagtttgccacttggcaatgtccacagctcgctctcatccttcccactctatggtgcccatttgaagaaactcaccccctttccctccctcctggacatgagtttcctgtgagcttatgaagcccagcaaaggggcatttgcttctcttaaccctttccagtgtcctgagatgttctttcctgtgctcaccgtgagcacaaaggagctaagagcccttctgcttccctcttgcaggggctacgccatcgccagcagcagtgatgaccgcatgaatgagcctcccacctcgctgggacttgtgcctcaccaggtgagtgatttggagatgagctgtggtcctgccccatcctctcatagaggggaaggttcgacagcacactcttccagcagcacacccgctgcagtggggcctcacggagagcgttgttttctggggacactgctgggaagagatgaacccatggcactgcctcactttgatgcattggagctgctgactagactctgccgtgcagaagaaaaagaagggacagggcttgggacggccatgtgtggttcagccggcttcagtctcagccctgccatttacagccttctttggcccagtctcagaactactcagggccttatcttcccatttacagatcacagtgagctccctggtaggcatggagaccaggctcataaataccagcccaacagcccagagtatggataagctgactaaccttcagtgcccagtgccctccctacctgggcagaaagcctttctgggcaagcatgggcagatggttagccatgtcaccactgcttgcagggtccatgcctgaggctgggaagatggaataaggcccacaggtcctggtctctcagtctgctcactgccttttggagtaacaagggcagctttagtgtcacgtttggggagctgttctccacagtcctgtgcattccgccccatagctgggaggggtcccttcaccgtagtccctgcccaaccaatgtatttgtttggtgctggcatgaaacccagcatcatgcataccaagcatgtgcccagccactgagtagtcacccagcccctgtgcctggcgctttccagtgaggacagttgagtagaaggaaaggctagcccaccaacatggagagagctggtgaagctgtgatccaagcccagacttggcaccatggctggtgttcttctagagctcctgtggctggagagccctggtcacagtggcccctcagcctgcctctgtgcagtctcttccgtctgtgccacctcctgccttatacctgctgtctcttaacctgtttctgtcagcaaagtaggctctagcaagggtctggggtacctctgccttggcgttggaaaccatagagccccagaaaaggtggcttccctccgtaaaccccaggtgtgtcatttgtatgacctgaacatgtcagtcgtttcccatacacactcccagcagcccctggcaatgtggtaaccacccctcccccaccacacacaaggctgcggaccttcaggctagcttgggctgctctccttcccatctcctccaggtcatcctgcctttcttcctgccctgtccttccttctcctcatctctcttacagacttcatgctgaggagggccttaattaaaattcccgacatgcccctgcactggtttcttcctttaagttaaattgcagcctctgttgcttcttagtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagtccccatttaaacaaatgttttttgttttttggtttttttctttttctcaagtagaggggaccatttatacgactgtgctctgattaggggacatcatctcctggtggcagattcagcatccttctcccctcctcccctcctctgcctccctccccctcctctccctcttccaaccccctccttctcctcttctcttctccctcctccagagacaaatggtttcctgttggaggggagctggctaagtccctttgtgtattttgcttgtaaagaatgacctgtaaagttctggctcattttctcagtgccccaaggagagcgtttattaatctctccctgtggagtgtggtgcctggaaagccctcaccccacccccaacaccagtgtgagtggtggagagcattccctgacttctttgctgtcctgtgagtgggtcctgggaggccactggcctgctctgtccctccatatgagtgcccaggcaaattggcctgttctgatattgtctaggaacagtgagaaccttgattagtccccagctgaatgttagagctgaagagatctggtgctagccttgaaaaccgtggaaaaccactagcttcgagagcaggctctttgggctgaaacttttttttcttatatttatttatttatttatttttggcctctggcccaacccacggggatagatactgcaagcaggcagcaagtaaagctgctttgtgtatgaagagggggtttctttctcaaaaaatgtattatgttgatgtatgaatcacatacagataatgtcccaagtcactaaatgaatgatccaagcactcacaaagtgaacacacacgcgcgcgcgcacaaatgtgtgtttgtgtgcttctcctgatggcccttccaacagacgggtgagctcttcccgactcacggaagcttttgtcacacttggaacttagagaaaacggagtcctatagtatgtgcccttcggttaggggactttggcagaaaactttttcattgtagttctcagcaattaattgatatcccacccacctggatcttttattcagaccataataaccagacatgatgtcacagcttgtagtcccagcagttagaggtggggacaggtgagttgagagttcaaggttctctggggcacatagtaaggccctgactcaaatgtgagagtgggatggggtgactcagtggataaagcacttgttacacaagctccaggaccgcacttcatgttcctagttcccatgtaagtgcagggtgagcatggcagcccgcctgtgaccccagcattggcacttgagaggaagaggcaggagactcttggagcatttggccagttagaccagcctcaccgaagagccttgggtcctggtgagaagtcctgcctctgtacatactcagagtcttacatggtgtgtgtgtgtgtgtgtgtgtgtgtgtgtgcgtgcgtgcgtgcgtgcgtgcgtgcgtgcgtgcgtgcgtgcgtgcgtgcgtgcgtgtgtgtgtgtgtgtgtgtgtgtgtgtgtttggtgtgacctccatccatacatgtgcatcacacacaggggaaatgcgagaggcaagaaaggaagtcaggttgttggatttgtgactttttcatcttgatgacaaaatatctgccagagacaagttaagagaaggatttgttctagctcataggccagcacagagaaggtgtggcaacaggagcatgagaccgaatgccattgtgtccacagtcaggaagcagagagctctgagattgtgagggtccctgcgagcctcaccaccagcaagggaacagccacttgaggtgaagaatgagcccaggtcagcagcactttagcaggccctggggcagaaacctccagagtctgacctcagggtttacctttcttgctcacttaaaaacagtaaaactttgagggaaagtctccacgtggcaattatcagaacaacgtttcagggatagtttcattgaaactcccttgcaatgtacatctttttggcaaagcacctgtgacctttacaacaagagtgagttctattgcctgacacgcagtgctggggtaagggccggggaggaaggatttagagtaagcataaggatggattctactgatagaggatgcctgcattctattcactgagagacaagcattgtaacaagtctgcttcctctgatccttctcaaagccatgccttcagaatgctggtgctcagctggctccgtctttccctttgtatttggtcgaggaccccagcccatgggatggtactacccatatccaaaaagggcctcccctctttgtagcctgaaaactcccacacagacatgcccacaggtctcctaggtgactccaagtccagccaagttgcccatgacagttgaccatggtagttgtcctttcctggctcctgggtgatgggtgagctctacaaggctttgatggaggtccactcaggtgttatgaaatgtacagcttctcctgacattcaagaaagttggccttctggtctttgagagcctgacagacaacatagacacctgtggtctgacagcctttgcctgtgcacctcggaagaccctgcagcaggtgtccagacacccaggcccagttctaacttgtggactaagcagctagcatctttgcctttgaggaatgtactcctaactctgaaatactggtaaggaaaagtccctgagtgcacatgtcctgttcctagggctgtgtgtgtgtgtgtgtgtgtgtgtgtgtgtgtgtgtgtgtacatgcacccttctcctaggtctgcacttgtaagctcgtggttctctgaggctcttgaattctctttttactctttgcagaaaaacaaaactagggcaggccaccaggagaggctgacctgggagtcttctgcatgaggtgaagtagacagggagcccaaagctctagccactgttcattacctgtctgctcaggctctgacaccctctccccagttttcagccttctatttttccttttaagatttatttttattattttaatgatgcatatttgtgtgagtgactgtgtgtggtgtatgcccctgaatacaagggccaacagaggtcagagtatccgatggccctggagctggggttacagacagttgtaggcagcttgatgtgggtgctgggaatcaaactcagggaggtcctcaggaagaaagcatgtgctcttaaccactgagccatctttctccccctgaggggggctggtaaagatactcaactcttgtgccctgtctgcctagaggaggtccagcaggagggcattgcctgaggtgtagcctaggaaagagcttccttcttctccctccccacaggttcggtggccctcagctagatggtggcaggaaaatgggttggtccacagttgccctatgttggccactgtcctttgtgacctggttatagtgtccatcctctccatacgaccagccaagcagatgcttcctgagcacagatgctgcagagcacacagggatcagagacatcaaggaaggcttgcccttggtacagtctaaggtaatagacaaacccaggccatgaggacacggtaggatctctatccagagggaagaacctcaaagctaggagggccccaggtatatgatctgaccgccttctcctgctgttcacctgctcctcggcaagtgtctcatctcctctgaacctgttttctgcctataaatgaggacaacctaatagtaggcccaagagtcacagatagattgtgttcattagggcactagcagaattctgagcacatgagacacttgcccatgctggctttctacctctttccacttttattaaagtggacgtttgtctaccctctaaacaggaaattaggaagagtcgtcaaactcaggaaacaatgcccacactacatcttgagagttagctgcatcctgcaatattttctgatgatgctgctggctagcttccagtttagctctttggtccctctgtggctctggttcaataatgagaggcagccagtgatgggaacggaagctgttatctaaaacaaagacctccatagtgtgcctggggctcgctgctgctaaactccattttggcccagaatgtggttaagactcttttcagcatccaagatcgatctggagttccaggcacatttttacacatgcaaactccaagctctagcagccttgccaaacctgtagggagctgctgcaacacccaagcagtggggctccagaggaggcctcaggcacgttggggtggctgttcctgagcggtggatctcagcttcccattgaggcaaggtgggcttggcaccaaagttagttacattgagcacaggtggaaacatggccaggacagtgtcccctcctttcctgatgtatttcttttgtgtccaactgggtaaaattcactgaagataattgaattcaccttctgcatttatttattttttgtttgacagtgtttgagttcctccttttctccctctcaccctctctccctccttccctcccactccccctttgtcctctgtgcttttccaccaggctttcgagccaaaataaaccagagctgagattgctggcttttctctttggtgcttgtaaggctgggtcatttctgagtcttgcttatctaatctggaaagtgtggaaggtcattggatgcagtgacacccagccaagctgccacaggaccagtgcgtgcagacgacctgacacgtgcatgtggatgtctgcatccctaccgggcatgacaacgggaagccttggcccctgcatggagagcagactagacgtatgaagaaccctcgtaaaactggaggcattttagctaaaattacaacccaatccagggattcccatccctgccctgccatcagtcacctctgagcccttccagactatacctttaccagcacagctcagggccaccactggaaacctccagaaccatggtcattggagatgcaccaccctagaaagaaagactttgtggtggcattccttccagagatggtcacattcctcaggtggcatggaaccagacccatttggtgaactaacctctgttgctaggtgcattttctggagggccttgtacacctgatgaagtctggccacaatgcaagacagtcacaggactgtcaaccccacccccaccccccagcccccctgttaacagccctgagctcatggcctgtgcatcctgctgctgcctctcacctcacacccagggcagcatctcttgtcttcagagcactgatggccaagctcagggatagcccaggacttgtgctttgcaacagagatctcaccctgcctgctttgcctgtataggctctgacagtgacttacagggcaggagccaaggaagcttaggtagctctcgtccagggccctccaaatgcagtagcagcaaggaaacatatttcaggcgtatcttttcttctgggcaggagggcacatagctctgtgctagaatgtagcaatcacaaggccctgggattagcatcaagaaccagaaatgattaaaggaaaactgttagttttcagctaaactggacacttaagctgatgattatttgcgggtataggacgtgcaggaacttttcattctgatcttgttgaaactaccaaatatataaactgtttctaaattagcatttctgaggcataatttacagttgaaataagtcgactttaataagtgttggcaaaaacctgcactgctactcacctccacagaggagacttggtgtttctgtccccccagctgttcctttgtgctgatgtcctctatagtccaacctcagcccgcagcagctacacatcagatttttgtatgggcagctttcacagtgcctctccttagtgctttcacctctgaaaggggagagtggggactgtaaagatagcctagtggttaagagcacacattactgttgcagaggacccacatttagttcccagtatccaagtccgaaatctcacaactgtcagcccccaggatcctagcacctctctcagtgggcactgcacacatgagcacacataccacacactttaaataaaataagtcttgaaacacataaaagggcctagaacagaatctttgacactttacagacctttttaatttaaatatttggcccataaggtggaatagtggtgttctttcctagaaaatgtgggaaggattctaatctggggtagatgtttactttcttggactgtgagatgatgcctggcctctgtgaaggatagctaaggatagtgctgaactgttggcagcagcctctgctccattcattttatgcattcctgtcaggctgagggataggagttgaccatacacgtaagacatcatttgtagactctcagtttttcatggtctatagccctgctgtatgggaatactgcagagcttgttcttaacttcgagctctcacatacgtggccaactgatgacatgtgctggagaaggtgttttccagcaggtagctgggtatgagggctcacccttcttatcccagtattgggagaagggtgactgtagtataaggcaagcctgagctacagagtgagtccttttgtcaaaaataaacaaacatctgtggcatgactgaatttgcacttgcaaaagaaggattttagactcttcatgccatgaataaagattagccatgggactggtttgagatggcttgactcctggggtacacctgtgttgctgttggcctttgtttctctctctgtctctctctctgtctctctgtctgtctctctctctctctctctctctctctccctccctcccctcccctnnnnnnnnnnnnnnnnnnnnactagttttactctctcccttccctctagttctggtcccaacctctgttcctaagtttagcagccgccgttcctacagaacagaaaatgacaacagaagctccatgtgccaccacgggaatagagacagctgtgcgggccgctttcaacagcatttagtgggaatgtgttagctccaattgctttaaaagacctcagtatgaaagtagcttaggtgtgtgtgaggcacactgtgaacagagcatgcatgcatcttatcttttgatcatatgtatttaccatgtaggagtcagttctctccttctaacacatggattccagggacccaacccaggctctgcaggccatgaggagcaagccagtaagcagcacccatccttggcgttagcttctgcctccaggttgctgccctcactgctttggatgatggactgtgttgtggaactgtggtgatgtgagccctttcctccccagcttgctttggtcatcacagcagtagtcaccctcactgagacagtatgtttttgctctgggattgaaggggctctagaaatggcctgtaggctttctcgagattgggtgtgctggaagtgagaatacacttcccatcaggctgtgggttgcaacccagcaaatggagacctctgtgaacagcatcaggctttgtgttcatctgaacttagctgttcattcaaaatggctctgagtaaagagagttgagagggttgtgtccctttttctatttacctgacatgatggggccctggagaaactgtgtacctgtaggcccatcgtgacagagacaagcaggtcccaagagcttgctggccagccttcctgctgttgtaaagtgatagggtggagaatgatggacacctgatctctggcctctgcatgcctgtgcttaatcatggaccctgcgggggtggggaggggcactgtttaaatgaggtgattgaagttaatgggagaggctgtgctcggcaagtctaagacactgggtctgatctctggctctaaaagaggaaagcagaggaaaattatgaagacataaaagagaatgctgttacctaaaaagagggtgccggggagccaggtgccatctggctatggaggtccacctgctgattgataccagcctagacaaatgtgagaaggaatgattgttgaggacaaagtctccatgagattagcctgtgggcaagcctgtagggtattttcttttctttcttttttttgtttttgttttttgttttttgatgttttttgttgttgttgtttttgtttgtttgtttttgagacagggtttctctgtatagctctggctgtcctggaactcactttgtagaccaggctggcctcgaactcagaaatccacctgtctctgcctcctaatgggtgattgatgtgggtggagggtgtggcaggtggcttgaggttctataagtaagcaagccacgatgaacaaggcatattctttattattcctccgtgatctctgcttcagttcctgcctccagttcctgccctgacttcttttggtgatcaactgtgatgtggaaatgtaaactgaaatgaacctttcctcccccaaattcttttggttatggtgtttctcacagtaataggaaactgcgatgccaccgttagtcatggtgaccacgacagcagtatgaacctgagacaggccccactagaaaccagattttatttcctcctgcccacccatgccaggctgcttcacctgatcatacgtttcatgaccttaaaactgggagttctggcatcaaataaatgaactttcaagattcatgttatcttgcttactgcggatgctggcttctgtggaaatgatcaaggctttactattacaagttttataaatgctatgttcctggtacatacaagggggagcagcgctccatcaccactcagccgtggtgggtggaacccacgagctgctctaaaagtggatttattggttgcaatcagatgtttctgctcaaggtggtgctgtttccccatcaatgctgtgactgcgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgggcgtatgccgtgttggtgatggaagcagagcctggtgtatgctagccaggggatcctaccgactaaaacccaccccaaccccgagacagtgcttgaggtcttccaccttgctttttatgttttaaagtaaatgtgcttttaggtctcaaacatttaaagatcatgtacatcgtgggaataaagagtcagaatagttctctcaaacctatcaccgtatggggaggaacttacattcacagaatcgcctgtgtcaggacccataataaccatttcttcctccttgtcacccacagacatgcatcattatagctgtgtttatccctgacctaatgagtaattgttctgtttggttttagatccggggttttctgtcacggttcgataatgttcttcctgtcagcctggcatttgataaatgtacagcctgttcacccaaagtaagtcattttacctctgagcaatttaacctcatcctaacccactcgggccagtggggtggtgcgtgcatgcgtgcgtgagtagaggaagggagcccggtaggcttggtcctgctgctgttgatctgcattcatccacagaagccagcttgggaaatctcaggtcctagtgtgcagagagcctgagctagctgctgggtcagctcttgctgtacagtactttcagtttggtcataaagctctcctgagtgtctcggtccccgcctgaggggttccttcctcgcatctactcagcagtgcagcttcttatgctttccccagaaggtgggggtttcaggcaggcccagctgtgttttggagatgttcctaatgcaaaggaacagcaagcagagatgaggggcctggattgggaggccggaacaaggccccttcctctttgatctttccagcagctctaaaaatagagcagggctgttgtccactgtaatgggaaccggctgatgtatctcaaaacgacatggcatctcagtttttaataggctctgagttattctcgcatgtgtactgtacgtgacagctgattccctttggatgtccctttaagccagtgcttctcaaccttcctaatgctgcgactctttaggacagttcctcatgttatggtgaccgcaaccataaaattatttttgtcactacttcataactataatttttctactgctatgaatcatgatgtaaatatctgatacacaacccctgtgaaagggtcgttcctctccgaaagaggtcacaaccctctggttgagagccaccactttaagccttcaacctccccatctccagctcctacttggggtgctatgcagagtagcttatgggggtcactcatcccaagatggcgtttctcagaggtctgaggtttccctgctatgcctcctgcaatgggcagagctgagggaattgaattctaggaaaagtctacttagagtggcttctgtcctgacctgtttacctaacagtggaatctgggatagataagccacagtaatggatttggttaaatctaggcactcccgagtggagagtggtttgttttcctttctgctctgagagtaaactaagcctgctttattgttgggcatctcaagtgcctggttgagattgaaaccttataatttgtgggtagatgacctctgagcccattcttcttgctgtttctcaaggtatcctgtatcctctttggcaggaccctgagggtggtaatgtgcacatctgtttgcagggacagggtctcagggctgtgtgctccttagtggaaatgtctgtctgtctgtctgtctgtctgtctgtctgtctgtcttttcattgtacggctgaactaattgctctccaaataacttggctggattattttcaaactgaaatcctttggtgcccatgccagaagtgtctctgtggctttatgtaggtctagctcatcaatgaaatgaagataattgggttctcagagaaatgtgagcatttgctttcctgctctgtttctaattaaatcagcccataagatgctgtctgtctataaagaagcccaagggtacctcaggctgcccctcttttttctttaagaaagaatagctttttgtatttttgtcctccctccttggaagcatgagattaaacacaggtatggtgtctttgttaccagagttatttcctgtcagtggccattcagagtcctgcgttacacaaacttgccaggcgagttaatacaacctgacgtggattttcacagctgcactgtcccacagcgatcacttttcatgtggtctggatattgggtttcctttgtgccgagaaggctgcacctctttccaggagaagcccctcatttactttcttggcccccctccctgccatctgcatcatctgttctccgagcgttgattcttcgaaatgacaattccaattaagcggaatcgctcgctctatgagagcttgcttaacgcttactcagcaggatgttttttatactgagtcatgtctgagttgctgctgtttgaatcaaaattctttggagctaaaagcaagttctacaaatttttcctttgatattcatgaagtcatttttttaaaaatttttcctcagtcttaggaatttcatacatgtatacaatgacacattagcatatctttctgtttcttctcttcaactccccttaaaccatcctccaacacagcctttccctaccacatgcccccacccttaacctacttagtcccactacactttctgcatgtacatggatgtggggaaggacttgggaaatcctctatcaaggccacacattcaagagagaataattctccctcccccagaagctatcagctgccagtagctttccaggaagagatgggggcctgggtcatacctcaaccatctgggctggaattttgactggatttgtcttacctaggactcctgcaggtagccatagtttctccgagttcatgagtgcgccaaaatgtcaagtccagaactttgaattttaggactctcctcagctccagctcttttgtgcctcctgccttctgtcttctccagccattgtggaggtggtagtggtgtttagaagcccgtcccactgaggaccaagcctctgtctcttgttcccatgaggtgatgttttcctttgttggtttccagtatccatcccccttcactcccaccccaaagagaggctcactctactcctgcttggtttagcttcaaatataggaaggggccgggggagcaggacactcagggtagtgagtcttctctttattaaacgttgatgctggtggtatagccccatcatgttgccagagttgaagaagacatgggtctccgcactcatgtctgggaaggtggcatcattgtccctctcagcatgtcctagcctgtttgctctcagcctgggacagagctggtgagctgttgcattcacacatgtgcagggagatggggatgctgaggggtttcttcatcttgcagagcctcctcagacagtggcacccactgtcagaacatgaagaggcctttttcacacacgtaagagttacttttccattctacagtgtggtaaacttctggcaggccaacaggtgcgattgtgagccagaaatctagaaaagctatcccagaatgcattgaggcaatttattaacaaccatctgtctcttaatttctttctctcttatttctaattaagtttttttttttttagtaactatgtattttggtacagttttaaaaagatttatatttaaattaaatgtgtggtaataggggagtgtagagcctacaggagccagaagtctcaggtcccctggaacttcagtttcaagcagttgtgagcagttggatgtgcatgcagggaactgaacttggggcctctgcaagcacaggcagtggcctaaccactgtgcttctctctagtccttctgatgcacttctaagcttggtgaaactgggacaggaaagatggctcagcagtcaagggtgttgttcttgcagaggatctgggttcaattcccagcgcccatatggtggttggtaagtccagttccatagaaatattataactacaaaaaggtccaatctgatcctgaagtgagtccctcacttcaggtggctggtaagtccattccctttctggcctctgtgggcatcagacataatacacatacaaaaataataattaataattaatcagacaaaataattaatcttgaaggaaggaaggaaggaagagagagagagagagagagagagaaagagaaagaaagaaagaaagaaagaaagaaagaaagaaagaaagaaagaaagaaaagggagggagggagggagagagagagagagagagagagagagagaggcagaaaacttcagcgttcagcgtctgctctatgtggcctttagcagagtctcccctctgctgtccacctcctcagctctgctccttctggttcctttgttgcattttccagagtcaacagggaaagtgttccttctcaactaaacatctccctgtgaatttcctaagaacaaagacccactctcaccagcagacacacaggaaacagaaacctttcagtgttaacagccactgcacctgacccaaaagctctatttcagacatcatctctgtcctggaatgctcctaactggcttccctttttctccttctcctgaatgaggactctcttcaggatcagactggacctttgtgtagttgtgaagtttgtgtagttgtgaagtttcctctgaccaccctcagcctgggagaggtctctttactctgctagcccctgcccatgcccttttgcagccatctgttacacttgtagactctgccttggtttgggtctgtctaatgtgccctcctgcttggaggcatgtgaactgttgatcaccactgatgatgttcatttctgcctaagcctggtccccctcatcctgaatagatggacttgccagctctcatctctgctagtccctgctacttcagaaaatggtactggggagaggtcttgagtcattaaagtacttgccatgcaagtgtgaaggccgaaattgggatgcccagcatctgtacaaaaggccaagtgtgggtgatatgcatctgtgaccccagtgctgagggtgtagggcagggacagcttcagattcaattgaagatcctgtcacaaaagtaaggtggagtgtgatagaggaagacagcccctagccaccacatgcatacacacatttatgtccaggtttccacagacccatgtgtgtgtgtgtgtgtgtgtgtgtgtgtgtgtatatgtatatatatatatatatacacagatagacacacagtctctctctctctctctctctctctctcacacacacacacaaacacacacacacacacacacacacacacacgcacacgcgcatgtgcattatgtacaagattccaaaagaaactgaacgtagtatgtagagttcagtctttatcaccgtcctctttttcttgctggcttcctagagaggggatgctctcaccctaaagcaattttggggcactgactagacaggctgcagtgagaaagtcactgccatctgatgacatcagctggtcacttgctgttcatcactctagaactttctagtctcttctacaggacagtggaggatttacactgggaatgctgttttcctttaatgaatccagacatctcccagtgtttccataggcgtagctttgtctctggagcccagaggttggccagaagcttctgaggtgactgcagagtgaagtgtgggactatttctgaggggggcagaattcctgagcatgctcacctggggggcagtgtgcaagactaagcttgttcttgctgcatggtgcggtcacccacagcatctgtgacatcctcttgggaggaagcaggcctcaaacctggcttgcctaccatctggggtgcgtgccctgcacagatgtaccaagacgtacccagaaacctgatcctgaggttttaattagtgatgagcaaggctaatgatattctcattctggtgatgaccgtgtggaggggctcctgctgatggattgtaagacaacttctgagatgttggggacgactgtcctgggaagtgagaaggagaaggagggtcagagtaacagccaccagcgggtgtcatcagatggcaaacagtttcattgcctttctcaccacagcctgttgatataacacagctgtaacctatttttaatgatggttcttaaatgctttaacctcccctgtagcccaccactcaccagaagtagtgcgggagaaagatatgggggaagtgaacctgtttagaaaggttctttggagcaactcccgtctgtgttgtctggaaatcggcagttcagttcacaggtcagcagtggcagctccatcctattgcagacatttcacagatacagcagcagtccagttcagtagagtagggttagcaacagcagtgacaggatctaacagagacagccaggcctcagcctcagtccaagtcagtaggagggacccggaagaacaccaggagaagttcttggctatgcctctctaagcaaaatgaagctcagagaagacttgaaactcatgagcattgcacagctagctctataagcagacctagctcaggccccatcactgtccatcaagtcctatttataccctccaaacatcatgtgttctccatgtgtcttgccttagcacaagcatttgtctcagcctacatcaccctgctaatcagtttgagtccacaggagtagctagaaactgcagcacaccaccagaagaggtttgtttgtttgtttgtttgtttgttttggtatggttctctctatggagtcccgacaaatgcagctcagccttgcactgtaaggtgaaccatgctttcacatgcttgttttagcagaacatccttttacctgtgtctgcttcagctaaacattccttcacaagtttgccccaacaaaaaaacatccagctgactttccaaagaacccttaagtttccacttccatagtcccaccttccttctattgtgatggaaaaagcataaggggctcggggtagctcaattggaaaatcagttgctgtgaaagggtgaggacctgagttcaaatccctacaacccacataaagcagcatggttagtgcacatctgtaatctcaccacctctaggacaagaaggcagaacaagaagagtcttaaaactcataggaaacctggcatacacagctacagacaacatgagtccctgtgtcaagcaaggaggaggtgaggctgacaccacggtctcgtgccatttatggacctgcatttatgtgatcacagacactcatacatatcatatacacacaaaaagatttttgaaaaaaatataaaataccagaactaaacctctttattgaaacgttcttttagaaagagttttgaccagagcaacctatcacctgaaagttctgttcacatatccttagaagacaaagggaccaagcttagacttggaggaagggtcagcgactcagagcagcagacattcatcattgggttgcttgaatgtttgtgctagagatatacacactgtgtgcagagcacaagccattgctaccatttatctctgagaggctcctcccaaaggcatgtatataagaggcttggtgttgtcaggaggtggtggaacctttaagagaaagtgagatcactgggaatgtacctggaaggggatcctggacccttcctctttctttcctttttttttttttttttttcttgcagtgaggtaagggtctttccacccaaggactcccacaatggtataaccacctgacctcacccccagaaacaatggtccaactgaccatgaattgagtcttctaaaaccatgagtctcaaaaattcttttctttttaaaaccgattgtccaagtattttgttatagaaactggaagctgactatcacaacaatcaaaagaaacattatgctatgctttcaatcccaaccttctgaagataaaagcaggagactctctgtgagatcagctagggctacatagaaaaatctaaggcactatcctcatgaaaaacacaatgacttgctgggctgcagagatgctcagcagctaaaggactcgctgttcttccaaaggacccagcacccaaccaccagaaactccagccccaggggatccagcactctcttctggcctctatgggcgctgcactcatgtgcacatacccacacacatatacatagttaaaaataaaagcaatggaaataagagagaaagaaatgagacgtgcagagtgagacaacctgtccaacaatgatgctgccaccctggctcctgctgtgttagggtgcatgccccctctctacaacccaatccttttttataaatggggctaccctgaggagggtttgttgagtcacttctgggctgaggtgaaaagacaaataggaatttaacccatgggtgagagaatgagaaagcaattccagtcaagacagacagggttacttatataatggccagataaaactgcacacaagaagctgtcaaatacccagtatggtataaccttaaggaggatggtcatttgcctccatgagcagcagttcccaagatggaatgtgtttccaagatggaatataagagtctgttttgaatcttaaaattccacataaaactctctcacctccgcctggagtgtagggactttcccagcctctggcattcagtggcctcagtgggggattcccagggtcctggctctgttcactgcctcgcctgctgagtgaccccaagttaggtgcttctgcctctgtccgcctccgggtcttcctttggccagtgagtcagctaagtaagataagtgctggctctctcctcactcttcaagttatttcttctgcactttggattgaggttctttccgtctttgtttcacaggcagttttattttgtgtcccatgctggaagtagaagccagaacctctggcatgcttcacgtcccagaccagcaatccattttaattgcagaaaagtatcaaaaatatagttaaggacaaaggtcatcagaggtcacctgccattgttgactatgtgttgtgcccttgacatagtgatgtgtagttagtctccaatcctgctatcagtttgaaatgagcttcaggtagggggattagagcactgtgacaagcatcctgcctgtttctcagccctttccaaggactggcaagtgcccaatcggaagagctcccaagggcttctgcccagagtgtctgcacacagctcctcagtggcgaatattactcaaaacggagctgcagccagggctttcttcccctttccaaaagggacatgaatctctagttgggaaaatgatgagtaacccccaccctggtcctcttttcctatctcacttacccagcaaggcctaatgctttctgtttgagcagatgatgggatccatatgtgtggttgtgtggtgtaaactgtatcccacttcttgtccttagcaacttgtgtttctcccatctccagagctgctgggctcccgaaaggagctgggatgtcccatccagagccagggaacagcgctcagctatacgccttaacctcacagctcttggctcttccttctctttggaaaatctcagatgttttctccctttgcttcaatttcctcatccatagagtggagaaaatattttctgtttcccagggaaattgcaatgtctgacgcatatccagtttctcagcccaggcacagggcctttgcccactcctgggactggtgttgacaccagaaacaggaagaaaacagagaccactgtggtggcctgaagtatccctgagtatgtggtgtctgtctcaaactgctgtttttcagacacaagagtccaggatctggaagtcaaggctcaaggctgctctggtttttaaaaactgcgggaagcttgccctcatgtgtcctaacagcccctgtttgaaaaccctccctatgatgccagaggacacagccttgcccctccctgctgacctggtcctctgaggcctctgatcagcagcaaaggttatcctgcttccctgacatctgtggtcacttgagtatacttttcccttcaggtgtcttcctgcctcttatgcagactagaaaatatagggctcttatcttttcagtggttctactgattgtcaggctgctcatcttcaggacattgaaatattaggcttttataggttagaaataatcaattcatgtttagcctccgtcccacatctatcccctagttcttaagtcttttggggtcatggaccatgttcatattgatgaaaagagctgacgtactcctttggaaaatgcatagccactgtacctttgcagtgtttcagtggcttccctccattgtgctggtaggatacctggcctcctgaggcttgctaaggtaccatgcccaggttctcctggaaaagtgactcagaggcaagccctgcaaccagcccggtcctaccatgacacttacggttttggagaggtaccaggtctctctgggggctcattttctttaatcacaggaaactatgaaagactgatctgccactgagtgtgtcttgtgcccagctgcagccaactgtgggacagaagacagtaaccctgttcagagttctgtgggtcagttcctcccctcaagggcacagagcccaggcaatctcttttcatgatcctaatcccctttgatatttatatgatgtagtgatcagaggaaggacagaagggaatggccagctggaagctgcagtcttaccactgaactagagacagatacacttgaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtctgtgcctgtgtgagtctgtatgcacaacatatatactggagcccttggagtccagtaatagggcatcagatcctttagaactgaaattatagccagttgtaagcctccgtgtaggtgatatgaatccacttatttgcaagagcagcaggtgctcttaactgctgaaccttccctctagtcccttctttattgtgtttatgtgtataactgtgcccctacatgagttcatgtacaccttgtgtatgcaggagccagcaaaggccagaagggggcatcagaccccctggagctgaagttcgaggtggctgtgaagctgtgggtgttgggaacagaacgcaagcctctgcaagagcagtaagcatcctcagtcaccaaaccctatctccagccctaatataactgcttagatggggtatttgtaacacccaataatgtatttacatgcatttattttactgactttaaagtgagtcagttaagtgattttataaagccaggagtgttgagtcacactaattatctcagcagtcagaaggctgaggcaagagtttgaagccagcccaagtaggctataaagggagaccttgtttcaaaatactataacaacaacaacaataatttatggaatatttttggatgatattgtgttgagtttctgttgatgtccttctggacgtgacagtaatgttagatagtggcaccttcctatgtatgaggtcctttaaccatccttagcgaaaaaccaaacacatcactgcaagagttagctaggtcctagcagacatcaagtgtgaggacaagagaacaagcaatagctcatggctcaatttatgaacagccgaaagtggaagtcaggccacccgctcccgggcctctgtccagtgggatgctgaccaccaggcatgacaacacaatgcccttggctggttggtgccagacggggcatggccgtttacagtgctctgtttgtccagcggattctgctcaactttcaccttcccatctgctttactgacgtctttgatgacctgtccctttcttggaagatcatgcccagagtttaccaaaacaaactgcctttggaagttaccagagttggcttctcgttagattcaagggcattccagcagtgagctctctgaaggctttgcttgctgccctgtgaggttttgaaatgcccattctaaaagtcctcttattcggctgccctggaaattctttttttttaaaggaatgccctttttcattatgcttgtttgctttgttttgcttgtggctgagcacatgagtggaagtcagagatgagctttctagagtcgacgctcctcttatcatatggttcccagggactgaacttggggcagtgaggcttggcagcaggtgccactacccactgaactatcttgtcgcccgccaccttggtgtttctaaaagtagtcagcaccatagccttttgccacagaagaggtaaaggaactgtagtgcagacattgttcccaaagtcagcatcttcaggacttgtttgtgttacacgatggcagcaatgcatcccagagtatctgtctcctgccttaagtaatgtcctcatcagtgtgttttattctaaagaatgaaagccctccgtgttccccctttccagaccatcagagagctggtgaaagtgcacacggaacaatacatcttaaaatctcagccctcaccagactcagggatttctcttgtgtgcggcccttagggcagcaagtttggcaccagtgtgcaagtctgaggagcactcggtgtcctgacacccgggcagcatccctgcaccgactgtagaggaggccgagcccaggctcgctccctgtggtcagatttgcccatcatcccgcctctgcacagctcgtgtctgcacagttgactgtagatttgctgagcctcctgggtgtttttaaggactttgctagcgctctaacttggtgtgatttgtggaagcaagagatatgctggggcttctcctgatcctttttacatcagcttcttgaaggaccttggaggaagaaatgatagaagtggggtttgagggcagtgccatgttctgcttacaagctcccaagcatcccagacatggatcttaacacagcatcactgccccttaaagaatggtggttattctttactctgtaaaactgcagctatgcctgtatcctgactataatcattagcttcacttcatctgactgacatagagaaccgattcaatcatgtgagcatatcttttaaaaaattaagtgaggtgctgaagagagacaccctggtaaaaagcctttgctgagtgtaagcatgagggtctgacggaatcctcaagaggtcacataaaagccaggatgtggtatgcatccacgatcccagaatgtaggaagtagggacaaaaaaaatttttttttggaagtatgagaggcagctagccaggtatacactggaaaaaacaagacactgtctcaagctggaaggtacaagacccaatacccaaggttgtctcctgtctccacatgccatttgccagagtggcgcttcgcacattacacacattgcacatacacataaatgactggtatagttcagaaggtagagtgtttgccttgcacacatttgcaggctggctttgattcccagtatcatataagtcaggtataaaaataaaaaaaatgaaaaggaatgctaatgaaaagtagtattggccgccgcccccacacaccccccccaccccccgcctgtgctcgcacccgcgcctgcctgcaccttccttggttggcgcttgcccgccgccgccttcccggcccgctcggcgccttctccgcctcgacttggcgcgcccgcagcatgcagcagcagcctgggtggcggcggcggccgtgaagaacggagggcggcggcatctttgttgcggctgggcagccgcggcctttgtctgcagatggtggacgcgggcggtcgctctgccacggaaggctgcaggnnnnnnnnnnnnnnnnnnnnctggaccgctaggacctggtgtgggccaagattgccgccaacctgcagtggatctgtgctaaggcctatggcctagacaacatccctgaggatctccgagaccttttacatggaccagtgtgagcaggagcacattaagccacccgttattaagcttctcctgtccagtgagccgtgtctgcagcctcatcctaaaaggggaccagggggctacctttcaaggacaccagtctgtcatctaggccctgtcccggaagggcatctatgtgatggagagtgatgatacccctgtgacagatgctgaccacagtcaggcacctattgagtggctacatggcaatggtagatgccctgatgatgggctatactgtggagatgatcagcattgagaaggtggtggccagtgccaagcacttttctacattccacacctcaaaagaacttccttatgacctcgaggatgccatggtattccggatcaataaggtaaatcttaaaataggagagagaacagagaaagaagttaaattaaaacagcagccactggaaagtcccgctcatcaaaaggtctgttatcggcgagagcacctctctgctaggcagtcaccctactctccattgttggaggacttgatgagagacagcagtgatggcgccgttctcttagccgtggttcactgtgattgcccagagcagatgaaactggatgatatctgtctgaaggaggtaccatcaatggctgacagcctgtataacatctggcttctgagggagttttccaatgagcatctgaacaagtgtttctgtctcaccctggaggatatgctctatgcaaccctagtgctgaagccgaacagtatggtttttatcgctgagctcttctggtggtttgagaacgtcaaaccagattttattcagccccgagatattcaagagccgaaggatgctaaaacagaattacagcagaagagcagctggcctcctgtccccacctccaacgcaaccacacgcagcttcctgggcagccctgctgccatgagccctgctgacctgccaccatccacccaacctctcactgaaggcagtcatcggtaccacctccactcggaagaacctgagtgtcttgggaaaggaacttccacatttagtccgtcccatccttcgttgccactgagacagaaacagcaaaaagtgtcacaggcagaggaaattcctgatcatcgacacagatccaaatctttaactcgggttgatggtcagccacgaggtgtagcaggagcatggacagattaaaaaaataaacaaacaaaaaaacaggcctgcatcacagccaacatcatttgctttccatcatgcagcaagttgtgatgtggatcccagttctggtgacagtgtcagcttagctggctctatcagcaaagatagcttggcatctaacattatccacctgaccccacagagccagccccatccttccgctggaaaggccaaaggagctggaaaagcctcctgagcagtgtcaacatggaggaggaggagnnnnnnnnnnnnnnnnnnnnnnnnnnnnnnnnnnnnnnnnnnnnnnnnnnnnnnccccaggcttggtagcaagttatcaggttcttcccagagacaggcagacactttggagagtaaacctaacagtttttacttagaacccctgatgccagcagtactccagccagccaaacagaagcagattatcactaaggaagatgagtgtggagaggggaggccaaggaccatcatggccaagagacctagtgagggctcccagcctatggtatggaagcaagtgagtggtagctatggcagtcatgacctgaacagaacgttcaccccaactccttgttcagaatttgctgcgagcattgatcttgcagaagtaggaccgcagtccgcagaagctataggggaagaacagcctctggccctggatagatttgatacattacctcaggggcaggctgctgatggtttctttctccatgtaggcagggctaaggaagatgagggaaggtggtccgttggttcacagagtcctagctcccacaagtcagagccctggaccatcttgaggcaagactcggactctggtgtggtggacgtagaggatacagagcaggattttattggtgaggaccatcctgtggttatccccagttatgctggtgaggaagagtcagtcaaactttacagggggatatgaaagtgaaggaacacgaagacaaggatgatgccagcagccgctcaagcccatgtctgagcaccacttctcagctccgcagcatggaagtgtaaagatgaccagctttgctgaaaggaagctccagctgctcaaaagcttgtgagaccaagtccagcagtgctaccagcagctcccagaagaccacccctgatgcacccagaagccgcccagcccctctgacaacatggcgccagaagagggagcagagtccaggcaggcacagcaagggccctgccagcctgctggcttctgctggtgcaactgcacatgcagcgggaggaaaagcacagagctattgaagcccagaagaaaaagatggaggcgctgtctgcatggcagcgtctaaagctgggcaaggcagcctttctgcatgtgataaagaaagggaaggctgatggtgccccacggccactgagacccgagcatttcatgaaggaattcccacagcacaatggggaggacttggatgatggcacttgtaaaaccgaagggttccttgtcaaagaagagcagagagatctcagtgatgctcaggatgtggtgtttgtccagctacataaacccaggggcccagctgttctgcatgatggagagaagcagagtgatttctactgtgctcctagaggacactgttggtgaggtagatgtgactgagggtggcctgtccattgagaagctcaatgagaccatcattacactgcagcaggctctactgatgatctcccagcagcaagagcagctcctcatgaagcccccctcagtgccaacaccaggcactaaaaataactgccaagaccaaaaaataaaggcccagtccactttgttgagccactctctccaactggtgttcctggccaccgcaaacccccacagcttggccagggccggaattcccactcaggaaggctggctaaactggaggttccaaaagacaggcagcagggttgttctcagagcaaaacctcaacacctagtgtggagatactcccacagtccaggtctttacccccaagcacccaggcggggaactccctgagaaatgtctctttgacagttataggctccatgatgagagtaaccatcagacatttgttctgtcctcttgcaaagatgcaaacattgtatcagagcaggtgaactttaaagagggtctagatacaagtgtgaaagaggcagggctgagctcctctgccatcacaggcaaagaacatactccgatggaagagccgccgaggagcaaggccagactcagtgaggtagacgtctctgacctgaaggcccctgatgaggatggagaggtggctggctatgagagctcggtggagcttggtggagatagtgaccaggagcctgggcttggtttcaggaacctgggcttggtttcaggatgaacagaaagcggaaatgagcttgctaagaggcgggcagcacaaggctgaagaggcagcagctggaggcagaagtggagctcaagcgagatgaagcccggtgtaaggctaactacggaaggaggaagagaaggcaaggcgagagctcattaaccaggaggaagcagcagcaggccttggaggagcaaggacttggcaaacctaaatcaaagcctaaaggcctcggccaaagtcagttaaccaggagtcttagagcgactctggcaccaagtgctcttccaccccagacaacttgagccaaactcactctggctccagcctatcctcagcatctgcagcaacaacagagcctgagttgaatcactagaagccttacttacctatctgtcctgagccacaaccccagtcagagcacagaccgagactgggagactgcatcagcagcttcctctttggcctctgtggctgagtacacaggtcctaaactcttcaaggagcccagtagcaaaccaaacaaaccaattattcacaatgctatctctcactgctgtctgactggaaaagtgaatgaaccttacaagaattcaatattggaggagctggagaagtgtggtgccaaccactgtatcattctgttccgagatgcgggctgccagttcagggcactttactgcaaccaactcaacactgaagaaatctacaatctcactggcatggggccaaaaaacatcaccaagaagatgattgacaaactatataaatacagctcagactgaaagcagtttaacctgatcccagccaagaccatgtcggtcagcgtgggtgctctcacgatccattaccacttgtggcagcccaagcagcccacggtgccaaagaagacccagacttataagtgaccacggcaaccaggactctgagaggttgtgctcacggcatccctatttattattttcatctacttggtacgaagtatgatgagccatggacagttttcctacagaggttcctagagaacagagacgatgctctcacccctgcacacatggatgctgggcctgacacgtgcaggagtgagtcctgtgctttcatgggcatggctgctgtggccctgctgaccactgagatcctcagaataagggacacccatggagtgagatcctggcctgtgggcccctcacttgaagttcttcagaataagttaaatgtgatctgctctctggcctcccttcacccctgtgcacattgcctgatgccccatgttggccagctgtaatcgtgcatgattatagggccaaggcttgtttgggtcagggggtttgaatgtcttcataaaagaagttcgtatgggaaatctttttcattttagaaattgtatgatatttattgaccgtgtctattgccaacctttatatccagttctaagattctgaaaaaagaaagaaagaaagaagaaaagaaaagaaaagaaaagaaaagaaaagaaaagaaaagaaaagaaaagaaaagaaaagaaaagtagtatctttgaaaaagaaaagcacacatggttttctggttcagtggagcaggaagagttcccgttacacagcagcaccctctgctccttatgtcctgtaccttcttcccacaggtaccagaacacaaggggaaaggagacctgtgccatcctgcccagctttgcaaggggttggccactcagggacccttacaggcactccctgagagagactgtgtacatgttccagctgggcctggccagctcaagactccagacaagtactttaggaaatgtccctgggttcatagggtagtccccttagtaacctacgtggttagttaaccactaagtaacaaagtggtgaattcttgacattcaaggtaggttatttatttttaattagaaataacttttttagctagatgtggtggtacttgccttaatctcagctctctgaaggcagagacaggtggatctctgcaagttggagaccaatctagtttacatagccagttccaggcctgccagggctacatagtaagaccctgtctcaaagaaaacaattcaaacgtgtgtgtgtgtgtgtgtgtgtgtgtgtgtgtacattatatatgaatgccagctatatgtatgtgcaccaagtgtgtgcctgttgcctgtggtggctagaagtgggttttgggtcccctggagttacaagcagctgttagctactgtaatggaggctagaactgagtctgggtctttaggaagagcagtaagtgcatgtaatcactgacccagatctcagctcctgaacagtttgttctaagatagagtcttgttaggccaggcctgcctcaatctcaagggcatccatcctaactcagtaatttgagactgtacactgtgcataaacagaatgggcaattttctttaaaacagttttatatttaaagggatggctccacttcccaagaagccaactgatcacacactggaactatctggaaaagaaagtctgggctaaaggtacacaggcttttctccactcttgctctgtttacacagaattgtaagcaccctgtgcctagcatgtcttgtcagtattctagacaatctggatatgattccagtctacaaaaaggtgtgcacaggtgacacatagacaccaacttagatagataaaaagtttatgctggacccctggagctggatttgagtaccacattctataccattaaatgccaccagatgactatatagccaaggtgtcaagatgagtgttgcccctcacaaatacaccatgtggccatgtatgaccctggaggcatggctcagacttcctgagatagtcttcctctgatataaaaagagttaaaatactttttcaatggccaagacaatgaagttagagcctgcatgcctgccatcatacactggggctggataagtgtctttatggctccactgaacaaaaattgggtgaccctctccccctcccctctctcgccccctcccccccaatccctcgcatactctcattttgtcattttcaatgtaaagtctcatctttagaagtctttaaaattagaggacagaaacaaaaagggagcttacttaggagggagcagattgcaacccctagggtatcagagtctgtttctttccatttcttgggaatccgtagctagggggttaactattaacctccatacagctgcagtttggtactcctgagaaagtgatggtggagacagtgctgtctctgctgtccccaggccatagtgactttgtaggtgcctggacttaagctgagccgacagaaaccgtgagagagtcactcacatgtgacctgactgctgaagcagggacaggagacagtgtggcagttgcatgactgtgtttccctgttccactactttctggaagtctgggggcccttgctcattcctgctgttgtggctgtaaattggtgggggcaggtcagtgcccacaagggtgagagtggcccctaatttatcttaccctccttgggtccttcagtagcattgatggatgctatctctatgtcctttttagtgccccataagatgactagcaagaaagctgtcccatctgtccaacatcaatgactttaggtttgaaaatggcatggaggtcttggattcctagcttgcagtctaaatgcctcccacgcccacagtaatgtgatcaggctagccactgtgcttgttttgggagcagggtaagattcccctagaaactgtcagcagctaggttgagtggggaaactgtctgctgtctttagtggtcttgaccttttgaagggcaataaaggggttggttttacctggtcatatttcccatcatgctcaggaaaactgtaggggcagagcagcttgttagatgctccacgaaagtctaaagctttgccttgagttagaacatatagttcccttttgctttacttcattctcagcttaaatcaaacatttggaggcttagggacatgaggctgatacgactagaagccacttcttggaaaacacaggtgcttctggtctgcactgacttgaaacagtatagctgcctctcacccatcgcttctaatgttggcattgattaaacgatgttattttgagttcattttgagtagagtggagaggcaggtatttggggagagtttcttaaaagaaaataaagttgatgtatcattgcaccacagggaccagaacacagtgggagcatgattggcagagtcccaggcctggggagcgcacacctcccctccaaggctgtctgtggagcttcctgtggtttgccccactaaagagaaacagcctttctcctggaaggtctagaatggcaagtttgtgcctcggctcagtgagaatctcactgctcttgctacagggctctgtcccaacaggcttctttgggaaatctcctgccctcccttcactgcaagcccaattcccaaacagcagccgttgttttgatagacacgggcagtagcttccagcatgagaggcatcatgctaccaggcccataacaatgaagtcatgtctcagaccaaatgttgccacacatacaaacgctcagtaagcaggcatgaaggccacgctacccagtatgcctgtgcaaactaggggagcctcaggctgtggccctttgaataaagaaatatttctcagggagaattcagtagctcagatcaggtgtaggaatggtctcatttcaggagctcattttagctaatgagtcagtggggtcttctggtgagtttccagtgctttcagacagtcttagactggcctggcttatcacattcctgtattctaccagcatatttaaggttagagatccttgtatagtgttgctagcaagttgtctgtattttgagtgatagagttctcaacagaaaaataatttctggcattggagtgtggctcagttagtagaacactggcctagtgtacatgaagccgtgggttggatccctagcaccacaaaagcagttgtggtgacacacgcctataaacttagcattcaggaggagtcagggggtcagaagtccaaggtcaccctgatagacatgagatcatatagaaagagaagaaggaagaaactgagtcagggggagagtaagaaggaagtatgatgggaaaacagatcatttccgtcatcctttgtgtaccttaggagctccttcatgtggattgagatcaatacgcttgtgtggtctcggtttgtgacaagttggtaaaaaatacagccccaatacttacatcttatctcctcttctgcttttctctgtctcatcgtcgtctttgtcttcatcatcttcttatgacccactgagtacaattagtgcacacacctcggtgtagagccggaacccactggagcatgggtagcttatcattagccgaatccccagtgggagggaacgaccccccaccttgtccagccatcatcagttgcctgtagcttctcagcaagggtggagcctcgtgagtccctctgccatccatgctgggatgttgagtgacttgatcttgtgcaggaaaccatggctacagtgactgcagtagccatgtcatggcagcagacagcatttcactgcgttcctttagtcctcctgctctcggaatccttcctccctgtaggttacctttctattgctgtgataaaacaccatgacccagggaactttgagaaggaagggtttgggggggcttaccattccacggggttagagttcatcccatcgctgtgggaggtgtggccacaggcggatgtggcgagagcagcatgatgagagctcaggccttgaaccacaactactgcacaaagcagagtaattggaaagtgtgggtccttacacattcccggcccacttacatagctcctccaacaaggctataccctaaacttcccatactgcactgccatctgggaaccagataaatgaacacatctcactcaaaccaccacatggctgctcttccaggatattcccttagccttgaggggaggtattcatacagatgtctcatttagggctgagcacgctagtcacttattctcaggactttagccagttttgagtctctgcagtaacctgtccagaacagaaagagacttctcctagttttagtagtcactcactcatcaactgatgggcatgtagtcgatccccctttctggctactggatagagcaatgatgaacaccggtaagcaattatctctgcagtaggatatgcagtattgggtgtatgccaggagaggtacagctgggtcttgcagtagttctgcttttaggtttttttttttttttgagaaaacccccaccctgatctccatagtggcagcacccgttcacatcctctgcatcctcaccaggtgtggtcatttgttttcttgataatagccattctaaatgggtaaaatggaatcccagaggttttatttattttttgtttttttttgtttttttgtttgttttttttttttttttttttgcatttccctgatgactaataatgtggaacacattttaaaatgttttggtagtcaattatattcttgtaaaaatactctcaggtctgtagcacattttttaaaattaggttgtttccacgatgttaaatttcttaagttctttgcatattctagatactaaacctctgtcagacatataattagcagattttctcccactttgtgggttacctcttcactcagctgatggaatcctttgctatatagttattttaggtttattgctctgtcatcttatctgctattcaaaaaggtcttgcctgtgcctctgccttgactactctagaggtttcagagtgtctaggtcttacattgaggtctttgagctgatttttgtgcaaagtgagcgactggatccagttttattcgacaagtagatgtccaagtttaaggcccctttgttgaagatgctgtcctttctccagtgtatatttttggcatcttaagaaaaatagtcatgtagttttagttgcatggacttaagtctggatgttccatcctgctcccttgacctatgtgcccttgtctgtgccagtgccacgctgtttctgttactgtggctctgcgttataccttgtcaccaagagtgtcactgtccctggcattggtcctttttcctgatttctttcttgttcagtgtgactttggcagctccatttttggtttttgtttgtttgtttgtttctctgtgcatgctttttatgaattttaggattgtttttcaatttcttgcgaagatgcgtgctgggattttgatttgattgcactgaatctgcaggttgccttttgtgtggtgactcttttcacaatatcaattgtttggatccatgagcttgcgaggacagaagtcttctagtctttcttagtttcttttttttggtgttttaaagcttttgttgtagaggcctttctcattgttggttaggtttatattctaagggttaaaaaaaaaaagattgttatgaatggaatcattttcctgatttctttctcagcatgtttgtcaatggtaaagaggaaggctattaactttcttttttaactttttattggttctttgtgaatttcacattatgcaccccaatctcactcatctccctgctccccttatacctgtcctccacccttgcagcctcctcccagaaaaagaaaatctcattatagaagctgcagtgtgtcccatagtgtacacttttgtccacacttctttgcttgcaaatgaagtcattgttctagtttagtctctggcttctgctgcactttcagtactggaacctcactgggagtcctctcagatagcctgttattgccctttgtcatagagatcctgcagctttggatctgtaagaccggctcctttacacactccaacagttcattgatggggtggatgttagggtaggtcaactcaaagccctggatctgggcttgggagatagctgagctggtcagcccaccagctttcccatacccacaccaccagggcaagctctccagcactgccccagctagctcatccaatgcagcagcaagcaaggtgtagagccagctctcccactttctgctctcacacccatggagttggctcacctgtagcccctgcaacacctgcagccacctctactttgctgaccaggtgaagtgtagggcccactctcctgagtgttgtagctggtgaaggacatagccagttctccctaggccagctctcctacctgccacaggcgacacaggactagaggggtgaggagggcatctctcccgtgtccacactaccacaaggtagacaaattgccaggccatctgtcccatgctcatgctcttaggctggctcacccatggccctgtcaccagggccagctcgtctatgctgcccaggtgaggttcagggcctgctctcccaagtgttacagccagtgaggggcagagccagctcttctgcctgctgcaagtggcaaggaatgaggggcgagggcatcctcccatcacccgtgccaccacagatctaatgagtggcagagccagctctcccacacgcatacccttagggccagctcacccatagttcccacaaccaaggtttcctgggtgagcggtggggctgttctcctgagtactgcagctggccagaggtggggacagctctcccacaaagcccaggtgaggggtggggatagctcaacaacatggccctgggtgacagcccagacaaggggcatccgcctggcctttgataatagcagatgcccgctgctgcaaagccacagacccagacataacccccagtgacacacaagccagaattccaccatggcctccactcatttgcttatcttgtagcacccaggggccctgagtgtctggagtcatctctggagtggtctcaggagtgctgtgccttgcctgtgagtgtggcactgggtagaggtcatcatattactgaaagatattctcaatacacctaattggcagtactacattagttttataaatattagtccacagctgccacaattacgttcattattcttatttaacttactattctagaatctgtagtagcccttattcaagcttatatgtttactctcctagtaagcctttgtttacatgataacacataataacccaccaaacacatgcatatcatacagtttatagttaatccaatcccatgacccccaactggagttttctctgccctactattaacttctaccatagagatatgatttcataataactccattacacttgtatccttaggcttagtagcaaataccctaactatataccaatgatggcattacactatttgtgaaggaacttatcgaggtcaccataccctactgaacaaaaaggccttcattatggaagaactctattgtatctgaagtcttttcctgacaggacttttttctgagttttctactccactccagccttgttcccacctgtgatctagggagctgctgaccagctacaggaactacagactagtggtcatcttaggctcactacccatccactctgctcagcaccagcttggggttgtcttgggcatagtctgaggctactgggttttgtatgttaattttgcatcctgctactttgctgaatgttgttttatcagctgtaggagttttctggcagaggctttagagtgaatgtacagaatcatgtcctctgcaaatagagagtctttgacttcttccgttcctatttgtttcccctttatttccttctctaaggaactatgattcccagtgctgtattgaaggagagtggagaagtagacagcattgtctcatgtctgattttagcaaaaatgttttgcatttttctcatttaatatactgttgactataagtttgtcatttatggcctttattacattgacatatatactccaaatttctgcaggattttaagtatgaaggaatatagaattttgtcaaaaatattttttatctttcaagatgactgtgatatctattcttgaaccatcataaaatttataaaatatatgtttgtgtgtgtgtgtgtgagagagagagagagagagagagagaaagagagagagagagttaaaaaaattaaagaatgcagcctgtaaacttgtaatatactcattcagttttaggatttccccctgtgaattagttatctttcatagttggattctttcttttaaatatagttaaacctcaggtaggaaatcatctttgactcctctcttcctaagttggttgtagaaactaatgtttgtgccattggcaaagaaataaaagccaatatctcgctgtatgcacttgagaccagatcctgtcacagggcaaaaacagctatatgtgcagtgtctgtgtcctcggatgctcacacacagtgtctgtgccttcagatgctcacctctgggaatggggcacttctggttcccagaacctagttttctaaaagaaaccaagaaaccccagcaggtctcagatgctgccagctgtgctggtcattcttgactatggagaccgtagggtagctctgtgtttccctccctggactgataacctccagtagcaaacacaaagagagtagggctggtcatggagtagccaatgagtggctgttgtaatacctggtcataaaccagctcgtagggtgccagagttttgtttctgttggaattggaaagacaagtcacctcctagaagcagggatggttgggggggggggtcaggtgagcatttccttaacttttttttgttcccctcccctttcctttcctccctcccactcattcctcctttcccttctcccctcccccctcaattccttctttccatccctccgtcctttccacattagcttttccaagggttcacacaggctttctgagtccctctcactcccttgtgcttgaagactgcagataaactctctccctgtttatcttccctatgatattctgcgtctcgcagatctttagatgtactcttggtctttatggtgatcaacttaagtcagtactgacttagctgacaggaaatgacacataattgaaaaagtctagcagaaaacggccttggtacttacttagctcacgggaaatgacacacagttgaacaattctagtggaaaatggccttggtacttacttagctgatgagacatgacttgtggcaaagaagcctttcctgggagttcccacatggacccgtgtattcatctgccaggtggtgtctcggctgctccgcgggtccttgtcttgagtttcactgggtctgggcacgtgtttaagatggaaatcacatactctgataaatatttacattttaaaagtacaattctgttgtcttttcccagtatgttctgaaggctgtgcaaccaccatgcagagtgcaccatgcatgcctttgtcagtctccccacaggctgtctacccgtccgtgatccctgccagcccatcctcctccctgatgctgccaagcatctgtccaggtcttctctctgggctttcctagtctgggcagttcatgtaacgtggcttttgagaatagcttctcaaaagctctgcatgatgttttcaaggccttttcacaccatagcgttccagtgtcttcctctcttcagggatgaatgatgccccactggccagacccagcccatacctgtcaggtgatgggcacagggattgtgtccgcctttggttgctgggaatgtgtgtgtgaagacaggttttcatatctcttgagtttatacttaggagatgattgttggctggttgacagccgtgcctccttaccctcagcagcagtgcgggaaggctccagttcttaccatccattgctgtccatttttattctttgataacctcgtactatgtgtttttatcatactcctgctcctctccccagatccacctccaactttgtgtcctgttattttgttagcttgcttgcttgttttttaaataatctatggtgtccaatttgaactgcctacatatgtggggccatgtcctggagcatgatggacttaccagaggccacacccttaaagaaaattggctccctccccagaagtcattaactgtcaccaaagtttctcaggggtgggggctcttgaacgccttcccattctatgctcgagactgttgattggtttcatcttgtgcaggcacacacaggtgctgtgagtcctgtcctgtctggaagacactgtgccacctctatcttccttcttagttttcttacagtcacctacagatgtagggtggtgtcctgtaggtacatgcaaggtccatctccctgaggttctaaagtacaccgccctaaggacccgtgatgtaggatgtctttctgtaaccacttttatacctttagctaagccatgtgtcagttgtgtttgtgattttactgagggttgtcagggtgattgatgggttctgggtaccaagcactgaattagtatatatgcacagcatcacatatattatagtatgctgacattttccattctctgacctctcttccctctcctgtagtcattggaaacaaaagctttaaggttcagtgaagtaaaagcacatctattttctcctgctgcctgtgttgtcagttaagcgaagaaacccttgtcaaatccagagtcagaagagtttcttacgagcaagttatatatatatatagttcatatacagtttgagactgttcccagagtcccgtggagagtacttggtgagcctggtgatgaggtcgggggatgatccctccgacaaagttgtgcttgtgaaattccggtcagttcttaggaaatggttgttgaggctggagagatggcttggtgattaaaagcactttcaagtttgcagaggacccttgttcaatgtcaactcatgtaggcaaactaaaacataaaataagctagagagatggctcagtggttaagagcactgactgctcttccagaggtcctgagttcaattcccagcaaccacatggtggctcacaaccatttgtaatgggatttgatgccctcttctggtgtgtctgaaaagagcaacagtgtactcatacataaaataaataaataaatcttttaaaaaatagcaaatccttctcttgaatagctgcctgaattcctgtgttacataataatgggttactctgacatcttcacacacagagatgatgtattttgatcatacacactcaccccttagagaactgggccttttgattagtagtgcctccagttggaccatcatattctctgctctgtggcttgttctttgagtgtttgctgatttcagtgacttttttgaactatttgacttggattttgttaggttgcaatctagtcctgcgtggtattggagtctctgctcagttagctttgtggtcaggagtaaatagagatttccttaaatgccccttccaggctcacagggggctctgtacacgctggggcatgcttccatgagcaggcaggcagttactaattctgaccagccctttagcccctgctggcacgatgctcaggtctgccacactgagcgcccagccttctcagagcccggctgagctcataggtggtttggagcatgacctgagcatcatgcccatacgtgctcttctgcagtgccaagaatacactgagctcgtcagagcctccagggacagttcccacaccttcctgaacaatttttgatgggctcctttttctcgggctgctaacctgcctaccaccttaacagccgatgactttaaacaaactagcctatgggcactggccccaggaaagagactttcacagtaggtcatttctgagtcgggtcacataaggaccgcttaggagcaggaacgcttccaggagttcctaaaggtagcaattatctgagaacttagctcaggctgggaagttacctctcacccaaagctgcccctcctagatgctttctccatgtgtgttgttatcagtggtttgcatggctcctatgtggtttgaggtggaaaggattggcacagggaaagttaaaatacaaatgaacaaacaaaaacaacaacaaagtcacgaacaaacctgttgcttttgccaggtctctgtttcccttgaacaaaagtcccacaggtgtagctgttccctttctcccagtgagggaggaggatattcttgggaatttcactctttctgtgtctccatcaggtattttttgtttttgtaaacttaatttggggacaatcctatattttaggagcagatgcatagcattcctgctgtgattcactcttgctcagtgtctgcctgaaatctcttcttgggagctgggtagatgaggttgaagtagctctaggatgggaaatgttccctgtggatggtcctgagccttgggattacttccaggtgcataccaactccccacactgaacatctttccttctcaattgacctcaatagaagttttactttgagagcaaaatggctctttgattttgttttgtacagttgtatgatataccagcaactcattcaaacaccagcatctagatttgattttgatcaaacctttgattctgatcaaaatacaaaatacaatgatacctgatactcttttttttttccttttttaaaaatttattctttagtcatttttttttttacactctagactttatcctcctcctggtccaccctcccaactgttccacatcccacacctccaggtcctccccactcactccccatccccacctccccacacctccccacaccctgggaccccaagtctctcaagggttaggtgcatctctctgactgagtccagacctggcagtcctctgctgtttatgtgttgggaacctcatatcagctagtgtatgctgtcttgttgtgtctaatgtctaagagatcccgggggtccaggttagttgagactgctagtcttcctatagggttaccctcctccctcagcttcttccaacctttccctaatttaaccacagaggtcagcagcttctgtccattgtttggttgtaaatatctgcatctgactctttcagctgcttgttgggccttttgaagggcagtcgtgctaggctcctgtctgtaagcacgccatcgcatcagtaacagtgtcaggtcttgcggcctcccccctgagctgaatcccgatttgggcctgtcactggacctccttttcctcaggcccttctccattttcattcctgcatttctttcagacaggaacaattctgggtcagaggttttgactgtgggatggcaactccctccctccacttggtgccctgtctttctactggagatagattctacaagttcctcctccccactgtagggcattttatctaaggtccctccctttgagttctgagagtctctcacctcccaggtctctggtacattctagaaggtcctcccatctcctatctcctgagattgcctgtttcaattctttctgctggccctcagagattcagttctgttccccacccacccccaagtacctgatcatgttcccctcttcccctccctgctgcctttcccttccaggtccctccattcctctccccacctcctgtgattgctttcttctccctcccaagtgagactgaggtatccgcccttcaacttattagccttcttgagttctgtgtcctggaaattctgtacttttttttcttttttttttttctaatatccatttactagtgagtgcataccatgcatatccttttgggtctcagttacctcactcaggatgatattttctagttccatccatttgcctacaaaactcatgatatccttgttcttaatagctgaatagtattccactgtgtaaatgagccacattttctgtatccattctccagttgagggacaactgggttgttttcagtttctggctattataaataaagctgctgtgaacatagtggagcatgtgtccttgtggcatggtggaacatcttttgggtatatgcccaagagtggtatatctgggtcttaaggtagaactatttccagttttctgaggaactgccagattgatttccagagtggtttttaccactttgcaatcccaccagcagtggaagagtgttcctctttctccacatcctcaccgacatgtgctgtcacctagctttttttatcttagccattctaattggtgtaaggtggaatctcagggttgttttgacctgcattttcctaatgaccaaggacttcccggatttctttaagtgcttctcagccatttgagattcctctgctgtgaattctctgtttagttctccactaaacccattttttgattgggttatttagtttcttggtggttagcttcttgagttctttataaattttggatattagccctctgttggatgtggggtcacagtcggtcatctcaagtttaaaggcagctgatgttttgatatgaaaacgtcttgagtcctctgcacgaccttgttgcccagtttccacgtgacctggacagcagtgagcactctccagtggcttttgggtcacatgggctacgttcttgacatgtgggcagcagcccaggcaatgctccgatttggaacaattttttgctccttgacctcatatctgttccactttctaggcctggctttatgagtaggtcttgcctgtgttcaacagaacatgcagacagactagcctaggatgatagctatgtttcctaccagcagtgtgcccagctcagagcagagagctcccctgtgcagtcgctccacctataaaagtcctaagaaacttcaggcttgcctcggtgtggagtaaggcctctgcacacagagccagctgggtgattgttcgtaagggagggagaatgtcttattcatgtgttctcttaaaatgggaatggcaggccctggtgtgtccagcagtagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcacgaccttgttgcccagtttcccacgtgacctggacagcagtgagcactctccagtggcttttgggtcacatgggctacgttcttgacatgtgggcagcagcccaggcaatgctccgatttggaacaattttttgctccttgacctcatatctgttccactttctaggcctggctttatgagtaggtcttgcctgtgttcaacagaacatgcagacagactagcctaggatgatagctatgtttcctaccagcagtgtgcccagctcagagcagagagctcccctgtgcagtcgctccacctataaaagtcctaagaaacttcaggcttgcctcggtgtggagtaaggcctctgcacacagagccagctgggtgattgttcgtaagggaggagaatgtcttattcatgtgttctcttagaatgggaatggcaggccctggtgtgtccagcagtagccttctgtcaccatactggggcattgggcagattactcttaaattgtctgtgagactgttttatttctttagcagttttagattcatagcaaaattaagagaggaatccagaaatattccacttatgccccacatgaatacagcttcctcactattgcagcccctagtctgatcatcccagctcatgaccccacattgatacttatcatttaaaacctatagtttatatcaaggttcacttttaattctatacattttatatgttttgggcaaatatatataaaggtacattgccaaacagtataaccacttccctgaccaatgaccttttaaaatatattttttcatgagtatagtatattcgtgtacagtaagtatagttgagcacatctgcttcatgaacccctgccccagcaatcttaaggctccatagttctgccttttctagagcatcacattgtagatatagcacataccccttgtggatacagcacataccccttgtggatacagcacataccccttgtggatacagcacataccccttgtggatacagcacataccccttgggatacagcacatacnnnnnnnnnnnnnnnnnnnnaccttttaaaatatattttttcatgagtatagtatattcgtgtacagtaagtatagttgagcacatctgcttcatgaacccctgccccagcaatcttaaggctccatagttctgccttttctagagcatcacattgtagatatagcacataccccttgtggatacagcacataccccttgtggatacagcacataccccttgtggatacagcacataccccttgtggatacagcacataccccttgtggatatagcacataccccttgtggatacagcacataccccttgtcttgcttatgcacatttttctgctgtataatctctgcatcagacacttgtaatctgctgtgtctcttgagggcctaatggctcatactctttccatgctgaggatcagtccttgtctggatgcattggttacttatcccactgttttgtgccgctcgtttacctactgaagagcagtttggagagaaacaagttatttctgttcacatccgtgcattagctttagtgtggccgtgtcttctaggctctactgggtcagatgaaagagtagccttggttttataagaaacctctaacaccttccaaaggaccatgggtctatgccagcagtgagtgacgtttctgccagtccgaatgcttagtctgtcagctatcctgacaagtgtgcagtgatggcccacgactgttgtagcttgggatcctctggtagcaggccgtgtgaaggatcctacttacttactttcaggaatcttcttcagttagctgtgtgttgaggtctttaggccatttttagacctcatgatttataatcttacacatgggcttgaagctttgtttgtttgtttgtttgtttgtttgtttgtttgcttctccgtctgtctgtttggtagcagcccttcctcatgtgcctttggcatcttctccccaccggtggcatgacttctactctcttcatgatacctgttttctcttggctgaaaattttcactttaacagaaatcagctctccagttcctcctcccacagatcttacctttggcgccaagactgggttttcccattacctctgctagctttctaagtctgcattctacatgcagtcctgtgacccattttgagctgatggtgttcagggtttttatgtgtggctgtccacctgtcccagtgtcaatttggactgtttcactgtatcccctttactcctctgtcaggtgaccacattcttatgggtctgtttctgagtcctctgttccgtcccacgggtccagttgtgttctttggccaaccccactgtctttatgactgccattgtacagtagatcttaaccttggcttatggcagtccccgacagttcttctcctttcatgcagcgttggctcttctgcatccttttgcttccctataaagtccctggactcctatcgttgacacctgctggggtttcctgggatcccgtcagttccgtagattatgctgggagagccagcatttggtgcagctcatcttcccattcgcaggcctggagtgcccgccatttatttagctcttccatttgcctcatcagacttacctgagacactggggcacactgtagtaccaggctgagaagactgaggctagcccaggcatgtatcagcatcatatctgcttaaaaggaaggaacagaaggaggcaaggaggtaatggggaggaatactgggagactatttgtagaaattacattgaagaaactttctttttctcgttttgtaagagtttttgtcataaatgggtttttgactttgccaaatatttttataaaactactgatgtgatcgtgtactttttttttagcctcttgccacagcagtggaccttaaatacttggctgttaaaccagctttgaaactggctgcttttatttacttcttcagctattgagacagggtctcactgtgtggtccttgctagtctggaatttctatgagaccaggcttgcttcaagcttcaaatagtcctcctgcttctgccttccaggtcccggggttacaggcacgtgccaccacacctggttagtgtattgttaaaggtctgacagttctgggcctgttgcttttcaggggaggaaggatcttaattaataactaattgttttttgtagaaagaagccaagtcaggatttaatttcttttaagccagtagctcccaaccttcctaaatgttgagaccctttaatatagttcctcatgttgtgatgaccccagccataagcttactcattgctacttcataaatataattttgctagttatgaattgtaatgtaaatgtgtgatatgcaggatatctgatgtaggttgagaactactgttttaagcgtactttggatctctcctttttagggttcccttgcgtgtagtctatggggactggccatgttctttcctcttcactgggaagagcacgtccttccttccgctctgtgtttcttcctaagcactgtttacactgtgggtcttcacgtgcactggctgtttttgcacttagttcaaaatagttttaatttctcttggcatcttgtctttgacccttgtgtcacatcgatctgcttctccatctcaggggttttgcgttcagcagtttttattactctcagctttctgttgtgctctgagagaggccttgtgtaacttctttttaaaagggattttatttttattttcaatcatgcctatatataagtgggggagggtgctgtgtgcatgcagttatttaaacagagagcatcaggttcctggagctaggatcacaggcagtttatgagcagcccccatgggctgggaacaagcagggatccacttcaaagcagtaaatattcgtagctgggaagaaggtgcattctgtggctgtgatcagttacaggatatcagttataaactgccaatggtagttagcagtttgaaatcagatgtgtccttgctagcttcctgcctactgcatctcttcatgctgatagagcatggttgacttctctagtgctaacagtggttttacctcctctgctgtcctattaactttcctcctagttatccctagactcagatattttggtgggactaggaaaataattaagtcaataaagtgactgctgacaagaggaagatctgtgtttgagtccccaacgctcacataaaaagctgagtatgagggtacatgcctgaacccccatcttgcttgggaacagggactaaagtatcccaacagctcataggctagccagcctccctccgtcggtgggtttcagtttcagtgagaagagaaagatggagagtggtcaaggaaagccagccagtgttggctgtgagtccccatgtgcaccaaacatgctcctttttctgacctgtgtcattacacccctccttaggcaacccctgttgttctctacccccagaaagtcaccatattaataataacttggtgcagacaactgattgtcatgtataccacagcctagaactcctggacttaattgatcttcattcttcagctgggactatgggtatgcacctccacatcctatcttcatatgcacctgtacacatgtgtatacacacacacacctttatatcctaccttcataagcactgcacacaggcacacacacacatacagatcccttcatattctaccttcataagcacctgctcacaggtacacacacacacacatatccctccacatcctaccttcatatgcacctgaatatgtgtacacacacacacatacacacctccaaatcctaccttcataagcacctttacatgtatacacacacacacacacacacacacacacacacacacacacggagggagggagggagggaggnnnnnnnnnnnnnnnnnnnncattgttgagccgctcattttacttggcaactttacttgttttgaagtcttctcagtaaacgtgtatggaccaactaagagctggtaccagcctgttgcagtttttttcctttctcagcatatatgttatatttttatcttttctaatatctgcctatattagttactattttattgctgtgaggagacactacgactaaggcaactcagccaaaagcactaaattaggggcttgcttacagtctcagaaggttggtccatggtgatcatggcagggactgtggcagcagccaggtcgaaggcacactgctgaagaagtagctgagagctcacatctaatcagcaagttccaggcagtgagatcataaaactagacctggcatgagcttttgaaatctcaaagctcacctccagtgacacacttcctccaacaaggccatgcctactccagcaagacaacatctcctaattctgcccaaatagctcctctaactggggatgaaacattccaacacttgagcctatggggggtcattctcattcaaaccactacattgccctagagctaaatataccttacagctgctgatctgcagtgctgtgccagtcacgggggacagacaccttatgctaacacagtgtcctaatccctccttcctggccttgtgtcactgctgccactcatttctgttacacatgtgtacatatgtgtgggtgacacacgcataagtagccatgatcatgtacattgttattctgaacagataaagaatcagaagaattgggcagagaggtggctcagtgggtagaagcattaggcgggcaaacctgacagcctggactcagtccctgtaacccacagtgccaaatgtggggctagaggtggctcagcagtcaagagcatggctgagttcagtccccagcacccaaggcaagaggctcacaccacctctaaggccagctgggagtaggaggggtctggtgccctctctgacctccaaaggcacctgtgctcatgtgcacatatccacagagacacatacatgtaatttaaaataaaaatttgaaagcctttgttgtgtcttgctaggtgcccgccctactccatattgttttccacctgtgttctcatcgtgttgactcaagctgcttcagcttttggtctgctaatcccagtgtgcttactggggctggttactctgttcaaactgtttttgcctttatttagctttccttgtgttttcatagctagaaatgatgccccgtaaagaaaaatgtaagtgggccttactgaaacaggggcaggcagaggaaggagaagggggacaccctctagtccctgagccttgggactgtgtctcttttctcctgctgtgagccgtgggcagggtggacgggtatttctcttggcaggctctgttaggatccactctctgccctgcctgtgttaaaagtgtagctctgtaactcacctgctggaagcagagtgggttttctctgatgttcactctgagaactagttgagctctaggctgtagaactcacaaaagcctggggccttcttcctcctggaaggcttccctgtctttcctctgaggcttccagggctccctctgtctgttacagtgcaggtattcccgcctggtgcaggttccctctgactggctattttcttcaaaattctgcttagtctgcctgagacttcaatgtaggaaacagatttttgctttgtgacctcaactaagtaaatgttgcagaggtaggtgtcatgtgtaggaggtagggaccgtgtgtaggaggtaggtgccgtgtgtagttctgaatcatcatgcgcagggaagcacaatgcctagacaaaagtgacttttaacaagagctttccagaaattgcacttacatccccattaaaaatatataagctgctggttagactggggtgtatgttttgtgcggcccttgttgaagaataatagacaaggggctggagagacggctcagtggttaagtgtgtgtagtgtttttgctgaggaccctgcactgattcccataaagcacattaagccactcacaactacagtaacaacagtgtcagggatccaattccctctggcctctgtgcacacctggctcatgtggtgcacataaattcatgcaaactcacatgcatagaaggaagggaagaagggaaaaaagaaggaaggaaagagaggaaggaagggaaaagaggaaggaagggaaaaaggaaggaaggaaaaggaagaaggaaaggaggaaggaagaaggaaagaaggaaggaaagaggaaaggaaggaagggaggaaggaaggaaggaaagaaggaaaaataatccatttgcttttcatagatgaaagctattacattgagccagctcagttggggaatggtgcttgctgtcaagcctgatgacatgagttaggttcctggaccccaccccacatggtggaaagagaaaactgacttccacaggcttttctctgtgttttggcaaacatacctgcacatgactctaaataaatgtaataaaatattttttaaagaaaaacattacttcttatcgttatgagatcagaatccctatgaaagccttctccagagtagccctgaactgaaaggctttggtgggcttcagtgcttagctgtagactatggatttgatggagcagagagcaagagttagcacagtctcagatggagatatgatactactggcattgtttctacaaagacattctaccatcttagtccagagatgtgtttccatatatgtcataaataacaaaaacctactgtgcaaaatggttaagcaaaggctcatatcaggaaaggacaggtatcacagagtgaacatggagccagcgagttggctcgggagtaaaggtcctggccaccaagcctagcaacctgagttcaatatccaggacccaaatgatggaaggagaaaactgactcccacaggttgtcctctgacctttaagtgagcacctttatggcagattgggctagggtggacaagggtgtgagcagaagtgggtggggtgagcagaagcagatgatatgcaccactgctttatttaggggaatcttcccaacctgtgggaaacttgcagtcttagggctttgctgctcagcacccttgttagctcaagggtcgtgctgtgccttgtgtaggttggaggttactgttagatgcactttatcttcctcccttccttcgaagctcttcttgtttgtttgcttttatagttgtagctacattccatcctctaagaagactaagccccttctaagaggagaaaggcctaatacctttcacgagctgcttgggttcagcagtttaacttgcagcactggaggtcccttcgtgattccacacaccccaagaggattaagtttttccacatattttctagccagcactgttaaagcctcagaattaaactgtccaccctggttacaggctgtctgtccttcgtttgtccttgctgtccttcctccgctcacaggtttgaagggttacacagtgatctttagaaacaagggcttaaagtccaagagttcaacaaagatccaacaagaggtccacttgcactaagtcgtcaccaaataggtcagatgtggaagccctctgtttaatttgaatgcttattcctctgagacaccggtctgatttgtgaggaatctcgttgagggtgagggaatccatatttattaaatgctttctattttttttgttgatatttatttatttatttatttatgagacagcaattgctcgtactgtagaccagggctggcttcaagctcagagattagagtggctaggattaaaggcataagccaccatagcccagctcttaagtgatttctgaaacccatgcattgggctgtcaagctaacgactgtggctgagtcaggctgttcagctctccaggtctcccaaggtgacctgtagcctgtggatccttttctccctgcttgggctcttctcggccccctggtttggtttggtttggtttggtttagtttggtttgagacagaatctactatgtagccctggctagcctggaactggcagtgtacaccaggctagccttgagtatatggagatcccccaaccctctgcctctgggattaaaggtgtgtaccaccatgcccacctttctcagccccttcttgatgatgtcagctctttttttttttttaagataagatttatttatttattttatgtttgtgagtacactatacctgtacagatggttgtaagccttcatgtagttgttgggaattgaatgtctaggacctctgcttgctctagtctgtcccgctcgaggtcaactctgctcgctcagtccctgcttgctccagcccaaagatttatttattattatgcataagtacactttagctgtcttctgacacaccagaagagggtaccagaagggggcatcagatctcattacgggtggttgtgagctaccatgtggttgctaggatttgaactcaggactctcagaacagtcagtactcttaaccactgagccatcttgccagcccgctgtcagctcttaagtatctcctctttttatccagctagggaacccacagatgtagcctcactcaccttttccctaagccagcctgtcctgagcaagcacttagctcagtgacccagcactgctgagatacctcccctgcccaccttcctcctccagccccagaccctgactttcccatacatctctgcctcttcttaacttccatactacctggggcaggggagctggccctgaacactaagcccacctgcacttcttaagcaggttatactcatggtctgagggcagctttatgcagtatctgtagtatgcttgaatctgacctgtggctagccacaggagaccatgtggacagttctgctagtggcaccataccagcactcagcctattttgagattttcagatgcagaacactgagaccattgaaggagcctggtttcccccttttctatcctccctctatcctttaaacacaccactatatacacagtctggatattggctttgtttaatatattgctatatcttggaagtcaatttgtaccagttgttcagagccatgtatgttttataatgacttacaggatatgccactgattgtaagtgtggcataatatggctgcacagtcccctgtcagatatctgttttcaaggttctttgctacagtggtttagtgagcaatcttacatctgtgttcatgctacagacagctgcctggaaactttcacaagtgaaattgctgaattgtggtatttatgcttttccaaaaggagaatttttaaaattctacttcttgagttactgcgtctcagctgtctgttcacgtgtccactgactcctgggcgagccctcaatctgctgtctttttcacgctcctctgcctgtctcttctgggttctagaactttctagaccctgcatctcactgcctgcgcttcagttgacagctgctgtgatcactgggtatgacagtcatatgttttgctttgagagcttttcttctctgtcaaggcaactggcctgtcatctctggccttttatgtgaaggctagcatgcttatgagaatcctgtccacattgactgttcagatggactctcacaacaggtagtcatggacctagagcccagacattgttagcattgtgggccaccccgagcattcctcttccaggtacagtctctccataggccacctcaatcttgaattaaaaaaccctagattaatttcacctgtttttatttttaactttgtataaaggtaattgtgacctgagtacagggtcctccttctgtaatatttgacatgtatatttttaattcctgttgccatataatcttccattcatttcgccatccattctgaatagtcacttacttctgcctgctgatgcttctgtgcacatctttgttcatatatctaagggcacataagtcgtcggcttctacatggtctcctctgatactgtatgggagtcccaagtgtcccagatcctgactttataacccctttggtgggtcttgatcacaggatgttgagcatattcttgtgttgattgcccttgtgtgtggcactcctgttgacatttgcagttccatttctaacagctacgttttaccgtgcgttcttgctagctgggatgtcagatttctaacagaccattttgtcctgcccactcccttgactactttccatttttcctgggatctttcctcatctgttacttattttgtaacaagtgaatcttgggccccgtagcttgcgtcttgtagaacattcactgaatttgcatgaaacttactttatcaggaaagttggcatctacacagatgtcatgactctcccaagcagatgtaaagagtaaatactcactcctcctatatcctttcctacagatgtttttaagagagagagaatgacaatgtgtgtttatatgtgtgtggccatctgtcatgtctttatgtgagtacagaggcatcaggtggcctgaagctagagttagagccagttttgagccacctgatggttagtactagaagctgaacccaggtcctctgcaagagcagctgcccttagtcaccggactctccagcctgtcaaatagcgttttacactgctttattttcttttttaaatgttctatcacattcattcatttacatatagttagttgtgtgtggtgtgtatgagcaagtgtgcatgtgtgcttgtgccaaggagtgcatatggaggtcagaggacaacttgtgggtgtcagttacttctactctgtgggccctggggatctgacttgggtcatcaggcttggtggttggcacctttgcctgctgagccattgccctgtgtttagcaagtgcttgttagaaatcagaacctttgaaagcatatctaccaccatagtgcattcccctttctaaaagtcccaatgttttgcaggttcttgatcagtacgagcgagaaggattcaccttcctagcgaaggtttttaactcctcacattccttcttagaagacttgaccggtcttaccctgctccatcaagagacccaagctgctgaggtaagagcacttcgcttctgtcctgaggactgaggacagaacctgcctgactcttgcctttgtgaaagaaaatagagagattgactttgacttcttcttcctgagagcagggagcaccctggtatgctaaagtgtctgcccaaagcaccaagagggcagagcaagtctggccgctgatttcctagcattccttgtgtttctggagggtatgcttgagtccagctgttggtaaacagtttacttataagggctctgtcagacacatctgttagggaggatcctgaactctgggctgtgtcatcagagaaagcatggatgacttgttgacagtctagtcaatcttaggtgccaacattggtctgctgtgaaatgtccctgtctggcttgggagctgtgcaggtccccaccctgaatgagggacagccataggctaagagtgaaatcaggttctcacagtgaacttgctttcccctgaagggggtcacgaggtgaattgaaccctcaaggcactgccatggctgtgcagggaagcccctgccacccctattctgaacacctggttcaatctcagacatggctacagaaacacaagtcttgatcatttataatcatcccaggagttatgtctctacactgcataggaggccccaagtagtcaggaagtggctgagctggaccagtcctggccagccagtggaataagggctgctatttggagggatgtgatgagctctgagtgaagaaacctttggaaaaaccagaacagggctgcttggacttgtgagcaggtttgggtgattttcaggcacacccaggaaacaaggctgtcctctagcacttgcttagaactgaaagtgatttatctctaacttgctcgatgcagggtcattaaacagatgtgatctttcactgatgtctggtacttaaaacccctgcagagagagtccctcattgagagacaaagctgtgccctagggctgagactggggccccaggcgggtttcagggtatgctaatggcagctgccattgcctgaaagtgcatgagacagaacctgcaggtctttgcagctgtgacatcactgacgagatggggaaagggattttccaagtcacccagaagagcagagaattcctctgatctcaccctagagacgcaaacaagatgtcagggtagtggctcaacctttgatcacattgagttactctgttttagtagcccagttggcccagagacccagagaaaaagaggttccagcgagccttggtaccagtaggctgtgggcaggaaagtagagcctcatctgcaagcctgagtgggtttcttgttagtttgcttgcttgttatttattttaagttcttcactaagttagctctggggtcttaaatgtcccataacattggaggtgaaagataacaagtcagccagcctatgacccagatgtggcttacagctgtggtgttttgaagcttgccctgtgttaaatttcgaagaaagccagaattttaaaattatgatttttacattaaagtctgaaattttcaacttctttgaaaaatggaatctggcaactacaggtgcatgcttcttgactagagggagccacacaaatgatgcatttgacccaggctttcctgcataacacgtgtgacgcgctgaggatgcagctcggtggtagagtactttcaagcatgaaagggcccagctgggtccagtgccagcaccgcgtcaggaaagtctatagaaacacagtcatgcctgtcacgtggctcccgtttcctctcctggagacagatacagctgctgtttcttcacccttcagccatgttctgggtttatttcatgttttgcagttgacagtcctcctgggagtttggatatgtaacccttgacttgccaaagctctaaatagaagctttaaacgaaaagcaaaaatagtgtcctcaccaggggacctgataatagcaaaaatcattgtcccactcaggacagtgaaaagaacttgtgtgagagagaatgaatgtgtaggtctgagaattcctggggatacagcttactagtagagcactttcctagcatgtggaagcccaagcctcagttcttcagggtaggaagatcaggagttcaaggtcactctctgcttatagtgaattcaaggccaacctatactacctgaaaccttatctcaaatacaaaacaaagccaaaaaaatctatttatataaatatagtattttgatttttatacttatttttggtgctcagtatgaaaatctgaacatgtgtattttttaaacacaacctcatgaaaatggtaatcccttcccttttggatgaactgttttcttgggcttggtgtttgcaaagaatcatcaaagtaatatgtattatttcatcatatatgttgtctatagaaagatttaatcttttgtggtgctgaagctcagaaccatgtatatgcatgcatgattatgtgtgtgatttaaaaattactacccatgtctgaaagtctgctgcttgtaccatgctggttattagggtagggatcaatgagacggttatgctcatgggctcatgtccactgtgagaagcaaaggtattgacaaggagctgaggggccatcagaaatgtttagtcatatgtatgcggtcagttccaagactcagagagtcaggatgtaaaaaagccttttaggaagacaaccaccattccctttagccctttaggctttgttttgtcttgttggtttttgtttttgtttttaagatttatttattttatatatgtgattacactgtcactgtcttcagacacaccagaagagggcatcagatcccattacatatggttgtgagccaccatgtggttgctgggaattgaactcaggacctctggaagagcaatcagtgctctttactgctgagccatctctccagctcgagcctcttagttttaaaggatgagaaactgtctttataaacaaaagctggattttataaactggaaagctggggaggagaacaccaatgccctgagccttcccaagttacaaagcacatcacagccacagagctcatcccagctctcctgtacaattctgtcatttgtagtttttgtttttacatacagggtctcactgtgtagccctggatggcttagaactaactacctggagccaaggcttggtctttatacatataacaccacagagatctgtctgcctctgccacccaagtgacaatccaagtgtttttatgtggactatatatggaggattaattttatttaacactgaaaagttaaaagaacttaggaaaggccatttgccatggcctgtgtttcatcttggggccttggacagacacccacattctttgaatcccatctaggtgtcaaatggtgttttcattttgcccatgggatgttagaagtccccacagaggaaaggccccacttaacctcctgcatgcttgaagcatggccatgtgtggaggatgctttcatgcttcacctttgaggcccagcttcctgagagtagagctggcccatggagactggccttgactctctggtccttcctccagcctctttgcaacctaaggaaatgggagttgcaagttgatggaccatatcatgtctcagtcacagatctgctgaggagttcctggagggttgctttaattgctggatttcctaaggaaagtctcagtctgactcaaacatgcagatgcattagcctcgttttatgaaactggctcaagttagcctctggggttttttctcatcctgggacaaaatatcagtttctgtgtttttattttattccaactgtggtttcagcatcgtgctctgagaaacaccaagatacatttttctactccatctaactaaagtaaaaggatgactcctaagggagctgatgaaacaaaccatcttggtccatccttgagagattgaaattctcagatcccatagccagaagccagcattctcctgcctcccggattaactaactccaggctctctgcccctcactctggcctcttgacaacacaggacagttgcaccatgggtggtgtcagcactgtccatccttagcattgtggtcaaggcgtttacatcctcgggcttttgtgaggcagcatcccccttgcagatttacgcagttacttagtgataaggggggaggaatgttgactaccaactgttaacacaggctgtacagccccttgcaggctggcagccacagagagggctgcactgacagatccatccagagctgagattcaaactcttaactcactgggatacagaattctagaaggtggaatgtctgttgtcctcacagcagaagtcacaggagaaacatggcagctgtatggtgtgacttcatgggcagaaagacttcctgttctgctcagtcagccacgctgttaacaagtgtttctgcccggcctttgcacttaccccaagtttctggcccttcgccctcacagctggttttgatttggtttctgtggaatagttttttgttttgttttgtatttaacaacagtcagatatttatgtacagcttcatcaagagcctctgatgacaaataagcctttggaggccaggggaggctgtgggaaacccccgtgtcagcactcagacctgtttgcagtggagagagttcactatgggaactcatgggcttgttcaagcacctagccctgtcttcccagagtcctctgatagcccgtctccccggtctgtcctgggatggtgccctgcactgaattttccttatgaagcaatccctccaggtcagccttggccctctctcctgagtgaggggaggggaggcagaaactgcaggcacagagccaatcgctgcttagtttggaaactggagcctgtcttttgaaatccagcttggcagcatcccattgagaactcgctgtgtaaagtgtgtcccttttatttgctgtcagagttatctgtagaaatgtgagatgtttatatatgtgggcattagggacagtcctgctgaagggtagacagcaaagtctgcgtggaatcctgccttccagagaggaggctgagtggcgcaacctacttagaggccatggcagagagaatggggaagtcacatgcgacacacagacaagacagctgagcaatggaagagaggctctagtcctccttaaaccatgggaacacaatcctttttaaattgtgagacttgagtcctctttcaaccatgaaattcaagaccaaaagacattaaaccataaagacttcaagatattacattaacctaaaaatattttttaaactgagtcagtcatgtcagacaggaattttatctatctggctttgtctgactggatcctcaactttgattggcagttgtatatatctttaaatcatgaatacattaaactaactggatgcattttgagttggaggggcttttcacgatggattctgtgagccagaaggtggaaagtgagtgaattcctagaactaggtagcacataggccaggcacagctgccccgacttcctgactcagcggtgcggggaccctggggtgtccttgcagcctgtgctggccttggttttctaggggctatattttcacagctgatccttctcatttgcaagcaaaacagctgcctcatgttgaatttggggagattccatatttcaagactgcaaaattaaatagatttgtagctctgagattgcaggtctgaatcttctgcttttcagttgcgcacgaggctcaggggtagaggggacagcagcgaaggtgtgtgcctgttactccagtatctcagctagtgttcatcagctctgcccagctcctgctgctgaggaagcagagaggcccagcaccatgggacagtgccatggtgctgggggaaggaggatgtgagccacacagggcttgtagctgtagggacagagatgacacatgcttcttttgtttctgtggaatctcaggttctcatgcgggtgggggtggggggcgcgggcaggcaagagcaaacattggttctcagagattggaactccaggtgtagggcagaaaaagcagagcaggggttccatatgtgcctgtgtcagtagggcctctgagactgtactgtagccaccaacacacttctcttctggatatgtctgcagtcaccttatgaggaagaagtacccattttacagatgaagctgtagaggacagaggagtaaccaaatacactgctgacatgcttttgaacttcactgggtaaagcctccatgtacatggtaaggtttatagtacaggtcactggccagaagcagcgagaacagaagcagggtgtcgagatgcagctaactcacagggagtctctgctttcatactgagcctacaagtttccacacacagagcactctgcccatctcacccagacacattctctggtagcttgtgtattagggttctctagaatcacagaacttacagaataacttacagggaaattattggaatgacttacaatctgcagtctaactatcccaacagtggttagtgtgaatgggaagtttatgaacttagtagtcgctcagtcccatgaggctaggtgtttcagctgatcttctgtagaagtagattccaacagatgtgcaagcaggcaaagaaaaagaaaaccttccttccattgtccttatgtaggcctccagcagaaggtatggcccagattaaaggtgtgtaccaccatgcctgaacttaagctactctttacttggaacttgctctgtcccgggctggccttgtattcatagatctgcttgcctctgtctcctggggttaacggtctgtaccaccttgcctggcctaagcttttcatgaccactgtgcttcaagatctggatcaaaagcctcaagatctagatcacaagtgtgccctctgtttccggattgtagttcattccagcaagttgacaactgggaatagccatcacagcctgtctctttgtgtggtggcatctgccacatcactgtgccttcttactcttccactggcttctaagagaatccaagggtccctgagaggtttgcctcaccagtgaactcatgactcgcctggggacgagtagaagtagattccaacaggggaagagcaggtctgaggagttttctttctgggcttccatcttccctaaactggaaaagaaatcaagagctggccaccacttgcacttacaacgctgtgtggtttttaaaaatgttaccaagctagaactaggtaataggtttttgtcgttagtctgtgtgctgggcctgctgagtctgcactttgccactatccccatttgcaaccccttattttgttttagtatttgtgtttatcttaccttgagcctccttggaggagaccccacctaattctgcttggcattttattaaaaggaaataaacttggctttgtaaaaagagttttcaaaaatagttgatattcataaaggattacacacataaaatatttgtgttgtttctgtcagacttgagctgcaagcattgatttctgaaagcatcagctagtttgtgtttccgtgcccagatacttgttgatacactcttccctctgtccccctccattgcctcccctttctttagtcagtgacctgtggcagtagacaccagtccatgatagctgagcctacttcagccttagcagtgtaggcctgaggatctaggataggccagtctgcaagaaggcctgggattttcatgctagaggtagaggcaggatttcctcctgagcctgccactgtttacatcacttcctgttacctgggcccagctggggtctgagattgacacctagctacaaaggtgttggcatacttttaaatacttttaaaatctttaaagatggggagccagtaagatggctgccatgcaaaccagccatgctgagtttgagccctgaaactcatcctggatctcagagcttaaatctgtgttagttttcctacagcaagacggggagggtgaagatcctggaggtgtccaggacccatgtggaccagctagcctggagcacacagtcagcagtgacgatgaggtagaaataagaaactacctcaaaagtgtcctctgatcccacacatgtaccgtggcactcaagcgcctggagacatacacacatatgagtagtggggggagagtaataataataataataataataataataatttttaaacttaaaaatgaaatctttaaaagatgatacaaatttagttaatgtagtctaagtacaactttttctcagtgttttcttaaaccaaaagtgacttctttttttttttttttggtttttcaagacagggtttctctgtatagccctggctgtcctggaactcactctgtagaccaggctggcctcgaactcagagggccatctgcctctgcctcccaagtgctgggattaaaggtgtgcgccaccaccgcctggccaaaagcgattcttaatatgtaatgccacagacctttgaactttaagcaagtattaaccagcctagaagtgatttgggttttttttttcttcttgttgtttggtttgtctggtttttgtttgtttgttctgttttgttttgtttttgagacggggtttctctgtgtagccctggtgtcctagaacttgctttgtagacagaccaggctggtcttgaactcctagagatccacttgactctgcctcccccaacccccagagtgctagaattaaaggcatgtgtcaccaggcccagccctggaagtaatttgtatttgtattaaatgaattttaagatgtcagaataacaacattgtcagaatatatgaaaaaactgtgtgaaagataaaaggtcttactatgaaacaggctgtcaatggcacactcttactggctgtttggagggtagctttttctctggtgagtccccagtgttcccttgtgcatcaaggctattgatctgtagacatgccaacctctctataaagcaggagagcatttgcatggatcctgtgcacattctttccaatgcctggagtcatctgtccatcactcatgagccctcagatggtgccagtgacgttcaggtatcacaccgtatctcttaaggaatggtaaaaggagaaggtggagcacgctacagactcagcaccgggaaacagaagcagaatcgccatttcaagtcctgtcttaaaaatcaaaaccatatctaagcacagtaacactgcatgtctttaatcccagcctttgagaggtagaaaccaaaggatctgcagttcaaggccaccctcagccacttaaggagttcagggccagcctgggttatatgaaaccctatctcaaacaaaacaaagcaaaaatcctgtccatgctcagtgcagagatgctgttttccatctgcactttattgagttgtggctgtggaaccggaaggcatggaggcttgcagtccatccttctgttgctgtgtggtccctgactttattcaattcatccatcttgtctcaacctgtttctttccccttgagatctgcctgggacccctgctgagcctgctaactcgagccctcatctcctttgaggaatgggttctgactcgttggacccaggtgcacaggcttctgacagggccacatgcctctgaggggggagaacttgatgccccaattgctttcaagacatttaaatgacaatgatcaagggaatcccctcctgcttggctctcttttttttaaattttttttgtcttaatattttaaagtcatccacaatacatgcagaaaaaaatataatgggtcctccatggcttcatgaatgaagtgtgatgtaaactcgcccttcccagcccatgtgctgcttgccgcctgcagtcctggtggccgctccgcacaccctgttttttcatcgttaactctagggaacacgtcctcaaacaatgcatttctgtcctgaacttccgtgagtggaattgtgggacatctgctctgtgctgtgtctgcagtttgctctggtcgccatgcgcctttccctagttagaaagtccctctctccaacacacttcagggcggggacagggtcctgcactgcccgtcactgtgtcagtgtgtctgtcatgagcttaataataatgctggatagagtcagtttttgtagggctaccaaccaaggtcatacctgtgatttggtttttttagctacccaaactcaggtttcactcctttatgggtagatatcatccccacttagacacacactgtagtgggatatttagaagtggcattttacctggcatttactctggagtgatggccacttagccttttataaataatcagttttcttatctgggagttatggggttgctcttcctatgggaacttcagaccctttgcatgacctcagctgcaagacattcctggctaaccaggaatgtgtaacaatcaataaaagcacttctgcaagactgctctgggttcagtcctctgaggctgtcccaccttgctgttagcaaagccttaccacatcctcgagtgtctctctttctttggtcatccacggagcttaggataccaatgatatgctgtttacctgggatcacaatttttgagtcatcgaaaatgtgcttcatcagatcatgacagcctgctttccagcagcatttgggccagtgtaagcttctgtaattccatgtccttgccaaattcttggcacatcatattttgaaattgtccccaatctgttagacttgcaacattctcacattagaatgttgatccccactgtcctgattaccagtgtggctaacgacttagatttgtgattgtttggattcctctctccaatggcttgtcccactgtttcaactctgaagtttctggcatgttctactgcattaagaagaaagcacagtagcgtgacttagttattcacttgaaaaatatgatgcggcctgctgactgcattctaattccagatgagccgtgtgccttggtcagagtcccaagtcctctctatccatgttcccatcagaattgtcagggagtttttctggaaacatgtaatgctcagagcacactgtaccacttgcatccgaaaggtcaaagatgagttcatctcagtcagtctcctatgatgagagagcgagtcttcaccacccaggttgaacagttttgattgtcctcctcatccacactctgacttctccgtggaactctctggtactctcatgatgaaagaggaacaagggagagaccccttcactgcatctatagagaggactggtgccagcattttaagcactgcttcagagatggctagctacccatccaaatgcactgccaggaagccatgaatgagcctcggaagaaacggccggccttatgctctgcccttggttcattcaggaataactgacgtttgacttcctcttataagattctgtaagactaatttgtcagtgatgggttatttctctgctggttgaaatgagccaatttaagccagattagaatatgttaaaggcaggtttattagaaagctgttcttgggtgagtttactgactccaaggaccgaggccagggaagtcaccatggggtgggggtgggggggactgagaaagagagagagaaggaagaaagaggaggaggagaacaacaataacaacaagcagcagtagcggcagcagtagcagcagctgcagcagcaagcaaatgcaggggcgggggaagcacctgagctggagagttcagggttggggccagggtatgccaggtatgctgggaaacctaaaggccagctctgctgtggttgacgtcaatcagtcagggagctgctcaattcccagcacatgccgtggtctacatgagccatccatgctgggtgggttggtaaagagcatggccatcctggctggggctttgtgaggctgggggagattatttgtgggggctatgggagagcagtgtggcgcttcatagtcacaatagagtgatagagtgctccagaatctatccactcagctactccagagccctctgccagtcacaaccatgtcacctgtggtcaatgtccgacacttgtgtcatagctggtatttatcagagagttttctgcatttgtgcatgtggtcgccatagcagccatcagtgagacactcctttagccctccagacctggactatgagtgacagaagccaaaagctcgacctacatttagtgtcaaaagtaacttactgcaggcattacttcaggaaaaggtcccacagagcccagtgacttcctgaggaacagatctcaaggaggcttttgactccaatgtgcaggacatgatgaggacccagcaccagaccctgccaccacagagatgcccgaggtcctggagagccctgaggagatggatgtagaggccctcgattctgaggacttcctgcccatgctacaagtatggccatgaggagcaaggacctgggaagccatgatattgtggtgaagcctttaggtatttgacaaggaagagaatggcactaccctgggaggcgagacccatcatgtccttttctcacggggtgaggaattcacagaaagtcgtggagacgctggcagagcataaggacagcagcacttgtattaaccatggagagttcttccatatggccccgatggctgaggatattcctaggtcctgagcccatgccatgctgagtgagatttctgtgtggctgtggaggtttcctattctcctgtcaggacacctcttccatctggtctcctttgggtgatgattgccctcaacattcaccagatgaatttgctcttgttacacccccactccaatatgtaatttcacatgaaatcaagccggaggagtttagactgggggcatctcatgtcaaggctctttatggattatctctgtactctctctgacaatgggttcttcttgtttctaggtagcaagaaacttgggtttagacaattctaaagtactatttttctgcaatagctctttttaaaaagctatcatccacaaggattaaatcacatgacttctctgaacctttcaatgggcaagaaagggctactctggttggtcagtttgaggtataaggctaaggtagtgacgtgattgtaactgacaggctctctgtaagagcatgaatgcaatgagcaatggggaattcccaaccagggaggggctggtgttagtactagcactcacgcccaaagtcagtcatgagtccacatactcttaattttactcccacatttgcacctgctccccactttgttaggaacaattgaaattgggaagtttggtgcagatcatgaaattccagtccccaacctgccaccaagctggactttactctatgaatttacccccatcttgtcatctaaccacagacaccaaaaacaaactctttattcagccagtctctcaaagagtttgctgtgaggcccctcaaggactttccctggagttatagcacagtgtgccttctatccccacagtcctggagttatagcacagtgtgccttctatccccacagtcctggagttatagcacagtgtgccttctatccccacagtcctggagttatagcacagtgtgccttctatccccacagtcctggagttatagcacagtgtgccttctatccccacagtcctggagttatagcacagtgtgtcttcctatctccacagtcctggaagtgtccatgtggattgggacccatgtactggtcctgccaacatcatggggcaggacctcttggacagcaaaggaccacaccctgcccttatattgctccgctgtagacttcagagggaagggagtcagaggtcagtatgtggtctcatctctgttcagatggccacaagcaagaacagtgtctctgcctccagaccagtgtggaaatatgtcatgagcagcaatctgggcctcacacccatgaacgatgtggggttatgggccccagtggagcgtttggtcaggagacagccggagctgttgctgctgaaccaattgttcccagatgtcaacttcagcaagcacctcgctcttcccctgcctgaaggtgcggggatttcttgaggccatggaacaatctgtaaacccgagccagtttcaatatgatggaacttcaagatgtcccctgtgcctgtatgacaaggccttaagagcctctctccccttccttgtgttttttatatcagcataatatacataaacgtgtagcaaccagaccccgtggagcctcaacagttcaaaaaaggagttgtcagaggggtcagggatggagggcaactgtagcatgaacagtcagaaaaggtttgggagtttgtcttatggccctgcaaccaagaagcaccagcctactgtccataggaagtaggtggtgttagagataaataagggacaggctctgagatgttctgtgtgagagcacaattacagacctggggtgagcggccaggtatgggggccatggaggcttgaagggaaggaggaggagaggtgctgagagggaggggaagggataccatgtagtttccatagaccactggcaactttcacaaaccttagaaggaagtgatcctgggttagtgtttcctgcgtattcttttggttatggctctcccactaatgaaaaactagaccctaatgaagcaccgattggctggccaggctcaattcagcacatcacttctttacaaccaaatgttactttgtggggggcacagagcccccatcttccctccatcaccaccctcagagactacccgccctcagaaccttgtacagtggtctcaggaaagacaccttagcttctgagaccccatgtctattttgctgtgtcaagagccttaacaggctgccttgggatggctgagagccagtggtgcacacaatttcagccagcgctcttaaatcactgagccatctaaaccctgagacttcacacttttccctgtttccgagctcgacatatcctctggagttacataggctctggctttttgaattaagactgaatttccctttgtcactttgactgaagttggaaactcccaagtctctgcagttggtatctccacagtgtctctcagtagataattcacactcagctcacgctctcctgcttgtctcggttctcactgatcccactgcccaagcctgaccttgttttcagtaacagagacactttggcatgtcctccttggatatttgatcagtgtggcccaggataacatttgacatgttgctggagatggggtaagaaaggacagaaggcagatttaaaataacctagaacatctggtaatttatcaagtttttgggggtgggggtgttggagaggctaggtcagtcccagtaatggctgaggagggaggtgagcccccatcagcttgtgcctggtggagcttgttgacttagcagctgacagggttcacccaagggaagcagttgacccgtgcttctcagtgccactgggacgaaatggcctcgccaactcataccagtggggcctggggctctgtgtccacagagaagccctgggatttacacatgcagaagtgttttgggcactgcaggcaggccccagagttgggtccctcccatgaccagagcacctcataagaaccagcacccctggaaaacatggtaacccctgcaaagaatggaaggtgctgctgttagaaactgagcaggcagagtcaacaggtcccagagacacggaagagatgagcccttcccagggactctgaggggagtggttgggggagagcggccgtggtgtgtactggcttaccttggaggctaagggaagtggtgctgaattagatagtgctgatggctgtccaattctgaggcactaagcccctaacggcacctcacatggtgggtttatggcctatgtgtgctaaaattgagaccgtagaaacttagaatacccaagatacaagatacaagttgcaaaacacatgaaactcaagaagaacgaagaccaaagtgtggacacttttgccccttcttagacttgggaacaaaacacccatggaaggagttacagagacaaagtttggagctgagatgaaaggatggaccatctagagactgccacacctggggatccatcccataatcagcctccaaatgctgacaccattgcatacgccagcaagatcttgctgaaaggaccctgatatagctgtctcttgtgaggctatgccggtgcctgtcaaacacagaagtggatgctcacagtcagctattggatggaacacagggcccccaatggaggagctagagaaagtacccaaggagctaaaggggtctgcaaccctataggtggaacaacaatatgaactaaccagtacccccggagctcgtgtctctagctgcatatgtagcagaagatggcatagtcggccatcattgggaagagagattttgcaaactttagatgcttcggtacaggggaacgccagggccaagaagtgggagtgggtaggtaggggtgtgtgggggggagggtatgggggactttttgggatagcatttgaaatgtaaatgaagaaaatacctaatttaaaaaaaaagatttaaaaagctaaaaaaaaaaaaaaaaaaaaaaaaaaccgagacagtgaaacccatgggaaagctcactgaacacttagccatagcagggttaatctgcaaagcagagcccctgtgctgacctaaacttgcagagtcttatgccctgtgttcccctcactccgcattatccctatcctgatggggactagttaacacagcttactttcataggccatccacaaagcctcagtaagaccatggatctaagggctcctaacttcagcttacagatataagtaaatcagcatctttttctggggaggagagaggtttggtgttgagaccgagtctcattagcattccttaatgcagaacagcatctacatggtaccaacaatgatgttcagttgaccagcatttaccattgctgtgaactcaagccaggaccagcttctatttgcaggcaatgtatacctgtggccacagtgagcccagggacaatccactggggaccaggctatgttactactgatcatactatatgttaaaacccccaaagggtggaagagacaaatgatcccctgttttagcaaacatgggtatgtacagttctgcaaagtgtgcatagagctgctagcctgaagccagaaggttccctccctgagttatgaaaagagggtgtggtcagctttgagctaaagtggccaagagttttctagatacccaaaaagaggataggcaggaccataaataagccttctttccatgtgatctggccctgggtggtgttcttaagcatggaaaagcctatccacagctttgttaacactttttccacctaggaagaagccaagatgtttcagagtcattctgagtaacccagagctgtctttgagaaagataactccagaaaattcagagggttaaaagacagtaaagggaatatgtcccagccactgctatcccaacaacagctgaatcttagcatgtaatgagagagaaagagacagagacacagagagagacagagagagacagagacagacagagactgcttgctggcagcggggagggaagcaggcagagaggcactgtttagaagaccttaaaggactgcagccgctgtggccaattttcctcatttcagtgatgttccagatcccttgtcttctgtgggataaactcatttagctctctcatgagtcatcttgcccacagaccatctctctggaggaacgctcgggaaaagacgcgcttcacattgcattgtatgagttggcagtggtgtgtatgcctccccagggcggcctgagatcggcttgctgtgtccacacatcaggacgcacaaggtccaagctcacctttggtgacaggagagtttcaaaagagggcagctggaatctgaagtagaggcagacatatagcccagtccgaggaccaagtctgcccaggttgtttcttaattctaatctgagctgatctggaacaggcctgcatgaggcagatcaacgggacagaagtgtgcatgggttactgggttttacataggcatggaaccctcacaacagagaaaagaaccaagaaaatgcccgaagctgaacgtgaaccccaactgcaatggtgtggaagactgtccaagttcagggctggcctgggccacacagcaatgatcctgtgtctaaagaaagaaagagaagaggcgtataggacctgggatgacggttaagagcactggctgctttcccgaggtctcagtttcagttcccagcacccacgtggttgcttacaagccacgggtaattctggttccaggggatctgagtacttttctggcccctacaggcacctgtatgcatgtgttttcttgtgtatatactcacagacacatgaacaaaaaacaaatctttctaggcatggtgatgcacacctttgactcaggagacagagatgggtatatctcttgagttttagactagcctggtctacatagcaagttctagaccaacccgagggatagtgagaacctacctcaaatttaataaataagtaaataacctttaagagagaggggatggagagagaaagcttttagaccttttgaaaagaatcaataagtttgtggaagagggatgggctagggcagtaaacgagaggcaggccccagtaggagataagcattatctacatgttactactccaggtgatgttccagatgctgacttacgcagatctacccagaatggatggcagtttctgataatgaaggtcaatttccttttgtcagcacaggggtagcatcttcctcacaagaattttatggcttgctacacataaggaaaggagcactgagatcacccaccatctctgtagctgccgctctaggacacctcctgccagaaaccatctgtttgccagtgtttgttggggccacatgtccttcaccccttcactgaagttccccgacagctggccctggtcagctggcccttccatctggaaggcttctaagtttcaccgatgtaacctctctacccagggcttatgggaagtgggcaggagaaagtagcctgcgttagaggaggttgcttggataaatgtcagcatgctaccactgaagtgagcttctccattcatgcaatagtctcttgactgttactctgactcatgtgaccagccactttattcaggtgcccctgcagagacactaagttcttgaggacagaggcactgggttctgtcctagcagtggaaaaagcaaaaagcaacccaaacaaacaaaaccccacaactttgctaccaaatggctccccactgatttcctccaaacaagtactctaaatttaccccaagagaccaccacactcacaacctcattccccactcctgtgatttcctgatggtgtcaccccacccttcactcaaggaagatcagaaccttggccttgaagcccaagatgtagaccacattgagcaagagctacagcgctgactatcaatcagacatagggcatcagccatgctggacacgcaccttaccactgggctatgcagccagctctaggagccagaattagggcatgaatctcagcagtgacgtctgagccagggaagccttgtgctgactgagtgtggagcccactcaggaatgtgagccccagctcgggtgagactgacagcatagacctggactcctgctcgtcctgcctgggctcctgggctcctgggctcctaagcccacacgaagctttttctgactcttggaactataaacggtgactctgtctggggccatcattgacacctgcccgccctgtggcacagcacctggcctgaagaaactccgtgtaggctagcagagaacattctcactgggttggacaaatgtgttacacacacacacacacacacacacacacacacaccttgagatccttagcagatcttaggaatcttttttaagcccagatgctttaccatcattgggcttctaaaggattgccattttcacttggggaagggtaatcatcttaactgagatagaaaacatacaccttagggatttcccttttaaaatgtacattcttgctgggcagtggtggtgcagcctttaatcccagctcttgggaggcagaggcaggcagacatctgagttcaaggccagcctgatctacagagtgagttccaggataaccagggctacacagagaaaccctgtctcgaaaaagaaaaaaaagtacattcttggggctcaggtatgtagctcagttggtggcgtgtttgcctagtatgtacttagtcctaggtttgacctctagtatctcatagaatcaggcatggtgggtggtgcacacctataatcccagtgctcaggagatggaggcaggggaatcatgagttcacgtttattttctatctgagataggtgagttcacctcaagaagtaaaatgatttaatctgataatttaaaatataatcactatgttgtatgttcactatcactgtttgtttagagcagtttcattgcctcccccaaaacacagcctggagcagatcaccttcttctgccctccatcatgctcccaatctggttgcattacactgagtgaccagtaactactttctgtctctctatatagatccccaatctggacgtttcatagacacggtatcccacagtaagcggtcttttctggcttctgtcttttggcatacagttttcaaggctcatcttcactggatcatgcatcggttctttttcttttttttttttctgccaaatactattccattgtgtggacaaagcacgttgtgtttcccttttcatccagtggtgggcatgtggcttgctgcccttttgaatcacgggatcagtgctgctataaatacttgtgggcaggtggctgttgcaatgccagttttcagttgtttggggtgtctgcctgggagtgagattgctaagtcacgtgatggctctctttagtaataatctttatgaacgtggcatattcaggtgtctgtagatgtagaatatgttgacattaggccagtggctcttatttctttttagacaggctatctcactgaacttagagctactttgtttggccagtaagcccctcagggcactcctgcttctacttaacagtgcacctataggtacatgccacttaaagcatctctgttcacctgtgttcttcataaaggtgtggagcctcctggaggttcaactgaatgtcaccaaatacatgaacttggacaagctagcacaaacgctgtgactagtgtctggcacctgctgatctgcattgtagcatggtgagcagggagggatgcaggtgcatgttagaccataaggaaggggcagcttcctccggtctctttccagcacacactatgcggtactgtcaccaaaggacagatgctgaaggaaaacgggtctggcaaagaggaatacaggtctgtgcttctatagacaatagttatagatgcaataaaaccattgagaggaagtggggccagcctgcatgtttctccctcaacgagaccctaatgagctagcttcatgcgtgtagagagggtggcagcctagtaaaatggaggttggcatctgtcttgggatctgctcagatgccaggccaaagtgttacatttcaaaatctcccagcagaaagggccatcccagccagccctgatggtaagtggttctcgctcagataatgaagcccaggacatagcaggaagctgctttgaagtcaggagtgactccagcttttgatgctccggcaccagatggtagttgtgagtggtgacagaccccagagagagaggcccacagccagctcaaagggcagtgtagagggagaattgttcttcagggagctgggttaccctaagtgatatcaacgactttaaattcttctcttcttggtgagaaaagccatttgagaacaacaattagaacttcatccaggcatagcagtacatacttctggtctcagctactcagcatgctgaggcaggagaatcacttaagcctagaggtttatgcccatcctggacatagagtgagacccccctctcaaagcaaacaaaaaataaagtttcaactgcacaagacaaagaaggccccacataactgccagttcagagagggcaggagatggcagtgtcccagttaatcaatcctggcttcgtggtggcttgctttagggtggtttttgagactaaaaagccaagaaagaggtcatatgagttaaccgtgccagtgagaacaccacggcgaatgtgtgtacagcagtcaagagtttgtgttaatggccccccctagaccttcagccccttgcatgtcataagactgagtcccagagcttccccgtgctgaatgggtggactggatgggtgttctttggaataggcctgtgactctgagtaaccaacctagcatgtcttaataaaagggacctgtgaccaaaacatgtcctggagagcttggatttctatacatctggagcctcatttttaaaataactcttcattttgaagatatacacacatgcacatttacacccacatgcacgtataggcacatgcacatgtacacacatgcttccagagtttctaagttaatttggctactcaaaactagtgtcctaattttgtacttgatggggctaaagtggcttcttggccttcaaaaagagtctgggttttactgccagcctgctcgacattcacacacttgcctgggctgttcctcacttttctccataaactcagaatgaaaccaaaacagtttctgtgaaacctgggatggatgaggaaggagcaacctggattttgccctgtgtccagcctatcatgtctcagatttaacccttaatttctaaatggagcatgacatgagtgtgtgtgtgtgtgtgtgtgtgtgtgtgtgtgtgtgtgtgcgcgtgtgtgtgtgtgtgtgtgnnnnnnnnnnnnnnnnnnnntttaaaataactcttcattttgaagatatacacacatgcacatttacacccacatgcacgtataggcacatgcacatgtacacacatgcttccagagtttctaagttaatttggctactcaaaactagtgtcctaattttgtacttgatggggctaaagtggcttcttggccttcaaaaagagtctgggttttactgccagcctgctcgacattcacacacttgcctgggctgttcctcacttttctccataaactcagaatgaaaccaaaacagtttctgtgaaacctgggatggatgaggaaggagcaacctggattttgccctgtgtccagcctatcatgtctcagatttaacccttaatttctaaatggagcatgacatgagtgtgtgtgtgtgtgtgtgtgtgtgtgtgtgtgtgtgtgtgtgcgtgtgtgtgtgtgtgtgtgttttcagcaaagatccttatggtaccatttagcatactaaaagtactttttctggggatcgtttcctgagacttgccctgaatttgtagatggttacagtatgtgtcataaataaaaggtagaaaacatttaagttatagaaggtttctaagtgcactgtgcactgtaactcaaaccccttcaggcaaatcccagccaaaaaacagaggccactctgctgtctgtctgatcacagagtgattgctctggggacacagggcacattcagtcaccccacctggcctccactaacagccttttatcagggcaatcctcagtcagtaagcaaaccatccaatcacaagtgagactgctcctcccctacccagacaccttgtggctggtgatggctgttaaatgagtcatttggtgcattttagccaggccactgggagctcttattcacccctttatattgagtggctttggctatccatggtttactatgttccaaaggtactacatggagaactccagccatgagaccttcctaagtcatgagcactgtggtataaccaataacatgatggtgcttagccccactccctccataagccatgaatggcccctttgtcctacacatttatggtgtatacgcaacccacccctcagtcacttagcacccagctcagttgtcacgctgcctgctacagtcagtatcagggtgctagtgtatttaaatggccccaacctgccaggttgatgaggctggcagtttcgtctcactcctttgttaagattgtctgattggctttcaattactcttatctcccccttgctgtgtctgacttacgaagtgagccttatcgtgtgtgttggcaggtagaagcagccagcattcgcagtgttccacactctctggtttcagaagtccatgggagtcttagaacacatgcgcaccccccagataagcaggggctggctgttggagaggctgatgcttatatcccaagtgttctgctaaccactttgtaaatgttaagatttgcaggccttcaactggcttatgacttaggaacagtgcaggggttggggagggtggaggatctcactccctacaccatacttccaatgtgggaaattaattcagaaattagcttactaattactagcatccagccctgagccacttcaggacaaaatacttcatttatagccacaataatgatgtaagtggccacagtacccatgtcctaagcaaatgagctatgtgcttgctgagttgatgggttttctggtgctgtgagaaggggtatcttaatttggaggaacagtaggagctctgagcatcctttttcatagctcagtggtggcttgaagatcatcatgccctttgtcccctgatatctctggcctacctcagggaagctgcacaattcagtcagtttctctcacttgccaacttgcaggtagcacttgtggtgtaagatgcacatcagggctgtccattgatgtcgaccaggaagtgcaaagcactaaagcctacttttaccagccactgccttgtgcagagcagggctttccactaaactgatggcttctgagagaatgtcctcttcaggtgacattaaggagaaaagcaggatgtagtgagccacagaattccttcagacattgcaaaagaaaaattagtagctacccattgcacgtggtcaagatacatgtgcacctatgtatgttcagtgtgtgtgtggacagaggaagacatagggtaccctcctttaccactctaatctctgtgactctcacagaacttagacagaggctggcaaccagcaaaccatagagaccctcctgtctccacacacctgctccgctccagtatacataatcccacacagactttcccatgggccctggggttcaagctcaggtccctgtgcttgcacggcggcactttcgcccacaagtccctttttgtaagacgccaaaatcccattcatgccccttggaacacaaaaggaagttcataattacctgtgagaaccacacaggtcacttcacagggaggtggcttaactttgtatgtaagcctgtgggctgtgctttggcagtcaccctgcacactatatccccattttcctgagactaccctatctgaagcacgaacagggcctccgttagtgggtcatgcttctgagcctgctgcactttgaactgaaagaccgtgaggcaagatgagggctggggccgggttgtggaagcctgggataaaggaatgggatcagtggacagctaggaggctaagggggaagatgagaaatgcaagagatgcgcctccctggggttcttgccccttctggaatgccaggtatctctctacagtgatctgacactgccctctgtcctatgcagttggttgctcagagcttcagacagtgttcgagcatgtctctaccctggatggggatttttcatggcctcccatctccaccttcgctcattgtttttctgcatttatacaaggttgctctctgctctccctctggtgccatgtctaaattatccctagattgttcatctcaagtgatacaaagcaaccttgaattgtccctggcaaacgcaaacagcagacagctcagattcctcctgctcacggaagggaagctcagttcaggagagcaggggtgccaccttttcctccagactggcctctcttgagaggcagggacatggcttcctgcaacagtagagcagtcagtatccaggaaggagtggtccatttcttcttaaaccccacatgccaggatgaggcctgtgacttagtgtatctaaagttaaggaaaaggcaaattcccagagacagatctgtggccaccagagagcactggcctgtttgaggccttgccagtgcccttttgtggtgtggggatggtgatttgccgctcagagggcgaatctgcccatcagttgagcaatgactgtgtgatttaagttttaggcccaagctgaaaaacagagaccagactatgtttgcactgtttgtacagtcagtaaggctttcctaactgttctcccttatccagacctccaggtgatctaggctatggttgcctaaatgtgacccactcccatgggtcctagtgcctgagaggtgctgggtgctctcagccagcagatagatttctagaatacctcccatttccgtgaccaccagctgaggcagttactttctaagagtccttcaggtttcctgccaaacctgggaatgccagatggacttgtcattatatagtgtaactaagtacactaagtgaaaaatgaacactggaagtcatttatatgaaacccaaattgagtttggaaagatttgatagcagcgagtgtctgaattcactgctgtctgggcccatccagagctgtgctctctggagcatattcttgaaatgggtacttgtgtcttccacagtgggcagtaagatttagctgtaattatatttagggggcatctggattctagtgagcatttatgggtcagttttagaatctaaagtctgtggtttattcctaatgtggaagtggagtggtctgcaggcacaagaggaagggcttcaccggccaaccatggcgtcgtactgaagaagggctgctgccatcaccagacttcctacactaagcgtcaggattacagtccattagacgcacaccagcagccagggatttgtgactttctgagttctgaataagacagaagtatgttttcccacatcttaattgtgaaccccagaaggagaagtaaagaaagtcttcagtatattctagaatgcagagctgctggatgctagctcagtgtccgagtcccaggcacgggagactcgcttggcagtcacataaagcagtcactcctgcccatgtgcacagccacggtagttatggctttgatgcctggtcagagacaaatgaagctccttggggagtcttctggagggttgtgtggagtaatggaaaaagcagagagaggcgcaaggcctgcctgtgtggtgcttgtgagcgctggcctgtttgaggccttgtcagtgcccttttgtggtgtggggatggtgtttcaccactcagagggctgtgctaaggacaagtgtgtgaagtttcatccatagggattaaaggtgtcccctagcttcaccatcaggaccatggcctagagcacactctattgaatttggagactcaggattctgctgtcgtcccacacagagggctttggaacaaaggggctctgttctgcacactttagtttctcaggaaaccgaagagaagctggggaattcttaggagcagggagaaactgggcagctccaggttaaattcacttctcagtagctggatgtgcttgactgtctccccagtcaaccaatgcttttgtattggtttcagttttgtttcttgcagtgtggggatcaaacctaggccttcacacacgctctgcctgggttccacctgcgagctaccacctagcctgacgggcagggcatctcttcacttcttatttgttttgtacatggatctcatcactatttaacatcatccacctacacaaatatcaataattctcaagacagcaaaagttttattttcccaccttacatgcttcaagtggtgactaacatattgattgatattttcctcccatttttgacttcttttattccaaaataatagagactttaacaagattcccttccccagtgtcacagctaaggttctgtacagtagctgagtaagagactgggcagagacaatctgtttggaaacaccaggattctttcagctggctgaagatgctcactctgcctctgatggcacagttagctgtgatgtcacaggactgatgggcagagggctgacttgctaagccagccagcagggagcatgactttcctccctgcttaccctttgaggtatggctggacagagttcataaaggcctcaggtttccatggctctaggaagatatttagcaaattatttttaaaccatttggagttggtacaaaacaccagaggattctgtagactctgagtgagttcggaggaaagtggaagctagtggggccacctgcacacccccagaggctggctccttctcagcttgccgtcatccccacttcccagaacttgctgctctagtgctcccagaagtctctcttcccctgcaccccgtgtgtgtgtgtgtgtgtgttgtgtgtgtgtatatgtgtgtgtgtgcgcgagtatgtgtgtgtatatgtgtgtgtatctgcgagtatgtgtgtgtgtatgtgtgtgtatgtgtgtgtgtgtgtgtctgcgagtgtgtgtttgtctgcgagtgtgtgtttgtctgcgagttgtgtgtgtgttgtgtgtgtgtatatgtgtgtgtgtctgcgagtgtgtgtgtgtgtgtgtgtgtgtctgtgtgtctgtgagtatgtgtgtatttgcacaggtgcctatgcatgcacttgcggaggccagggccaacatctagttgtcttgcattgctctccaccttggttttttatattttgagacctagaccactacatctaggttcttagtaggtgctagggattgaactcaatccctcatgccctccaacaagcatttacccagtgagccatctccctaacccctactgggctcttttttcattaaaattccaaaagtttccacagccacttagagttaggcactgggctgctcaagagaagtggacatctgaatgtatggcccctcagatgagctcctgtcaacattagtcttctccttgtggaaaagtagcattcttggcagtgaactacgtcgtggaaaaagctgaaccaagctcattctctggagccctgagacctgttcctcacaattcctgtggggctctaggcacacttgataggttggagatgggcaaaccattgctcacctgtgagtcatgggtggttgggaggagcttggagtcaccagaggctcaccagatgtcatcttgacctgatgtgtttagcacagtcccctgagtggatatgtgtgcttgcgatatctgtaggcagtgggctttgctctgctggtgccatgttctgtatgagtgggtagccactggtgggcatgctggagcagcgtgcagctgccttgtcttgttggactttgcattatggccttctctcatctctcagtgaatatgcttgtttacaccattaagccagacacactggtaatcgagccctgacttgttagcagagggtggcttgaaagaagatagtaagatgcagaagtgccactaacaaaatgtccttgcatatctgcttgtagggacaaatgtaaaaccacaccagaagacacactatttttagtctaccaactttagtgtgtgtatgtgtgtgtgtgtgattattgattgtgcggtctttcacagaaaagctttttttttttttttttttttactttaagacaaagtcttgctcagtggctgaggctatccttgaattaaataaaaacatccattgttggctgagtgggtgggaggatgggtgtatatatgagtgagtgggtggatgcatggatggatagacaggtacattgatgagtaggtggatacgtttgtaggtggatgcacgtttgacttggcagggaactaaagatgagagatcagggggcacttctgcactcagtgtcttatcggtaattacctcagtcatattaaagaggtctgggcccagtaatgtgtccaatgtttgttttgttttgaagaatttagaaatatgccatcctagattgtttttctgtttctataatactgcactgaccccaaaccaactcaggagaggaaagggctcatttcagtttacaggttacagtctgtcattagagagaagtcggggtagaaactgaaccagaggccatggggaatgcttactggcttgctcttcatggctttcctgacctggtttcttatacactgcaggaccacctgccctgaggtggcacacccacagtgggctgtgccctcccatgccagccattgatcaagaaaatgtctcacacagacgtataggtcagtctgatggaggcaatctctcagctaaggttcccgcttacagatgactctagtttgtgaaagctgacaaaatctagcacagatacttaatgagttactcttacaaagaattcctttagaaatcaactctccaagattattgtgctaatctaccttggttgaaaaaaatcactgactagggtttaaacaagcatgctaatgtgcttgttaatgaagctgtagttcactgggatttctagggtgaaccactactacatccaagcattcaagttgtgagtttacaacagttacaggcaagcagaacaacttgtgtccagtacaactatatttcctgtgtcttttgctccctgcaaccaaatgaagtggtacactgcacacaggtggcttaactgaccctcgtctataatggggacttccaggatatttgactggcaaattacctcaccctttgagattggcaggatagctctgtgttggagccttggaatgtcagaggaagtgatttgcatgtggcagtttgttgtgatggccgacatcttgctacctcaaggaatacatatgtgcatacgtccaggggactttaaagctgaactcctgtgagttcttacatgctgcctagagttatagcagataccatttgcaagaccatgtttcctctcaacatggttcctctgaggagcccctgatctgcagtcacaggttctgctcacccctgcaggtgctttcactctgcgcaaactataaaatccatgtgttttcagccccacctcacatggggagtgacattgtgacattagtgcctgccctttgagccctgttttcttccatacgatatagatagtaccatgggccttctagaatattcaagaaccaaactaacatcaatggactgagcatcaggtgggctgagcatcatccagtgtgctcagtatccagtgtgctcagcagccagtaggcacagcatctagggtgctcagcatccagggtgctcagcatccagggtgctcagcatccagtgtgctcagcagccagtaggcacagcatctagggtgctcagcatccagggtgctcagtagccagggtgctcagcagccgatgtgcacagcatgaggtgggttcagcatactttgttctgcagtaggcagtcataaagcatgctcttcatccaggattgctggagaaacactctatgagacagacattggtcctgcccctatctccaagactccatcctcaactcaacataggaatgggcaaatttccaaaggagagtagatagatactctttgtgaaacttagttatccagaacaaaattgttcttcccagataccattcaaatggagtttcagggccatgaagaaaagggaaatggtcagatcagggacacctacttcagggagtcccccaagtgcctgtcagagaagctactagccctacttttaagactgtagttagcaattgatgacaaaaccatagtgaccttaagacaaatacctatacctaccagtgctaggaatagaatctaggaacacacaggctaggccgttctaccactgcgctccatagtcattgccagtcagacctccttaaagtacctgaagtgccactaactaactgcatgcttcctctatccttaaaaaagccacagatttcttcaccctgggttggtgtctggactgcagtcatagtctctgtttccaaataaaagtcctttgttagagagttattggtatgttttggttgtaccttggcaacaacaaaatgtcacaaaaatgtccctgtggcagaaatgaattccttcaccctttcctaggtcaaagcaaagatagcatgttcttggagactccagctttgcctgtgtctgttgttcaccccaggctagcaggtgattattttttctctgacctcagcttatttttgtacctttatgtcacatacacatatccatcctgggtcctgacattctgggctatttcaggagtgtcacagaagcctacttggtcttgaatgtccactctgtgacaatccaaagcttcagtgggttgaattctctccagatgctcagagtcattgtgacttcccaaggactggcaggctctaaagccccactgccatgtggatctgtgggtcagctccatgtctcagcacactaaggcacagggagcaacccggggtctgcatctggcttcagctgtaggaagagttcctggtttagggtttgctttgcctcctcctaggccttgaaagaacttggaatggccaagtgttttgagcctgtggtgtttggcccttgccaaacatatcagcttgcagaaaatgtctatatttccaggagcctgtgacagccagtcccttccaccccacccccacttcagcaagggctggagctgcctgctgtcccatgaaaacacggtggtctttactcctccacccagcctttagccaagcactgcactgctcaccagacctgagagctgctaagtcattcaatgaagaattcttgctagaatatagtcaggnnnnnnnnnnnnnnnnnnnnnnnnnnnnnnnnnnnnnnnnnnnnnnnnnnnaaatggggcaagcagaaggatgtctgctgtgaggtggacggagccataactcgctgtattctcaatgatataagacaaatcaaatcctcttcccatttatttgattttggccaagtattcttgtccaaaattaaaatcagatgtttttctctttctccccccattttggcaccccctccaaccccaagcaaatggtcacaaacactcacttaatgtaatttactggagctttttcctaaagggacatttatgtttctttcttttatgcatgcagtaacttttgatcaaaacatgactccactccctcatttaacgtggagtatgtggattaaaggcctctttgaatcttaaacacagattatggctttctttccctttaagcaaaccgccataaaaccctggcccctctcccgttttcttcattaaagctctgtttattactgtgttttcggatggcagtcattaagtgattgttagcacaatgagcacttgattataattattcatctggcaatcagttattgaagcagtccggtggtgtgattcaaagggagcgtgctggtacctgccagcatcttctagatccttggccttagtgaggtggggaggaagctgatataaacacatagacagagaggctcaagctttctctgagtggatgctttcatgttgttctaatctggctcttagcctttcttgttccacaaggtaaatgaacaaaggtgataaaataagatgtaggcaagagtgtttatgctccaaactcctgaatcaataaacacatttcaggttagtagtatatttatataaaatagctatataaatgtttttatactcgttattattgttaacacagcatgggaaatttttaaatcttcatgtgcacacactagtatggcagccagtggactaccttgggcatcagtcctcacctacttgagacaggagctcttattggctgctgcataccagagattagctggcccatgagttgatgggactctcccatccctaccttccatctcacagcaaaagcactggaattatagagacttactaccacttgggctttacatgggttgtagggatccaaattcagttctcacatttgtgaggcaagggttttgtccactgatctatgtccccagcctcggcactgactttggactgttctggggatgctactaccctatagtgggtgttagtgaccagtggtactcattatacagaccagtgtgctcctgccacaagcagaggccctacttaactcagacccttctagtcgtgacacattttaaccaacctgagcaaaatatctttgcttatggaaatgtcatatgttgaatctgctcatggattaaaagagcagcaggaaaccagggctccaggatctttacttggttctctgtggatctcagctgagcctctatgtgtggggcttcattctgaagagagtcacctagccttttttccatggcagaggatttaaccatccgcagtcataggttgcttggtggagagcagcagactctaccttctattcatcaatgtccagaagctagggatgtaactccatggtagagaactcgcctggcttacataaggcccgaggttcaatcccctggtacttctaaaaggaggaagggagggaagaacaagaaaataagagaagggaaaagtcagaaaggacctagattggccccatccagttgcatatctacttcttgattaatcccatgtccatggaaacagtatatgcgatggatccagactggaccacatgttattcttgtgggtagggcatggaagatggagtcctggggttggcaggcccattagttagaaacactgatttcttcctgtaagtggtatcccagtgactgagaaaagtctgtgattgttagtaaaatagaaattaacctgaaaatgtcaacctgtaatccccaaaattctctagatgtattccaaagcaaattttgacatttcacttagaaacattccaccttgttaaacccaagtttaaaagcaaagaagttcccacatgcatttcaaatgatgctcttgtctcatctgaattggtccccaatccccaagtccctctctatggtctagggagaggatcacaaagagacaaaccaagaggagttagagatgtgtcctaccctggctttggtgtcatagctgtgctagcactgcgccatgtggaatttggggttctaggaagtgctgtctacaaccacctcaacacttgggatgacttctaagagtctgaatgacaacattctgactcttggtttgcttcctcctttgaagctgtggctacaaaggcaaaacgcctgtaaaagactttttaagagtaagaggcttgaaagaacggaacagcaactgaaagtcacacacactccaaacatgatttaaccagtcttgcttacaaggagtatatgaagtgccctatttactgggctaataaggaagacagttgcaatacaagctcaggcttgaataaaaatagtcattctcaatttcccatttctcttattaatgcatgtttattattcactaagtatttaatgtgtacagctgagctgtctaagctccaggtaactcgagtgactaatagacctccaagctgaacacacagggcgcagccagcatctcctcatgtgtggatatttgcacacacacaggctctttttgaatttgtggattttggctatggcccgagaagtttcttgggaatctaatcttctcaatggcaagctccagcgttgcccttgccaggagtttagttcatgtagacctggtgccaattttcttttcacatatgtgaagtaacagtttggcacccagcaaacacaccaacgcctcagcaaagactggagtttttcagaaagcaaagtgaacatatttggaactaattctcttcaggtaaactgggttggaattaaatgttgttagagattgctgtgtctgtgcaattgtagatgtcaaaggtcacagcaataaagtatttttgttttatagagttgtccttggaaaggccacagaccatatgacagcagagtgcccagtgccagcctcaaatccaaattccataaagttccatctgaagcccagcaggccaccaggccccacttctgaagcagggcgccccacttcctggggccagctagctcagcctgctttcccagcccaaagtgatgcatgtccccaaaacagggagggtaaacttcagccagccctggtagacagttcaaaagctgaagacaccaacactggcgttttggcaagtgaaagccacaggagatccaccccgttgtcaccattctgcttgcccgtgcttgtgcatgagtgtgtgtggggtgtgtgtatgtgtgtgtgtgtctgattttccttgttatttttaaaagctcagttcctctcacatagatcactttcatgtcaccatcaacagcaggactatatatccttccaaatgacaaaatactgaagtgaaggaaggcacttgcccaagattttgaggattttgtgtgccctagaattcatcgaatgactttgttattattattatttgatatttactttatttacatttctctctctctctctttctttctttctttttttttttttgtttttttgtttttttgttttttgtttttcgagacagggtttctttgtgtagccctagctgtcctgaaactcactctgtagaccaagctggcctcgaactcagaaatcagctttcctctgcctcccaagtgctgggactaaaggcatgccactgcccggcctatttacatttcaaatgtcccctttcctagtttcccttctgaaaaccccctatcccttcccctgtccccctgcttaccaacccacctacatctgcttcctggccctggaattcccctacactggggcataaagccttcacaggaccaaggccctctgctcccattgatgaccaaataggccatcctctgctacatatccagctagagccatgagtcccaccatgtgtattctttggttggtgatttagtccctggtagctctggggttactggttagttcatattgttgttcctcctatgaagcggttaaccccgtcagttccttgagtcctttctctagctccttcattggagaccctgtgctcagtccaatggtaggctgcgaggatccacctctgtgtttgtcaggcactggcagaacctctccagagacagctaaaacaggcttctgtcagtaagcacttgttggcatctacaaatgggatcaaatgacttcttattcgtggttccccatatctcctaaagatgctgggaagtcctttgtcttctctccaaaccagaactgcgtgtagtggacctgagaaagccttgcttacccaagccaccttagtagatttctatcccaaggtcactgtcaggtccacagctctgccaaggacagctttccatggtggagaattgtgtcgaggacaggagggccttatgcacttgagagctcagctagcagctgaacactgactgactggcctctcccccccattcctctccccacccctgaggcatcagacccagctaccacctgctaacatgtctgaagaaagcaagaggcctcggtcatagcagatgattggagttgatgccaaaactgcaaacaagccataaattacactgttctcacagtgcagccactgctcgttagttatgggggaaacggactccctttaatctgttttatttatggtagatgagagttgatcttttttcttcttggcaatgctgtcatcttgtataattataagatcaggttttctcactgagtatttttgaccggttcttggagttctctgtacaaagccctatgctatctactattggagacagaagtcttgtactcagcaggtggggactgacagctgaggaagagaaaattctggagggggatggtgttacacgggcacagcactgtgaatgttttttaatgacacaaaactgtgcacttaaaaaataacttaaatgtcatgtatgcatcacacagtggtatattttaccatagtggaaaaaaaatccttctactttttttatgtcagagttcatcatgtattgctatacttacgttttattttgtgtatgttttgcctctgtgtgtgtgtgtgtgtgtgagtgtgtgtgtgtgtgtgtgtgtgtgtgtgtgtgtgtgtgtgaaaacaccatgtgcatgcagtgctcaaacaggccaccagagggcatgggatatcctggaacccattatagacactcatgggggcaggtcctctggaagagcagtcagagctcttaaccaccaagccatctctcctgctgtatatttgctgtgcattttaggttttatgtatgtctcttaggaaaatggaagcttgcatggctagcacaggatttggaactcgggggtttcctggcttcgtaacaggttttcactttagatttctcctattatcatggtcttaagttgcaagtgatggcaatttgcagcacaaggaaaggcagaatgtccagtcctgctttccacagtgccagacttggccagagctttggtgagctgagcatgccatctgtgagaaccagcccagcctggtggtcagtaagagctgagcccctggacctggcggtctgcctatgcctctgaacatgagttccaccatcctcgcaagctgtagcatctttgtctgtggaaatgaggacactactttcagaatgatcagacctcagtccatgaccctacactgagaactccataggtagtaagtccctgtcaccttccttgcctctaagccttttctcacaacagactgcatggtaggatagctgctgatcccttcctcctgagcatctcatcacacacacacacacacacacacacacacacacacaaaaaccttcctattcttagtgatctgggctctgcctatctttgagctgggtggatatgttgatgctagggcaatggagaagggagcaggtcctggtaccctgcctgccaggacagctatgcagacagcctgctctatgcctctgctgttgcctaaaggccccactgtctcatccccaccctccaggttctcgaggactggaatgtcttcctctgacctcttgccccttagtctagagcccccaagaagaaagacactaaacacagacctaggtcttttcccccatagccagcttttcttacagtggtatgagagcaaccatctggggcctggcatccttatatcgctgtgcctccctccagcccaaagggacagtcagaccatctttaggcctccccgagagctggaactgagggtggaggctgagcagagaacttgggttggtaaaattaccttgaatccctaagctgacagcatttcggtcccttactgaatgctaggaaactgaaatccaccccactaggcttcagtcttatgggaggagctggtgcccaggcttatcgggactgttcaagccttctcttgaacctttgggagactttacacttgtaagtgcttgaacatgagaatctgaactgcacagctactgaattgtacctgtacatctgtgtcactagtgccccagcaagatgtggaacaggctccatccagtctctctcaaacctccttctagtctgtacccccaaatctccacccttctaacttgtatcttacccaggtacaaagtacttgtaaaatctttcccttccgtgcccagcccaaagtcacacctcatctaagtaatggtatttaggaactaaaacttggacttggggtataggtcagaggtaaaatacttgcctggtgcatgtaaggccctgggatcaaattctaacaccaggagaaatataaagagcagcagcaacaccccaaagcacaaacccaaagccagttagtggctagcatgacaaaaccacagggctgaatgcagacgttttctttttccctccccgccccacactcagtgtgtcagtttctccttctgctcctgagccaggtcataaggatgccatctcagaacctagaggagcagcaggcaccgggcacttgggtcctgtttccagctgtgccagcctcacagtcgagggtctccccaccgggaacagggatatttgcttttctaaagcctagcatgtccggtgagccccagcaccggccagccctgcctgcctttgtcggatggagttaaaaggcttttgaggccctcactgtccttcccccagccccccaccctggcttgcacagccccgctcaagtccttttatctagtcaaggtattcagtctgtttacctggcgctagagataactacaaggaactattaggttgacataggagacaaacaggaaatcagaggatttacagatgttatctctttgacacagagggtcttttacaccccatcaggacagatgctatgatagtactgaggaaacacactgtatatgcagttattcctggactttgcaggtttgcagagctctgagggctagagagaggagatggggagaaaagtgaacacaagaaagagctgagacagatttcctcatttaccataaagatacacactctttgttacagggtagagttttattcaataattctgcataggattcattatatgcatattattgcataaggcgtaatctatgccctgctaggaagcagatatgccaaaaaggttaagttctcaaaactgtctttttaacacatttctactcctgctatagatgggaaatctagaggagcagcaggcactgggcacttgggtcctgtttccaggtgtgccagcctcctaacatgtccagtgagtgcccccaacacaccggtcctgactgcctttgtcaaagttaggggcccttttgaggacagggacacaatgaattgagaaaatgtgggtagaagggaagaaggctgggggagcaggcaggatgggggtggaaaatagtcaaagcaaaatgaggaggccagcagagggggacccctgagcaggaagtctcttcagaagtctcaacacctgaaccccaatgccggccactaacagtgccagccactatctgtccttgctgacaagcagagagtcaaggcagaccaagcttcacagttagttctgctgcctggacaatttcaggggggggggggagggagggagggacagagagagacagagacaaggagggacagagagagacagagacagagacagaaagagagagacaaagagagagctcttcagaagatacacagcaaggaggatgcctgcttatcttcccgccccgtctgcggtttcccatttctcctgacgcccctctaaactccagcttgacgtcatcatggctggtggccgcagctcccacggtgcgagtgccaattttcctttctgctcacacgtggctctgggatgctctgctaagctctagccacctgcacaccgcatttgcttttctttaactttccatgttatctgctttttttctcttacctcactgccaactaaggttctctctgtgttaattaacggtgggtggtggccagtcctcttgcctctaggcctcaccccacctcaccccacaaagtagctttgctagtgcacacattcatttccaggtgtttcccacgcaacagccctcagtgaagtcaccttgggacgggccctatcccctccccacagacaggaactttaggcaggagagcaagttcctgagtacccagcagctctatcataaggatcagctcttgggatgatgacagcattgctctcctctctttaaaaaggagtcacaaagaaagggtttggccctggcgaggccaagtcaaacaggatgcatcctgctctctaccgctgtgcagggagtagccgctctgtcctgtcagcctcccctctagccacctctgggtcacttcctctttctgaatagctccctgacctgctggaagggtgggcagtggagattgtgtttccatgaactcaccgaggaaaaggatcctgcaagtttctcagggacagaatgaaggccgttcttctccctgcaaaggaaaccaggtccagcccacctgccagagcagtagccctactcgggatgactggctttgaggctgtctcagggtcttttttaccctgggcttccctgaggctgtctaggtccctaaggctctgtgtcctcactagactggtactgctcagaataccatggggcctgtcatcagagagcccatgagctcagtggtagcacctgcctagcgtgtggtgtgcaggattccaagctgaaccccagaaccacacaagaaatgcagcatagccgggcggtagtggcgcacgcctttaatcccagcacttgggaggcagagctggcaggcagatttctgagttccaggacagccaggactacacaaagaaaccctgtctcaaaaaaaaccaaaaagagaaaaaagaaaaaaactgcagcatagggttggggatttagctcagtggtagaacgcttgcctagcaggtacagagccctgggatcagacctcagctctgggggaaaaaaatattaaataacaaagaaatacagcataaataaacatgctggaaaacatatgcatggctctgtcaaaccccgtggctcacagtcctatcacaatggagagccccaaatcctagctcatttaagctcaagcccagtttaagtaaagaatcacgaatgtgtcacaagctcgtgaatacctgagaggggtggagagatagccaccaagcctgagaacctgagttcagcatccaggacaaccccccatccagacatccctccatccccccccccccccccaccgcagtgaaaggagagaacagactcctgcaaattgtcctctgacctccacacgtgcactgtggcgtgcttactccctgcacataaaataaataaatacaatagaaaataaaataaccacatatgtggagtgtggcacctccatcatcccagccacttgtaaacggacacaggaaaattgcttgaggccaagcgttcaagaccagcctgggcagcatagacactacttcagtcagccagtaagcatgttgtaggactttgctaatgtcatttattataaagctccactctgtatttcctatgttgatcaagctgcagacatgcccactctactgacttccctgcgtctcctggcttcggcccatcatgtgggtgttttcagacccttgaggtgaagtgggttacaccccggttgttgtctgtcactgtcgagaggcagcactggtacaccaggctgactgcagtttcagtaacgctgtgccagtattcctggctgttgtgtagtcactgatattttagtgagcattgcttacaggagcccagattatggtagctttgtaatagagagccctttgttgatataaatgaaaaatgttggcatgaagcatcaaaaccacaatttggcttcgcttatcagtgcacacaaagctttgacctaacaccccaggtgggcgtgaagcctccttggagaccgagcccctctctgcctctcaggaaatggggccctccttttaagagggaagaagtttagccagatccagcttggaggcctggctgggaatcaacccagctatcctggctccatccagccctttctccttcctgctcctcacccccacgtccccacatgctttgctgcaatccaggatctgcggtctccatgcagacagtgcacacagcatttgcagtgtgcctaactttgaattctaacatggggatttccccggagtagctgagcgatgccattcctgtcctgaggggtctgtcaaggcagcttacacatcactataccctatggtattcctgttgatggaggggtgcttgtaccattcaggcctttgctgtgtagagttgtgttgttagacaatggaattcacaggctctaaccatccacccgctgctaccttctcttcttatccctccagctcctgagacagctcttcctccagtggtgatttttcttattagtccatactgctgaacaaacaccttatatggcctcagattaaagatcccaacccttctctgccactcatcagtgtgttcctagggaacaggggtctccctagagtctcagggatcattccacagaacctgggaagtcccttttgcaatagttaggcctgaactatttgcttaatacatggaggtatcccaacaaattattagtcatttgaaaaactactgcttttttacaaaagtaactgtgaacattttctatgggtaaccatttttttgcttgagtactgagtttagttgctgagtgttcctgttgggcctctcagggtctgtaggagatttggcctgtagttcatgggcctttgggggacaatcaaggcctgggtgaccactcccaatatcagctataccttcacttgacatatcctaatgctaaaggctgccacatttataatagaagaagttatatgaaggctactagaaccagacacagatacacttgccaaagagcttccagctcccacgtgaggaagacgtcacgtaactgggaccactggattcatgtccaggttttaacagacaaggagcagagagaggaggaagcttgcagccttgcaaggttttgcctgttggaggtgatcagcagcaggatacacacataaaagatggcaagagatgcagctagcaatgtggatgcgttgggctcagctggggatcatctcacacggacttgaagccatgaagtgaggagtcacagggtaatgctatgcagaagggctgttagaaaaaatggctttggtgtccaggaaagacatggtctagaaaagaagggcgaggaagggtcagaggggccctgctctgtcggtggaagcacaggcagcccttccatttctcctcattctgtcggcctaagagcagacagagagttaataccgagccttcacatccacacctaacaagttgtacttgagaacaggaaaagcttaggtctggactgggggatgttgattttggcacatgctctacccaggagaggaggggactcctttgcatctccaccctaccccacccctgccacatccagcctctgtaccacaagtcctatgcaaactgcttgatctttccagagagtgaccctgccatcttaacccacaggactccgtccaaacgcggctcccgtacaggttctgctgactcctgccagacctgtcccttggagcatcccccatttgtccccatggaaggagccattttcattcttcatccctttgagtgctttggttctgctgtggggaagctgccaggtctgtgaagtggtcctgtgttcaacatgaagtggcagcagttccctggagtgattctgcttctgttggctgttcattggttgttcagttcatgcagctgaggaaatggggcagaacaatcgtgataccctcggttgtgtgcttgctgtggacactggcctgcccttgtagaggacagtggccgaggcatgctgaatgagagacaattcccacttatcagctgctcggcccagttctatctgcaggcttccaggtcagactcctgatactggaggcccaggcacttagctctgtcagggtccctgcagacggcatatgtggtttaagaaataggactgtggcaggctctttgcgtcacacctttcagttcccacaggctgcaaaccagtaacctggtggttatgcagcaggcaagccgatggttctaactgccatccactcctttctgttgtggaattgcagccagaggaactgacactgtcccctaaatgtagtcagcaagattcttagggtaaatgtctgtttgcagatctaaattcatttttaaaaggttatttttattttattttattttattttatgggcatgagcattttgcatacatgtatatttgtgcaccacatgtgctcagtgcccatgaaggccaaaagagggcatcagatcccctggaactggagttataaacagttatgaggttccatgtgggtgctgtgaactaaaccggggtcctctgcaaaagcacagagagctcttaacctctgagccatctctccagtccccaagtgtgttttttaatgacagacatcaatcctgggctgggcatataggtcagggatagagcgcttgcctggtgtgtgtaggcctgaggaaaagaaggaagaaatattagtgcactttgggaagagggaggaaaagggagggagagacagggaagctagtcagctttcatctctgtgacagaaacaatgcatgggatgaagggtttgctctggctaccggcgtcaagggttctgtccagagttggttggccccatgcagttgggtagtagtggccatgggatggcatggctgaggtgagctgttccttccatggccaaccaggaaacagagaatgagaaaggaagtggccgaggataacctacccgaggacataccgccgtgacagctcagcccacctcccaaagttttcacaacctctcaaaatagtgcccccagcaggagaccgtgcactcagaacacagcctgtgtgggtgctgcaatttcacactgtaacgtagagggaacaggaaggaaattttttctcaaccaaagagtcatgccagaacgacatagaattagatcagtcaggccagaagaaaaaacaaaatgcaaataccagtgttggaaaggaagaagagaaacttcctatccattgtttgtctatgtagaaaaccctagtgatccacaagagaaatactagcgtaagtgaatggatttgttgagctcccaggatgcaagatcgatccttaaacatcaactttttgtttgtttgtttttgttttttttgttttttcgagacagggtttctctgtgtagccctggctgtcctggaactcactctgtagagcaggctggcctcgaacttagaaatccacctgcctctgcctcccaagtgctgggattaaaggcatgcgccaccacacctggctagacttatatttattacagtagttttaggcctcagactactcttgtttccagctagctcctataacttattaacccatatatattaacctgtgttctaccacatggctcattaactaatgagcctctcctgccctgacctgcttcttcctctgcatctggctagcgaattctcctgcacctgacccttctttcccagagttgtgtctctcctgggaagtcttgcctaccccctcctgcctcactataggccattggcttttcattaaaagtcaatcagagggtgagagagggaatatttacaaaattcccaggtaggagatcatcccataaaaataacaatacaaaagttcaatctgcacacagaaatcagcatttgaataatgcaaagacgatctttacacagtgatagtcattcactctctctctctccccctcgctctctatatatgtatgtatgtatatatatatagatgtgtgtgtgtgtgtgtattcatcatcagttgaagtataacaaaatgtatttaaaatgatggatgctaaggagatgacttagaagctgagggtccccagaactcctatgatgggttacaaccatctataaccccaattctagccaatgcagtgccctcttttgcctatgtacatagcgcacatacattcatgcaagcaaaccactcacacacaagtaaatacgtctaaaatggcatcatgtctgaggtttgttttaaaacacccctgtgtcctttttgaaaatgaagacgtacacaaggagatgagacttaggatgggggtagtcactgagttcatgaaggtttgttgggccctcctgtcagttttgtgtgtttgaagttttccatagggaatgaggtgaaatggacctggtgtctgaatctttccagcctgctccaggagtgggattggccgtccttgtctcctgagagcacgtgggctctcatatgtgctaagtgccccatcataggggataaacacgtcttcttgcttcatttgcatttcaggtgctttgaaccacagacatatatttttcaaagcctccgccttttcttcatctcttcttccgagctggtctgcgtttgcaatgccgcattgaggaatactgtgactgtcatctcttcaatcatttctgtctttttttttttcccccagaaaaaaaaaaatgaacacctgagctacagatttgatccctgggcttatttgattaagaaacacatagctgtgttcatagctatgaatatccatccttctcagggcagaagctttgtctgtggtacctacctatcctaagaataaatccaatagaagcccagcaggcagctttggagcaaattacttgagttaatacctctgttttctaccataagatggggctataggcagacctgtaggacggttttcttagtgattgatgagggagggcccatcccaaccctgggctaaaggtctgagttctttctttaagaaagcaggggctggtgaaatggctcagtgggtaagagcacccgactgctcttccaaaggtccggagttcaaatcccagcaaccacatggtggctcacaaccatcttgtaacgagatctgactccctcttctggagtgtctgaagacagctacaatgtacttacatataatcaataaataaatctttagaaaaaaaaaaaagaaagaaagcaggctgagcaagctatgagagcaagccagtaagcagcactcctccatggcctctgcatcagctctgcctcgaggttcctgtcctgcttgagttcctgccctcactgcttctgatgataaactgttacatgggactgcaagtgaaataaaacctttcttccccaacttgcttcccctcatggtgtttcatcacagcaatagtcgcactaactgagacaactcccatctttagcattctctggactcttgtatccacacactgatcagccattcagcttttggcacttggttactccttggacaccttctagatccattctcaacctgactctgtctgcagtgaactaatctccctcatgacctacctgactttccttccagctaagaatgccggtctatgtgtgttgataagaagtggaaaccaagggtgccaaatcccttcacatttgtctacttttattctcagctttttgtttcagatcaatgatcctgtacgtgtgttattgagacattgttctgttgagctgactccttttctcatcttgagaacattctagctaactgttactgtacagcttaccttcgcatttacctatactaatacaaagcttgtatctaaatcatgtactttcagttgtctttgtccttatatatttttaattattacatttttacttattaattgtacttgtcgatggatttacaggcctctcctaatgtacctgtggaagtcagagggtatctgagggaaggaattagtgtacctgggaattgaacttggatctcttggaagaacccagcacttcctgatgtcttttacgtatccccttctttctacaaccaggagttacttgaggagccctgggaaatgtccatgcaggttgctagttctccccttggccttcatctgtctctgcttcactgtctgcaaacaccagacccatggccacatccaactttagcttctgcctcaccctgtcccaagactctggtctctgcttgagttcctttgctggtttcttacagagcctgatcatgttattctgcttatttgtccagtttgtctttttgctagcatgaagtctgcctgtgtccaccatattatgctcagaattttgctattttcgtatccatgtttcctttaaacattcatttcttttacttaattttttttattgattattgtgtgtgtgtgaatttcacatcatatatcccaatcccactcatctccccttccctttgtgcctgccctccacccttgcaaccaccctcccaaagtgggggggggggttaatctcattgtggaagctgtattggaagcctcagtgtgtcccacagtataccttttgtcccacagtatacatgtctttacttgcaaatgctcattgtgatgagtccttgatgtggttccaggcctatcaatactggatcctcatcaggactcctctccagtaccctgttgttgccttgtgtgatggagagcctgcagctttggatctataggattggccccttcacaggccccagcagtccatttgtaatggcactttcaggatagtctttctccagcagggtgcctcggttaccttcagcttaggtagaaacagctccctttggcagcccctagtggctgctcagccttgcccctcagtctttgggagatggctcttttgaattcacttggtcctgtgtagagcccatccctgcctcttcttgtattcagcctcatcaggtgccctggctgacagtgtgctaagatgacgaagctgcagtcactcagccctctgagacagcttctgtccctttagttttagtagcagcaatggcctgaggcagtaacggggccacagtggcaacggaggagagatggaatccaaggtgcagaaaagatacattgagatgtcatagtcctccctctgggagattcctggagtagctcagagcacagggctactgggtacaggaaggcacagacaggttggccatacagaaaagacaccacaaaatggtgggtcaagtttctaactagggtaggcatctttgaggactgggaaactgttaatcccaaataataagtaaagaaataaactaatgttaaagaatgaacaagcacactcgttttccttttgatcctttctaacactttctaaaaatggcaaaaaagaaaagattcaattttcagaggtcaagaaagtagcttagttggtagagagctgatcaggtggagcgtgcagcaggccttcatcttagaaatccagatgtgatggcgcacacctgtaatcttagcactgtggaggtggaggcaggaggatgaggagtccacgatcaccctaagccaagtttaagcctagccttagcaaaagaccttgtcttcaaaacaaatgattaaaacacaagactttcacagagagtgtgatcgccatgatcaaagtgcatatcctcaaagaataaattcaaatgttatatttaaaaacaccctcaaggacaatgagagtgtgatcttaaaagaccagagaaagttaatggctaaacagcctgtaaagctgaggtccctaaacacatgggagtcggacatccctgcctcagaaggtagaaagttgataggcccaagacaagagacagctgaaagcacaaagatgctcttagagcagccacctctgctgtgtacttggacagctgccccactccactgcaggaaggcagtgagtgctttttctgatgagtttgaatgggctcactgggctgcaacaggttagtcagcatcgaaagcaaaggagagaaccttgctttcaaaaacattggattaagtgggtgtttgcatcccagatgccaaggttttagagcccttcccataacacatcctgcagcaaccacttggttattgaacttaaaacacatccagcaaagaggtggaatgtccttctccagggaatttgaccactttcagacagccgatatcaggggctcttatgtcatggttcagccagatgagcccacagcaaagtcaaagtggaccttcagttcttctccctaagtatgaaaagaactcaagctgccagccaggtagtatagcgagtcactgaagcaggaactgtgtgtgcatggacatgagcaaagttctgctcactgtatcttctcagctgcgtgaaagaaacatttgtgaagccagaacaagctactatgaaaaggaatattccaatagctaaaaaagctctcagaaattaataatgtaatacacttaaaactgggtactgtaccagagaataacatttaatatgtctttctgatactaaagccaaggacaaagaaatgggaaattgcagagagaagtgaattcattaatcaaggtaggaattatacatctaaataataaagttggcaaaaaaaaaaactgatcagcatgacaacaaagacaaacctggggtgacagtggtgacagtgctccaaggcaccagagagttggaggtagggcagcttgttccaagaaggctgttggttttggtttgtttttttttaaggtatatttatctttatttggtgtatatgaatgtttgcctgcatgtatttatgagtaccatgtgtgtgcccggtgtctgaggaagccagaagaaggcattagggcattagttacaaatagttgtaagcctccatgtgggtgctgggaaccaatctggatccaagcttgcaggtggttgaaagctactcagtgtagatgctcagaacctagctcagtgtgttctcttaactgccgagccatctctgcagccttccaggaagattcttgttaagatgctgggcgtgcaagttctgaatacctgatatatctatatatgtctgcaggagactaagacagctgacagaaagtttggaaataagcgatccttaaaagcccagaaataagccgggaggtggagtggtatatgactttaatctcagcgctttggagggagaggcaggcagcttggtctacagagtgagttctaggacagctagggatacaaagagaaaccctgtcttgaaaaccaaaggggggggggggaagagcccagaaatgaagcaaaatgataaccaataaaagagttattggttctggggaaacaaatatggtacaagaaagaaaaaaataatcttgggggctaggggaacctcagtcatggatcccttgttgagattgtgcaaaggtctaggttctgtcctttgttgccaatcaatcaatcaatcaataaatagtcctggtatgatagggctcacctagacacagcaattagacagtcataataatgtcaaggcaggagatttactgaagagcaattattaagttggcagagtaggaagatgagaagataagattttgcaatcccggggttgcatagaaatgcaggagcgttaaatcctcaccaaacgcaaaggactatgatacaatatctaaagtcaagacagtggctcatgctattgtgacacggggagatttaaggatgaagtgggggaccctatgaagagtggaagttgggagaccagccttgtgatcacactgctttaatcaaatgaggcattctttcagagaccaagtgggaggagagaatgtaaggatggaaggcctgtgctttaaaaaaataaataaagtcagctgagcctggttctgtgggctgtggagggaagggtgaggtctcagccagctgagaccagaatggagctggatgttgctggaccctaaggcagtttgggatgcaggtgtgatacctaaccaggtactggcttgcctccctttgggccccatgttgttaatgaggacttggaccttctgtgatttaaagctttgaccttttacaccgcttggttattctaaatttcatcctttgaactggcttcatagagaaaaatgggctgtcattgacgcgaccctcacagtcaaatttgcaaaagaacgtgtctctccctgtgcttacctcggactcgcaaagccttaaccaccattcccagccttcgaagagggaactttgcctaaaattaggaaatctgggtgtctgggagacacaaaacctctagggtcaagcataaaagacttgctaaatatgtgttctagaggcaacagtgtggcaaagggctattcacagcttttctgctgcctggtcccctctgctagatttgatactgttgaatcctggctgaacccctttggaaacttcattaaagtcgcctaacccttttgagagtaagatagggagccatcctaatcccaggtggagttgttagggttaggtaaggatggcatacactaggtaagggtttgtcaatggaaaattcctcagcaactcttggttacagttagtgaggtttgaggtggtggccttgtctcatcttgtcctgtcctgtgggaggaacttatgaattcaactatgtagttgagactggccttgaactcacaatcctcctgcttctgctttctgactgctgagattgcaggcatggccaccacactggacccaatgagggagctttttaacgagctcatctctgcagatatgccttcttttcactatttttgttataagtgagactacctaggctctcacatgatagcaaagactcctaaacagctactctggaaatgtgcttctctgtttctaccttgtagtgcagtctggagcagcaccctccaccatggtgaccattaagtaccaactgatattcacacaaatgggttgaaaagaaaatgtcatcttctccatgctcctagaagcatttagagagctgttagcacttggctagcagcagccttattgaacagtacagtagggcccctgagccatcaaagaaagtctaaaggcacagtgggaacctgatgctgtggctcagaaaggcagtcagcctggagcaccattgctgtggcagttccctggtaaagattcataatgtgtttggtttcgtggcttcctttgacagtgagatgtagccagcagggtcacttcacctgattagtgtttttaaagtgcaagataaaaatgcatacagttataaaggaaactgattaggttaaaccttaatggtcaacatattaaaaataaaacaacaacgagaacacaaaacaaaaacaactttgtgacctgtctgttctcaataatgcactagtgatccagtgacatccacatgctcctgtgatttcaaatttgtgatgagtatttataatatttcagggtaatttgtggcaaatgtcataggcccagtgtcatttctgttggcagcagagccataggtactacctatactactgtgctctgttcctataaatttctgacagaggttagtaaaaatagtttgtttgtgtcccccgcccccagccaaacatacaaacaaatggattctatttatgaaccagcccgatggaagtactggggcctcaatggtaagaagccttgttgagggttatcacactgtacaagctagctcatactttggagaaagggaaaaaggaactagaggggaaggaaataggcttacacctcattggccaacaggagtcatgtgatcacattagagcacacagccttctgagaaatgtagtccttagttagacagccctgtacctgactgatggaaaaatgaggactttctattagtcaggaaaatactaataagataaagagcggtctgggccacagcttggtttatcactatagaatcaaaacaaaaaactgttcttttcaaaacctgctgctggtagtgtagagtttaaagtctgaggcaggggggtagcagaaggaagttttgtcccttaccgatgtgcacaacccctcagtggccccagagcctgagacatgcagtgtctaagccacatgtagcatctaacagtccccagttctgtatctattcctgcagtcgttggtgttgttattagcatagggcctgagaaggggtggcttttccaaaggctgttacctttccagggggctttaaataccttcacactccttatttgattaaagctgtcaggctgcttcttcaatttcttcctcccaagttagttaacacagctccacgcagccacggcctgcagcttacaaatgacttgtctgaatggcagtcgtgcaggccagcctggttggcttctgctggcagaagggaaacagagctgtagaagaccagatatcccttaaaggtccactggtgccctgtacataggcaaaaaaatccaggcagattttttttccagatataacttgagtgttatgtttttatctttgaagcaccagagtagcacaacccaaagaagcaaaccccaaagtcctccaggccctccccaccaataatcataatcatgtctactgataactaatctctgtagcgtagcattcataatggcctttcaagtatgtcacctttggacatttgctcaattaagggtgattttcatcgagtctctgggtcgcagttgttgagtgttttgtgatttttttttgccaccctcccccagcccatgtctacttttaaaatgtgattcactaggaaaatatgattctattaattgagctcattgaagagccaatttttggggaacgcgtgtatctctgtaaagtgagagccccgtggaaatcacccgtgttctagcattcacattttccctgactcagtggctccagtgccctttccgagtctcccatcaatcaaaagtaatcccatacagtgaagatctccagggtctgtgactcagcccagaatcctgatagggccctccgcctgagatatgaataggatctgcagatggctatatttataggcaaagctttctaagttgatttctttgaatccagaaaggcttcttctctcaggctgccactgttttccttcaccacagagtgagacctttttttgtgtgtggctggcctatctctctccccctcctccagccagctggtaactatgggagccagaaagaagttatgtgcttgacagagttgcctgaaatcctatatctttgccccttttcaggatcatctttctctcatcctgcccagaatgtcaccaaccccgcccaataggccacaggaactcaggggcggctgcttgtctaaaatagatacccctcagctcacaagatcagccaccccccattcagaatagacttcgcattttataaaattgcttcattgtctgaccccaccccaagcatcaaagccacaacaagccccaacgccgccctgctcctcaacaaataaacaccacagacaccttcacatgacagagtaactgctgtggaaccaaactgcctgggcagatgctgaccctggtagaactctctagaagcctccctgcttccttggtccccaattaaggatgcttcactctacccccacccctcaggctgtctcagtcccctgcaaggctcttcccccactccctcctctatgtactagttatccatctacagaggctacacagaaggcccacccttcctttgcaaacttcccaggtttttctgctgaaaacagcacattctcacaggcaacactggctgattctgcgctttgtgtgtgtgtgtgtgtgtgtgtgtgtgtgtgtgtgtctgaccttgttgttcttggcaatcaaacttgtaggcttaggggtagagttgatagcttaaagtgtaaatgtttgtgttggtcagtgtatgctgtttgcagcattgcccagctcccttaggtaattgcccaatatctgtgccttcactcaggttgtggaataactccctcactttacagttgcttggtcccccaaggttcccagccctgcctctgtcgggcctggctgctgacacccttttacttcctggagagagcacgagaagtaagacgaacccttcaccaatgtatggctgtccacactcaagggcccccgagcctggtgccaacctgctaaaccccccaaccagtcatgaccactcaagctctgagctttgttctgccttgctggtgttccagcccagagaaagggtgcccctcaagggagagaagagattgatggggtgccatgatttctgaaaggcagggagcgcaggataagaacagcagctgccgtttgaggagcttctgctgcatcccaggccgtggtcagtgctttctgtagtcactgaatccccacgacttcgcttttgaagtcctggtagcctgttgatgggaagggaaagttgggctccaaacaaggaagtggttagtccaattctagggaaagtggtagagtcaagctctggacccagcgagggtgactcaaagctgagagccacatgtgccaggctggcagattttccttccagggcagcgatcttcgagagaggcagggtctgcctgggagatggatggctgcagttctttcccggagtctgctggttttcagatcaccaagcacggccctgggctcaagccctgtcccctctgcagaggggacttaggactttcccagtgggaaaggaagacatgaggggccgtgtactcagggaaacgctacccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggacttacttatttttaactgtgtatgtatatgcgtgatagaagtattcttgtatacgaaaccagttatactgcacataaattttagaaaaaaaaaaaaaaaaacccatgcgctggacaagcccatttccacaaagaacttgggagtttaatgaggcataagacatgatttgcatggttaaagatggccgctggcagacctagcctgtcttgaactgagtagcacagacagcgagatgccaggacgtggagtggctggggtaaaggcacttagagcagcacacagtctcactctgttttaaacaggattggattcctaaggtggtgctcgttgagagctgactctgctgctgtgtaaggctggagcagtgcttctcaacctgtgggtgggtcatagcagatagcctgcttagcagatatttaactacaattcacagcagtagcaaaattatagttatgaagtagcagtgaaaatagatttatggttgagggggttaccataacacgaggaactgtattaaagggtcacagccttaggaaggttgagaagcactgtactagaggagtcagagagagctaaatgcataccagctctgcaaggggaccccaggagagtgtgctcagcttcagatgccatcatagaccagccaatcagagcagatgccatcataggccagccaatcagagcagatgccatcatagaccagccaatcaaagcagatgccatcatagaccagccaatcaaagcagcagtgaggacccaccaggcacctctgagaaagaccccagtagaagatggacaccagcaaatgctagaaagaacatgaagggacagggccctcacagccatccttagggagaactcagggtggcacagccattcagaagacagctgggtaatgtcctacataactagacatccagtggccaaactctttgatacttacccaaatgagtttttaaaaacacaacaaacaaacaaacttaggtccacatagaacccacagccttctttgtattcaccagaaattgtcagaagctgggggaggggtgcaactctgtgtagcctatgttcttagaacagccttgaatttgatcccaccacagtaaataagcaagtatgaatggatagaagcgaatgaatagctaaacacccccatcgagtgaatgggtaaatcatggtatatccagacagtggactattattcaaggggggaaaagggcctttgagccatgaaaagctacagagtaactgtagacatgttttatgggatcaaagaagccacctgctgcatagctacagtcacatgatgtacagtcacatggagagggctgattctagagacaggaggaagatggtgtttgcaggggtaggggaccctggtcaggcagtccaggcaggatttaattgactataatctttcgaaagccctcagacatcaggagctctggtccagctgtaggtgtaggcactatagcagaggcctgttgagctgaggaagtccagattctttgtctgtgccctgaggaaactagagaggtcaccgaccagcctggagggtgtcactggaggctttttgaggggaagaaacatgtctgtgttgagacaggaaggagctaggaagagagagaaagcttgtaagcttcagaagaaatggagtgtcagggcccagtgatgagagagagagagggaaacctggccgtaaccggaagcagtgttgaaagggacaggcgtgaggcccagacacagtcaccaggctgagacacaacagagcctgtaagctttgtaaggataccccagcctttgtggggacccacgagaggatgagcctctcaaccaggatgtagggttgggttcctgcttcagaagcaaggcaagccaggcttcgcatagaggagacagaggtggcagtgtgggagtggaactgggggtgacagctgagtgaaggtggcagtgagaaggtgcagatgagaaatggagatggctgaatgctggtcggggagaggacggggtctgtaactctgagggttctggcccaggcgagggtgggagtatctttagaagtggagatggaagagtagatatactctgagatgcctcagagctgtgccacgaggctgttcagtgctaaggtcgaggctgctgaaaacggacaggagcagtgctgtacaaatcccctttagttgctacgccttgctttgttccatcaaactgagtagaaccagagctgtggaggaacctctgggcattgttagattctagagtaaacattgcacaggcttcccataatggcagtcatgttaaaccatagagaaaaacctgacaagagccctcagagccagtgtgctatgaacagctaccccagactgcagcattgactctatcagtgctgacttggggtgctataaaggtggacctcagaggccttgatctctcttaactcttagtgtttctattgctagggtaaaacaccatgatgcagatggggaataaaggctttatttggcttatgcttccaggtcacagtccatcactgaggaaagtagggcaggaactggaggcaggactgaagcagggcctttggaggagtgctgctttctggcttggtccccgtggcttgctcagcctgctttcttatagcacccaggatcacctgcctaagggatggccctgcccacagaggtctaggcctaccctcatcaatcatccatcaagaaaacaccccacaggcttgcccacagtcaacctggtgaagacagtttctctactgaggttcctctttccaaatgacccgggctcatgacagaatccaagtttcccacgtgacaaatgaagaaagacttgctcattcccaggcttccttgatgctctgagcactcagctggtcaaactttcccagctggaatcccagagaaccctgtacatggataaataccagcagcatgcagtgctcatgagcctcagtaccaagtcagattctgaaactgtaccttgccagcagccagagtgcagactctgactagtgtgcttggtggtggtggagttgttgtcggtggtggtggggaggtggtggtgatggtggtagtggtatgaaatcttctggggtctcggaagctctgcctttattttttaaaacctagggcagtggagttccccatttactgctgccttccttccttttttcttgctgtaaaaagacatcataaccaaggcagcttacagtaaaaagagtttattggggcttatagtttcagacattagagtccatgtccatcgtggcagggaacatggtagcaggcaggcagacatggcgctggaataatagctgagagctcacttcttgatctacaaacacaaggcagagggagagctaactgggagtgtctgggcgtttgagacctccacacccatcccccatgacatacctcctccaacaaagccaagcctcctgatccttctcaaacagttccaccagctatggactaagcattcaaatatggagcctatagggcccattcccattcccaccatgttgagaaaatctactatctcccagtaagtgtgtagtgtgaggaacacaggtactaatatccccactttagtgctgaggaaggagctggacgaaggtgatggattaaacacgtgtgtccttcctgggtggaaagtttctggagcttgaccctgactccagtttgcctctgatgctattcttagagtggccttgagccatggcagctgagggacaggacgggtcccagctgcctgacatactggctcaccaccctgtcagcagtgcttgtcattggcatccagatgctcccttacccactgtcgctttctccttcccctccccatgtgcagataacaaggcatcttatggcactgtcctggaggggtgctagccctgctagccaggccccccagtaagacacagaagccagcaaggcacctgagacctctgcccttgcagtcctgaaacttccatgagctcttgcaactgggaggctgaggcttaaagaaacttaataaacttccctagagtcacatcacaaaacttgtccaagcgaagattggaggccagagcagtcagtgagacagcccccccccccccactccattcagcatgcaactctgcaagggtcccacaggtgcccccctcactggcctctatagcctgtggtagtcaagcagcagggtatggaagtgccccctcttcctgtgtttacccatccggtaaacagtgtcgagaacccagccatacagagcctttgagttagagcatggcagagtggctttgctgttcagaaagccaaggtggtgccagagggggaggaagactcgttctggccaccacactgcactgagcctccctccccctctctcagccatttcctggaaaacctacctagggaagtcattgcagacctgggcttggcttgtcaaggacccaccatgcattcaggaagtgatttttttcctctattgaaaacaccagcatttagtattaactttttaaattggtgtttggcagagcctacgttcttttccgtctccatgctccaggcatgtatctctataacagacataggcagttgtaagttctctccttgtattctggaaacaaattggcacattccagcacgagagggtagcactttggcatagcaggggtagttggtgttgcaggccacacacaagcctggggagaaaaccccggaatgaactttggaggctgcggttaccagcttcccctctgtaacatggggatactggtcaacatgtcggcctgacatgcttgctggaagacagtccttacagaccacgggctctgctgtctcgggtgcgactcacgtgagaactgtggagtgtgaagcagcaaccagctgccttagctgcctgcaccttcctccaggagaagaatgcttagtccacaggctggacaagctagatggtgccagaaaccagaggaaacagggtgtggctgggacagaatgggaaagggtggcaaaatgtcacaaagggtgactcatcaagaagttatagacctgtggtgaagaaagtgctagcactgtaggaagacaaggtgggaagaagtaaagggtgggcccctgggactcctggcacagagctctgcacctgtgtgcttgcctggtcagccgtggggcctgcaggaggaccaaaattcatgaccatgccagaaagcttagcatgggatgaaccatgcacttaagcaggtctgggaaagttgataatccatcttctccactatccactaagctgcctgcattgctgctgtgcgcacaacacagaagcagcccagacgaatgtgctggtcccacagaactgtttgtcaccacaccttactcctactctgtgatggctagggagaggaaccctgaggaatagagcataagtaacttgtcccaagtccatcagctaagggccggtagagccagggttccgtgtgctgaaacctcgagactaaagcatcccacagggctactcttgctaggaagaggtttttatatccccccaccaccacctgtccatctgctttcttttgtctgagacccttttgctgtagggcaaaagccacctcaaaagagaccttgcatgtccttgctggagtcagtagagaactgggatggggaaggcactggcaaccatctgctgtgttcttgcctttctcctaactaaaatagtctgcaaagtgatggagatgctggggggattcctagggacactcgtgaatcatgggctccaagatgagctgactgaggtgcagagttgtgcagagtaacggaactctccacagggttgggaaaggtcactgagtcctcatcccaggaggaactgcactgagctgggacgggcttggagcaggagtccagccccactgcatggctacagacctaattattcacagaatttaggctcggcttctaatgttcatttatatccgagtggcacagccaagtttaaaaatatgactgaataatgaaacactccagccacacagggcaaaccccaatctagacctgggttgcaggagcccgcgctgcacacacaataaaaagtgttggcctctcacagcatgaaagccnnnnnnnnnnnnnnnnnnnnnnnnnnnnnnnnnnnnnnnnnnnnnnnnnnnnnnnnnnnnnnnnnnnaccccccacccacactccccacccttgcacagtttgctctctggtgttagaagtctagcctgctctctgctagccagccagctgaggcctcaagcctgtgttttcctgttctcagacatttattcctctgtgaagtggacacagggatcccccagagggctctagcagggccaggaagatactgcaggtagttttgtcaagtacttcccacaggatgatgagatcatgttaatgtggctctcaaaacttgtaagggatccaacttcagtcatttctcgtccctctcctcccctgggttatagggggtcactcagaagtcatgatttgtaaatgatagggccatccattcaaatcagtccctctctgtttgtcttcccctgtccttgaaggaggagaggggaggatgttcagtcctgataaaatgatcctcatacctcagtagtagtcctcttagtacctcgatgcaccatagcatggtagccacagctttgtccacctatcccatccctaagcctagaccagaactgggaccttgtgaccttcctcacttgagtctcggaaagtccaggctgccatttctcagggatccctgagtgtggacttgcctcttggaggctggcttccccatatctgatttatagcgctgctcctgctcgaactcggaaggaagcattctagtgatgctggcacgcagcaggctacaaaggttttaaagtgttgctctggaagcaaaattgcccctcatgctgttagaataattataccccagtccatccccccacatagccaaatagcagtcgtggaacccagctcacatgggaagcctgtggaggaaagaaagaactgaaacagaacccagcacaaggcacaaggactgcagagggcctggcgaccagtctttagtttccacattgaccagcagtagtctcttgggtgccccagccctttcttctccagaagcatgcaccctgcatgctcacactggctgtggtttcaagctgagcagaaagtacagctttatcattttaagtatgtagccctaggccaaaacagacagggccattttcaaaactctgttcaaaagcatctccagacattcagttccctctcgtagctgtctctctctcgcaagggacaccctttcctccccaagccttagtcctgatctgtgctcagctgctgctggctgcctggctgtttggtgggctccacctagccctggccagctgagccttgccttagcagaaaggcatccaaacacagcaggtgaagggaggcattgccttctggccaccagcaatgaggccctgggaaactaatacggcatttcccttggagtgtggtgtcttacagaaatacagaagtacacatttctcagaaaagcagaagactcctagcgaggactgtctgttttcaatgtacttaataaatcccaggcagtccaggtctagcaggcccaccatggtcctgtcatctcgtagtctttctctgtgagcagatgtttgatccagtgcagcaggaacaagcctcctatgtcccaccttctgctggctgagtcacatcacaacttagttatttcctggggaaccaaaactaaagcacccttttgctttagcttgagtgactaatttcactcaggagagattcatggcacatcattcattggggttttcccttctcctttgtcctgtgttagacacacttgtttgttgttgtgtgtaacaactttaaaaagccatatttttctttatatgtgtgtctatgtgtagaaatatgcatatgtgagtgcagcgttcatggtgtccaaaagagggcgccaggtcccttggagctggacttataagccattgtgggtattggaagccaaactccagttctctgcaagaggagtgcatgcccctaactgccaaacactctagccctgatacagcatctatctaagcagccagtattattacctctttaacatcattagtggtctaggaaaaaacatcagaaaatatcaaaaattcttgtagctatcctgcataaaattaagatgctagttctgtccaaattcttttgaagaattctctggtgaccattgatttagcttagtgaactgcacaatgtgtttattgaaatgttattgtgcttattaaaatgtcattaccttgaccctctgtctgccaagttcatggataaaactatgacagcctgtaagcttaattcatacccgtcatctaggctctgtctagaggagtcctttgactttgttcagttgctgtcatataaacaataggattgctaataatgtctttggctcttttgattttttccaagttattactggtatacaggaaattttgatttttatatgccacctacttggcagtcttattaacctttcttgttttagtcaattgaaaattttctaaggtttcccaaattaaccattccttctgtagataacttttttttttttttggtttttcaagacagggtttctctgtgtagccctggctggcctggaacttactctgtagaccaggctggcctcgaactcagaaatctgcctgcctctgcctcccaaatgctgggactaaaggcgtgtgctaccactgcctggcttatagataacaattttaaagctttagttttaaattttaatttaatttaattttatatgtatgggtgttttgcatgcatgaatatatatctgtgcaccactcacgtgcagtgttctcaaggccagaagacaatgttgtgagccatcatgtgggtgctgggaactgaaccctggtccactgggcgagcagtcagtgctcctacccactgaactgactgcagccctctgtgcagcgtgttttcttgtctatcgcattgtctgattgatgctgatctcagccacagtcgatgtcttgctttgtcctgactgaactgagagttttctcactgactgaggtctccgctggaggtttggctgcatggaagaagcttgtttataagggtcagatgcacagctcagtggtagaactcttgcttagtatattcaggtcttgcatatactaagcagtacagtaaaaatgttataatgcatatgcaagacctgcatatgctttattgatagagcaaaaaagtttaaagcatctaaaaaattaaccacataagaaataaaccaccaggccaggcacagtggcccgggactttaatcccaacactcaagaggcagaggtaggtggatctctgtaagttctaagccatattggtcttcacagtgaatttcagagctgcctgggctatgtttagaccaaaagagtaagacccagttcaagggaccaaaagaagagaatttatacataaaatattgagttcactagtttgcatccagccagcctgcccatcgggaagagtggcgtggggagcttcccacgaaagggatgcaaaagtggcctggagggtggttcagccagaggagctgcatctgaggtgtgtgtagcatagaacgggaaactgcagtcgatcaattgatcaatcccgatcgatcaggaggcagtgtgagctcttgttgagaggacacctagtgaagagaggggggagtaggaactcagtacttgacatcacattctggggcacctcaaaaacccacttagggatgtactgttcctgttttgtttaagaattcaaagccagcggtggtagcattggtggcacacgccttcaatcccagcaattgggaggcagaagcaggtagatctttgaattccaggccagcctggtctacagagtgagttttaggacaaccggggctacacagagaaaccctgtcttgaaaaacaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggaaggaaggaaggaaggaaggaaggaaggaaggaaggaaggaaggaaggaaggaagggaaggaaggaaaagaaagaaagaaagaaagaaagaaagaaagaaagaaagaaagaaagggaaagggaaggaaggaaggaaggaaggaaggaaggaaggaagaatttaagctgtatatttaggctgggtatttagcaccatagtagaacatagtctagcaggcacaaggtcctgtgcttaatacccaatatctaagaaaacaaaaaacaaaaaacaagcaaacaaacactcaaacactctttgatcattagaaataattaaagccattagttaggaaaaccaagtcagtgcaattaaacttcgggacagcagcagagagaagcagctgagcgctgtcctctgcccagtgcacacaggacagcagaatgtgtcagccctgggccactcacttgctggacaagggctatgtcatggagccagcaccccagcctgaagtatgcttccagaagtcagagaatcctttcccatcttgttcaaccaggaattacagacaaaacacaccctgccatccttactggccagatagtcaggtgtaggcaagggagagtccccaaatctctcaggtatgtgacttggttgctgccaactgggaggggtctgcccccactattatctgcataaagctgggtggggtctgtccccactaccagctggcttctgtcctccactgcctttgttttctttcttgtctgggacctttcctgatgaatggcacaggtcatacatattattttggtgactgaggggacagagcagaagaggtaaggaccaacgtttgcacaccaggaaggcagagattggtctgtaaccattagctgcctgctcaaccatccacatctaactgccttctcattggttctcttgccttcctatcctgcccctgtgtggcccagacaggtgctcagactatgtgtgtactagaacaggtgtagcctatgccttgggtctctgtgtacaggcctctggctggtggagacctgggtgatcacacagaaggaatgggtgcagatgtgttctaacgccctgcccatctcagcagacatggctccacaaactgtctgctttgaacaatcaatgcatttgtcagaggcactcgcagcaggggcaaggccctgcaggcagctgcacactcctgtctgttccaggccacaagagccccagctgagctgcgcatgtctgttgtcctgctgctgggggtgagggagggggcagcctgtgggaaattccaggaagtgtggccttcacatggagggagccctaaggaccctgagatgcatctatgctagagcagtccccaaatccctttcccagggcttctgagaaacctcagtgcttaatggcaaaggagtggtctgcattagcagaacaaagacatgcaagaaaccctaaatccttctaactcaccccacagtgccatatgctaaaatgtgtccccacctctgggcatctcactgcctccatcagccccttcaccagaattatttttccttaaaatgaccagcagtgcacacctttaattccaacactcaggaggcagaggctggtggagctctgagttcaaggccagcctcgtctacagagtgagttccaggatagccaaggctacacagagaaaccctgtcttggtgggcagggggtggggaggagatgaccactgccatgatagagtggggtgtggctctgtgggagccctatctagcagacaagcccaagatttctcccaggcattgaaaaaggaaagcaatgcttagtctgggtgggtgtgtcctccagacctggaacggtgggcactgcaggacctcaactgtcccccagggaagctctccagccacctgggctcagctcatgggtacagagcgagctgagctcccagtctgatggtcctgccccaggtctgttactctgggagatggaagctggactagacacagagtactcagcccaggtcaggttccagagtaaaagggtgaggggtgtggccatgggagacatcctgtccactagcagggtaccttggaatgggagagaccattctgtcccttcatgcctgcccttggtgccttttggtgaatgtcgtaggatggcctagctgttcaccagattgatggagccccctaactcaagtcccttcctcctgtgtgcctatttgttacgagccggagtgaaggggctcagctgcaaggtcaaagtgcagccagccacactgtccacgagctggctattcttgtttgctaatgtctgtcctaatgacatagcatgaaagtcacagcaactgatgttcaccgagagctccagcataccagcactgttctcaatactatactggtctcactttcaggagccttctccagaatcacccctgagaatgtgccccgtttgacccagaagccacagaatttacatttacaccagctagtccaccactgtgctaggaagggtaccacgctgctgaggccccagtgtgtgctcggggattaaatgggtgggaagaaggctcggtgggtttgtgtggagagtgagtcctcctgcacccactcactcagcttgccgtgtgcacttctgtgccgctgacggtcacagagggtgtgtcatcgctaagcaccgcacagactctgaagtaaagacagagccaggtatgtccctgcacagagaggactggcattcatgccactggggcccagagagaggaggacaaagtagacaggtggggtggtgggggccagaggtgcaccaggagcatactcagcgaatggctaagaacaccaagtggattttaaaagtgtgtgcatgaaaaccttcttcttggggtcagaccagagaccatcagtgatctttatgccacaccccaaccccagggcttttggtgacccaacctactctatgagtgttccatgctaacatgacaggtttcacagacagtgggaaagaaaagaaaccccagtgtgaagggagaagattggagaggcaagggccaagatagagcaatgggggcaggatctggctttgctcagcgagctaccccaggactaggaggctggtgtgggtgggagctttttggggtatagaacagttcaccccacttgttttcactgataccctgagccaatgaaaacacgagaggcagtctcgagcggctgtgcagaaacctcccgtgcagcagcgtattttccagtccagcttgcagtaacttggtgggagggaagtgagtttccagtggggtttcatcagtggctcatacaggagcttgttctctggtccctcgtgttgggattggatgccgtatggtgttttatcctgttttcagggcaaaagcctcgggtctgtaaacttattaaagcagaagtctctattttcttttcttgaagatagttttttaatcgtgtgtatgcttgggttttgcacgtgtatgcaccagaggcaccagtatgcaccagaggcatcagataagatcccccggagtcacaggttacaggagctgggagccacctgacatgcgtgctgggaaccaaatatggcttccgtggaagagcagaatgtactgtaactgctaagccacctctctgtccccctgcagtccctgttctgaagcaggaaaggctgtcattaggcttaagtgtgctgtctaggaaggtgggggatgggagaagacagtggagctgtttcacacacaggccatttctcaaagccacagtttttctttcttagttctacgaccagcttggcgcctgttgcttatcaaattaactaaggaaaagaggaacaggaaagaaactagaagcagaaagctggtttgtttgtaaaatgggttaaaagggtgtttattaagggaaacaactgccctttcatttttgctcttaaaacagaaaggctttcatgttatagccagtttcaaatcttggaactcttcttgaggcgtgtttcccaccgctggggatgagctgccatgaaggccaagttgggatccacgaacctcgaggctggaaaagtactgcccagcagaacctggcgggcctcgtgtaccagggagacactgccatgcaggctggcatggccaaggcccctcagaggatgcccagcctgagcaagtccaagtggctggaaaagtactgcccagcagaacctggccacctttgtgtcccagggagaagctgctaagcaggctggcatggtcgcacccctccatccaggtcttggccttggcccctgctgccaaggatgcaccagtctgaaatagatcaagatgcgtgagtgaaacaactctggtgaaaagccatgagtgttagcgctgtgtcccgtcactgtcagctgcacagtgcgaggctggatggacggccatgggcgcctgtcctgagacatcactatatttaggcatgggcccgagaagccaaggtaaagaaagacacccctgagttacatcagaacactgttgcccttggagctgtagccgtgtgtctgtctgtccttgcatctgctgctcaccacaggccctgtgtgccatggtgtaaagacagtgccccccaaaaaaaccacaacagcttggacggcatcagcacttcctgaatggcagtccttgatgcccggcgggtacgtgccactgggcagggaccacacacagtggcttcctatgtgctgtactgaagggacaccgcatactccatgactgcagagcatgacacagagctctgacatggcagccctgtccacagccttctatctctcaaaatctggtgtcttgcagcacacgtgggaaactgtgatctcccaaggtctggtggcctgatggcaatagtctctgtcttctcatacgggccttcaaagtcccggtgcctaggaagaccagttctgctcctctctcccggctcagcccaagctgccctgctggctctgcctgcagcagtctgcctggccagccttcagctccttggtgcttcagtctccttgcagacccctcctccaggaagccttcctgaaaagtcagatttcatggatgtcctacttaggggacatccttggaggccatgcagacatttctgctagaactctgcatcctccggacgtaggccagccatcccctaagagccttctctgagcactgccttctgttccctccagctcaggcttctccctgcacccatctaaagacccctgcttggctcatatgagtgactccctgcttggactgggacttcccaagggaaagggtgagcctagcatctttgcctctcagtcactcacaaagtaagagcagggaccacacaggtcttcaagtagcttactgtcagacttgggagtgagactgtggtacggcaactcccgtctggatttcttaggcaggagccaatggggaagcacaaggcttccctgaggaccccactcttctacagtgggccttagcactgtgtcccaccaccattgcttggccctgaggtcctgggacggccatggacgcccattctgagatgtctctatatttaggcaggggcagcagacagccagggcaaaaacagatactctcatgtcccttcagaacactgttgtccttaagctgtgatgtgtgtgtgtgtgtgtgtgtgtgtgtgtgagagagagagagagagagagagagagagagagagagagactgattgagtccccaaaaccttctagttccagggaccctgctagcctcacctcttactctaataattaaagacactccacaccacaccctagcatacacacacgggagaggggccccaaagcatctccattcatccctagcagggaaaggatgattgcatgtagaggaaggagagtcctgtgcccactataggtcctcagacaccagacatccatcagtctaaggctcctgccccacacgaacaggatgcctatgggctctgggtggctacaactgtgcaggccagccttggcctctgaagccagaggagcaggatggcagagagttgaggtccaggagttacagatagctccttagaggaaattggacaaaacccaccgtctttcaagactgttgctgtacacagcatcccacaggtcctggtctctcctgcctctgccagtccaggctcaaggagtatgaccaggagctcagagtcttcctagcctggcctggcagctgtgttctgacccctctttgctgtcctgggagagagcctggagctgggatagggctacttcttcccaggctctttgaccagacagagagaaagaaatgaaaactttccatttcccaagtgaagggtagagtttggtacacacctggtggaggatgtttgtgttcagggaggtctttgccgtctgctttcagagtaaacgctcctgtggtcacccttggatagggtgcatccttagacagctggcccattggcctcagtatccgcaggcagctgctgtgaacttgcacggggcagccaggaccaccctgctggtgtaggaccgcggagctctggagctgctgtgtgaggctgtgcaccttcccttcccagggctcacagaaagcagcagtgctagcaacagctattgttttcccaagttgtaaaggcctgttttcagtacagatgctccaggacagcctgcaaagcttcctaagaagagctagctagtgcccttgttctgcctcgccatactctgatgcagagtgacagcctcactgttctgacttcccagcctccaaatctgggagctaaagaaaccttttttataaatcttgggatctttggttacagcaacaaaaagaaaagcctcaaactgaaaacagcccagtgccctgtctttagtgcacacgggtgctgacttgctgtgtgctgtgtgtgtgatggccttcacctgactatgtcttgtctggaagagcagccagtactcttagcctctgagccatctctccagcccgctagttcttatgtgtgctgtgcagtgtatggcagctgctttttctgccacatctcatcctatggcactctgtgttgaaagcggtgtgccttgttgaatcttgtggcacctttgatgaaggttagctgccccttgtctccctgccttgtctgtcttagtttctttggtactcaggaggaattcagggctgggctcagcagaccacacccctctgtgtttctgtccttaacctgggtgtcacgctgctctgcttgcagtagctttagagagggcttaggagaccagtggtgtctgcactgtgccttgatggtgatggtcagccccagaggcagagccctcgggactcctgttagcataagccttccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctttgttactgtacataaagtgttaaaatgagctgcaaggtggcctgtacatagccaccctctcctagagctctgagggctcctgcctccctccccctccccccctctccaatggtgaccctaaaagccctgtgaggtagagcacaggcagtgaatgcgcctgtccctttaaggttttctaaggaacccagaatcagagctacataatggaaaccactttgtagcctccagcgtggccatttatctcaatcaccagtgcatttaagatgtgggccaaacatataaatcatatcttgaaagaaagtatgttggtgccacaaaaattaccctgtattcttaccacctaatttaaaaaatgtgttttgaagcttaagagagtgcaaacaagcccaggctctgagtctgcctccccatgcatcctgcctcccgcatcccacctcctgcatcctgcctcccgcatcccacctcctgcatcctgcctcccgcatcccacctcctgcatcctgcctcccgcatcccacctcctgcatcccacctcctgcatcctgcctccccatgcatcctgcctccccatgcatcctgcctcccgcatcccgcctcctgcatcccgcctcccgcatcccgcctcctgcatcccacctcccattcggtccacagaggggctgagcagagatggggactctggtggccgggcttagactgcttcttttgaaggtcagtgaaggtcaggagaaggcaaagcctgcaggggctctgctctcattgtgtcagatattgtgccccacctcagtggctctcatttgcagtgacactctccagatccccttctctgacaccccaggaatgggactaaacacatctgtcccccagaagcctatcttccaaactaaaatgaagaggcaggagtgggctaggaccgccgcagttccaggatctcccatcttgaaacttccctgaaaattcttgctcagcagttcctgggaggatggaagaaactagtagatgtgtggatccttcgtacaggcagggtccccagccccagttcctggagcaaccccttatgtgtgcctgcgcgtgcacacacacacacacacacacacacacacacacacacacgcacccattgtgcctctggtctgagagtgcactgagcacagaggactgaatgcacacctggggtcccgacattaggaaacttgttctcacgtcctggcctcatcttcttgtgcttggtaacaggcatagggttaattttctcctctaattcatttgtaaacatgtttaccttaaatccgcctgcaaataggccctgtgtccctcctcatgccagaggagcaggctctggctctccctgaggtgggagacagaggttccagtcctggcttatgggacccaccttacctcttttccatgcccctcaccctggctttcatgagacagtgtcccttcctcagagggacagttgacctccatgccacagagaacgtgctaggtcttttggtgtggggagctgtcacctctctttgttgccccacctcctccacatctctattacaacaagaataacaacaacaacagcaaacaggtccaagtggaaagttccagaaggaactatcttagggtttctattgctgtgatgaaacatcatgacccagaagcaagttggggaggaaagactttatttgccttatacttccacattgaaggaagccaggacaggagctcacacaaggcaggaacctggcggcaggagctgatgcagaggccatgggaggtgctgcttactggctgctctctgtcacttgctcagccagctttcttacagaacccagactgtctgcccaggaaaggccccacccacagtgggctgggccctcctacatccatcactaattaaggacatgctcctgtgggtttgcctagcctacagcctgatctgatggagtccttttctcagttgaggctcctaagagcactcaagcttgtgtcaagttgacataaaaccatcccggataagggctgatataacagagccagcttcatttacactgtaagggtgcaatccacccgtgaagagggtaggagagtggagtgtaggggagggagggctcagaacataccaggggcagcagggtatgagaggtagggaggaagaaccgggcaagctgacagacactgccatgcacagagtgagagtcctgaagggagagacgggcccttcagtttattcttggaaaccaaaagaattaaggttttctgatgcttaaaggcttttgagagatggagggaagttgcatccatgtgagtccatgtgggactaagcttgctcacagcccacaggagttcctccaggatagaaactacagggtgtatggcctggtttttagaagatgaggggaggctgccagagggtctgtgatctgatagcccccacccccagctccttagcaaccaacccccagtgagaactgacaagcagttggtgaggagctgcaggcatagcacgctcgctcagatatgggcgcccttgcctcctcactgaccccaccacatgggaagcaagccctgggtaggacaagcaggcctgtgtctgtcccacactgttgcaggttcatctgtaactcccaagggctcatggagagacagtggcagcagcagactcccttgcctgcttctcagatggggacctgcggctgcacagccctcacagccaaccttgccctcagctcccagctttcccgggctgtggcctccactgtcccctctgcttactgcccccagacagtgccttgcttccttcctgcctgcctaccaacctagaatgtcatggactagcctcattgccctgtgagccccaccctcttctggccctcactcttgaattaggtattttatcctaggaagtccttcctggtcttagtgtcacctgctgatagccctgcccccaaacctagggctcgtggccttggaaagggtctgtgagggatggtggcacacaaggaaaaggataagagggctcacatccctcagaaggaagtatgacaggccttcccatctcttctagagattctgattcctcctggggagtctgggagcaggctagggtcaaggtccttacccagttccagcacagtccactctatctgcaactccctgtccctcccagaagagaggtggggagcaggatgtgcagaggcccacagaggcccgcagagtcaggcatgaggagtgccagccccaactttcacaagctgcaatgtggcttaagatgtttacattagcaaatgaacacttttaacacaccccaaaatataattgtgttattcccgggtgatgacagtgtgtatggaagaggccccttggcccatggtgtgcactgcagtgtcgtccaaagcagacccaggctgaaactggctgctggcatcttctttccagagccttcacaccagtgctgcagaccagtacaccttaatggctgtggggctgtggagtcaggcagacttcctctggcacctcccgtaaggcttagaagggcctttctctcatctcagagtcgtggcacggcttgctgtctttccttgagagctgtggttcctgccctgccctccttcagtgagcctgtgatgtgtaagtgaaattcactttcctctccaggttgcttttggtcatggtgtttatctcagcaacagaaaccttaactaaatatgtgcatgtgaagtgtgaatgtttgtgcaccttcatgtactcatgtgcacacccgtgcacatatgaaagagttaaggcctgtcagtcctcaccttgcacctcatttgagggtaagttctgttgcgtgccgcaggctagctggcccagaattcctggagatgttggtctctacttcccatctctctgtaggagcactggggtcacagacatgtgccaccatgtccagctttatgtgacatttagggacttgagctcaggtcttcatgcttgcatggcaagtggtttttttttttttttatctactacaccatcttatctcctcagcccttttgtgttttggttggcatgtcccgaaagaccaacaggtgtttctcttttttgtgtgacttaagagacctttcccttctctggctgcaagcagggcctactgaggactcaccgcccttttagcctgttttgtgcccagtgaatgtactgtccccccacatcaatcattaatcaagaaaatgccccctaggcttgcctctgattggagggatatttttcatcccaagtcagtctgactcttgtcagggcaacaaaacacaaaccagcagcacattttaagagctttataaaacatggaagctcgggagggtggattatacctgtaactccagcacttggaaggctaaagcaggaggattgctgtgagttcaaggatattctgggctatcaggtgaaacttgttaagtgccctatgcccataccaagcattaacattgaacaaacttctgtccagtcatcatattcttcattcatgcagtaggcgaccggagcctgttcaggccagtgctagcctgggtaccatgtgaaccccacagtgagcgtggccaggctgcactagtggagaagcccttcactggccctagaaaatgggtctggaaaatcccaatggtttcacagtaaaccctttgggtggcttgaaggagcctctttacggcccagacagtgccagcagcaagagtcccacctggtcaaccttcaagctaagcatctggttcaggagcaagcactctaaccatgacaggctctccctgcccatccagaggctgggcagaagattccagagttttccttccttccttttgttctgatacctcctcccacagtcccccctcccccctcagcgttcccttcctccacgctagctacccaagcctttcctacataaggtctctccagtttggctatgtgatctcaggcaaacttttacttctctgagctgtttccccgcttaccccactggcaggagtgagacagaataggattattagctccaggtctgcacacagcctgtgtcataggtgcagatgtgcttattgaatatgtatgagtatggagtatgagtagctgaattatgctgcaacttggatggctctgtctcagactgtcttcagatccaaaagaccaggtcaagggccgcttacagcaaagccacctaacccatgagcccaggttccagtctggtgggggtctaggaccagagagacagtgccccacaggacaggtggcaattttttttcctctgaggcaaggtgtagaaatggagggacagtatgagggacactgccacccttgcaggagagaagtcactttctgggttgctttccacatccatgacagccagcattgctatgaacgtaacttggccagacctatcacctcctcccaacaagctgttctttcccttagctctgcaagggctgaggcacccttgtgcaacccattccaggaattttggaaggctctgaaggcatagctctctaggggccctaagctgcttagggcaccagagtcttaggacctgctatgctgtgttgacctcaggccaccttcaacgtaggatttttgccaagagttactgggacagaggactggcctaaagagctacctccttctcagggtgttacaagagtgggttccctctccagtttataacccagggctccccagagacacacactaagggacagagggaaggtctggtagtctctggtctgtaatcctgcctaggtgacctggggttgctggagaagggctgttctaagtgacagccagctcccttgccccagagtgttgttggcacctggcataaagttcagtgtagacagtaaggcagcacaggatggcaagtgctctcctgccaggtccctgagagctcccgccctctctagctcagcttctccagcacagggtacagctgggcaagctgactgggccagtggtacatgctacaagtcaggggctggctgggtccaccaaggatgtggcagaggatgcagggaggggctgactggctggtgctccctgttcacattcagttctcccactggctttgaggcctggtgaaaggaagaaactcgagatttgacccattgtacaagagacagggtatatcagtcctcccccatgttgggaggcatacgcagtgcctgtgggagtgtatacctctgttatcatagcaactgtagttgggaaatgtcatctgtgggcatcgtggggcagcagaatccctcagttgagtatctgcctttttttccacacagatctgggacatgagtgacgaggagactgtctgaagcaagcaaccacagctcaggagtacctggccctcagcgcaggactggaccgcaggactggtgatctgggccctgccacctccctggtcctgatctccacatctccaaggacgagggtgtaccctctgccacccagttgcaccctttcctgtgccatctcaccagctctgaactcaataataaccttggcattgccactgatctggggctcaggtccttccatgtgcactaatctccccccccccacacacacactgttgctgaaggacaccccaggacccaacatagatcagacaaggctgtgctaggagcctcaccggtagggcacctgctctgggccctgggtagcagtgagtgctgagtttgtagcctcaagtgttcaagtggcacaccaagccaccctcccccagctgtgggcatgctgtgtgccaccctgttccagggatgggagaagctcctgccacagccctgtactgaaaagcagggaagagctctgtaggatgggtgtgtccagctgggcctagtcaggtgccctcactcacggggttgctcctggggcaaggcttgtcttcctcttcactctgggtgggcccttggcagctgtggccacccatcctaaatagatgagctgctcccctcccacacctgtgcaccttcactggggtctcaggtccagaacagaagcccatgcacggctggcttagcaggtctcaggaagggagactagagaggaccttggcctaacacagatgctgcaacaagcggccctaccatctgtgcaaggctccccacaagtagccaggcctacctgggcacagggccccacagcccacatgccaccctaggagtcaagagccacacagcctcggtttaagagcactttattattgttcttaaggctacttttaagtacaaaaaaaaaaaaaaaaaaaaaaaaaaaaagatggcctgccaaacctttttttttttcttcttccaggaaaaaaaaacaggccacagaaaatggtatattacagatttacaaacacagaggggtcagcacacacatagatggcttggttctggggaggtcgcaagctcctgcccaagcgggctggcaggctcctcagctgacaaatgaggtatcccactccagggcacggcctattccagataggtcagcgcaccagggacccagccacccgcactgccatcccccccctcccccaacagcgacgacccgctcactgacgggtatctgaggcccgttgcccacagagccagtccgcggtgcggttgttttcctgtgacaacctcagtagcctgtagaataacaaactagtggctattaatgcggacgcagtgttgtcatggagtaactgtgtacctgcacgattacagacacacctacgacaaaaaagatcaacttttttcccccaaacaacaacaacaaaaaaatgaatgattatgataggaaagggaaaattaaatagctacatatcattaacaaattaattgttcttcaaaaaatacctacaaatttctctgtacattctttacgcacagcgtaatgatggtctttaaaattacctatataaaaaaagtgttctgaacaattctttttttcctacagaaaatataggggcctgaatgccaagcttggaagcccaggagagtgggtgaaccttgtgcggggcaggaggagggctgtccatgtttgtaaaggccagtagccaccctgtgaccacgaggatcagtccccaccttcccacccgtgcaggtttcccaagttcgacagctaacctgtttcctcctactaaaagtcagccccatgattccctgtgcaggagtccataatgccttgtgggggaggagctcctagccaggtgatgccctcaggtgggccaggccaggggacagaaacactcaaggctgggagaaacagcagctgtcgggcatccctagccgtgtctgtcctgctggctcctaatgtctagttagtagctattaatagtgcaggaataactgtatagtcagaggaatgtgtacagccttggccccagcataggaggacatgcacgcagccccacgctgcaggctgtcaggcaccggatgtttggccaggagttggaaaggagcagtctgtgtatcaaggagcctaaagacatgaactccaagtccccagcccaggatgcagaaaatgagcagcaatgggcttccccagcctgccacacccactggctgtgcgctcctctctggagtaaagtgagcgttgactcatcccagaagcacagctgtaccagcagtgaatgtatcagggctgaaactgatgacgcaggctaatgctgacaagaggccagacaagaagccaggcagtgctacagtctgggcttagtcaatagaaaccagctatttttttttcttttgagacatgcaccatgtcagaagcactacggagtcctccagccttgtccccggcctcacagactgcagtgctcagagaagggaaatgcccatggtcagggggagtctgcagtccagctgtgagcacctcaagcctagagaaagacctagaacctgctagagaccctctaagttcagcaacaatgcaagcacacatggtcagaagtattccctagcagtttgccctcagtactggcatctcagacagctgcccagcaggcagctctgccctccgtagtgcaaatcaggacagttgtcttcaggcagacacatgcaaatgcagactgagccaggctcaggtggaagccaagctgtgcatacccggccacagaagctaagagcacaaagcgtccggatccccatgtcgtcatggcttgtgactgagaaagggcggcagggtcccggctgccaggtggcagacctgcagaggtttctttggtaaccggggcagggagcaaggatgctctgctggacttaatgctccgtgctgttctgttgccacactgaggccccttgtatgaacaccaagcaagtataaaacagagcagaacagaagtccagacaacatggttttgagaataaaccacccacccaccctccccccaggattttttttttctttctgtttttttaagcactgactgttcaaagctcaggcaaaccatgcagattcctgtgtggtcgaagggtggttcccccttcaggagaccacagagggggagtgactatggctgaccatgtgggcagtggggctggctggctggcccctgcgtgaggctgactccgggctgctggatgcgctgtccttggctgctttgatctgaagccatgtgtcacctagtgctttggcaaagtggtcatccactgagccagtgatggacaccgagttaggcgccggctctggctccttgtagttcttgcccaggctccgacggaagtgctcttccaccacagggtcacaggtggcagttgctgcaaaggaggggacagaggacagatagctgcatcagtgggtccgggacccagtcagtgatacttaaccacaccattaaagggtaaagcccaagagtctctgtggcactaaataacaatggtggatcctggagcccagaggggccagggacagaggtccttttctctatgcctcctgaatcatggccaactcaaggtgcacacgtgctctaaaacagtgttttaaaactcaccactaagtaaattttaggaagagaggttacagcctatagcttaatccagggttcccacatgtctcaggctatgggggaaaacttaccactgggtggtctccggtagctggcagacccaggcgcagaacagccactgtgtgcgatgggacagtgagagaggttgcagttgcgggcacccgcggatgcacaggtaatcacagagggccggttctgtgggagggagaacaggtcaactcctcatctactgagcggagctgccagcgagcccagctctcaggccagggaccttccctgttcctcgggccctctgtgctacacaacagcaggtcgagagggggagactagactggggtggggtccccttctccagcacctgcaggtgagccccaacacacagcatctcctaatggccaggccccaccctcccctgttagtgtgtacaaacactgaccagaaaacctaggaatcacaggcccagaggctcagagtccatcaagggtcacacaggggacagaaacactccaccccacagaaacactccaccccacccctccctctcatgctgcctgtgtgcttttaaagtctcttactacagtctttgttagaaaccttacccttttgttgtctctggggctttttatgtggggctgaagcctcgcacactaggcaagtgcccatgtcctcagtctccctctacctatcttgctctttgtaagtcaaggccttatgaagttgcctcaaacttgtaatcctcctgcctcagccttccaagtacctgagattatatgcctatactattaggcctggccttgttttttaaatagcattaatttcattttcctctagtagaagtaatagcaataacaacaatggcctgccttactcacaggtttatgaccactaactttataggacccaagcccccagcaacgctctgacatttaacttaggccttatgaaatcatatgggggaagggccggcctctcaagaggattgctacactgaccccgaggaacacagtgccagggaagatgggcatccaagccagggccaggcactcatccagatcaaccctgcactgtgcagagaggaagccaaaggagtgagggtaccaacatcccctcacttcaggacttctgctcggggttctccatggagctcttagtccccaacatccagcctgatatggccacctccagatgacatatacatacctgctgccgctccacagctgacctgcctgtgtcactgctgttcttagtcagggcaagaggctgctccatgaggctggggagagatgcgtacaggtggccaccatgcaagctcacggcgggggctgcagcccgttcaatgggactgcggctccgctcccggggatctctgcggcagtctccgttgacagtcttattcctgaaagacagggtcatgctcagaggggggtgacgggcaaagggggccctggggaggagccatgtgctttctcctaggtgtttccatgacattcctacactaacgctaagggcaggaccaacaggtgagttgaggaaccacgccctgagtataggagaggcacctgcgggcgaagctggctttgtggcctccctcctttcctgcaggcagatgctgctgcctgcctacacacgagatctacttcatggtcagcttgggcacagttggtcattgaagggtgggaatgacccagagaaatggtgcaatcctataagccagctctggagagggaccacagtgatgtttgctcctaagcagcagaggccatttctacctctgtccagagaggacactgatgaccagtgtgatggctctgcttctcggtgtgtaagatggcagccagtgggcagcacttgtacccagaagccacagcatcagacaagcagaggacagcagctccctggagctgtgcatgccggcactgaatgtggcaaatgccccatggaccacaggccagctgctcaatgctgccgccgctacacgggcctgtggagagtgtcaatacagctatggcgtgagagcccgcaaggcccagctaacacaaggtgttccaagctcagctctgtcctccctccagccacttattctagaaccccttggggattctagaatcccttcgagtctgtccctctaactgccagagctgagttgttcaactttaaaattgaaaggaaagtggaagatggttcccaagacttctggacgttctaggttattctctaagcccctgcttggcctgttctttgccatcagggaagcaggtcatgtgcctatgggcaaaaggcagccatgcctgcctgctgggccagccaaatgcaacaccaccaaaggtcataccacacacgtgacagccacaccttttattagtgaccacttaactttctttttttttttttttttttttttttttaaagatttattttattgattatatgtaagtacactgtagctgtcttcagacactccagaagagggagtcagatctcgttagggatggttatgagccaccatgtggttgctgggatttgaactctggaccttcggaagagtagtcgggtgctcttacccactgagccatctcaccagcccaccacttaactttcaattgtgagcagtaacatagcacttcctgggtacccagtatcccttttcctcactgttgtaaaactacactgccacacccactgagccccatcgttccgtggcttccctgtgttcatctcagagcaaatctgaccttacagagagcacatgtcagcagccaacacctttctatctactgttcctgactgcctgtccacgctcacctctggctcttgccacaaagcattcataaccacctgccagtcctcaggggaagctgcagccatattgtccttccctgaattccagtgcaaccctcaaggcacaagccaccacaccactgctggtcacctctgcctgtcctacactagcactgaaaccactggcgagatggaatcctgcctgccctgagctgcagaccatctgcacagggaaaggaagatatcagagtacaaaactaggggtgggcagactcatggggaaccagggttggcccgtggaccacagtgcatccacagccttcacacgattctacactcccagggagcatcatggttcccagaagaccctgtggcaggaaatgggtgcagaagaacccaacacaaggagggctgggggtggggggatctgaggaagaccctatagatggaaagaagactcaggcaggcaaatatcacttgtccctttaaccttcaggtccttatcacctcccaccttccatccccacagcatttcacgtgggcaagcaccaacctcagtgatgagatgcacagagagaccagaattaggtggtaccaagagggggcctccaggaccatgcctaggaaatcagtcaactggcactgggcatggaacatcatacaaaataccacgaaacacagagcaagcctgggaatgtgctagttaattttagtaaaattacacatcactttatttccagctcattttcctggttcctggagcttaaagacagacattgttttccatgtccctcccccttgaatgaatcacagcccagtgtgtcctgtgctgtcaggacgctaacccaaaccacacacatcctgcagctccttaaagaccaagttggtggaaaaacccaacgctagccctgctggaggagcctagagggctttcagggctgcctaggacacacaaccttgcctataggttggcacttcttgagagaaataaaaggtggatagggagacagagaccaccacactcatccaatgcagggttttctggggacagtcaccatgtgctcccaaccactctctgagctctgaagacaaaatgtcaatagaatttgggaaaaacagactagatcccaggaagtacaattccaaagaaaacatggtggtaaaacaagtgtctggcctttacccaggtacagactggaaggctagcctcatgcatcatcttgctcagctacagactggaaggctagcctcaggaatcttgctcagcctccggaatcatggtacattggcagggcagaagagttaggaaggacccacccagcctcagcttcccacaacacacaggatatcctggaggtgatagagtgagccttcctgatgctaatctgtgctgtcgtcactgcactgtgccctgggaacctggatgacagtcccaagccttcccacagacaagcactaatagtcgtggggatagaagctaagcctttagaccttcccaaaaccatgaccaacctagaggccacctgctttgcccagaaatcgtgacattagtggaaacatggtggtgcacaccatatcctctgtgcccccaaccctagcttcccatcccttgacaatcaggaagaaagccatgtcactacctctacctcaaagccaagcacgggcaccatgaagttgcctgacacatctatcccctgcccacaaagatgctgctctctcaccttctgctcagtgcaattttaaaactcaactccaaggaactacccaaccgacacacacctcatgttctctcacaggaagctaaggcctgtcccggctgggaagcctccagctgcagcagaacccagggggaagatggcccatgctcttcacgacagtggcttttccatccttgctgagagttcagaccttaccatgatggactccacagtgggaagagcttcagaggggcctggcacagtctgaagttaccacgctcgttcagtcaaggacgccagcgcacagctcactgtctctaaaagcttccctttgcccatggtgtagagaactgtttctatacatctctcaacaaggcatttgactttctcctgtgaattgcctttaatctctgtcacagatagatattatatgtgaccagaactaataagatgaggtcaccagagccacaactcaatgccactggagggtggataagataacaggcactcaatgggaagatggtgctgagacgggggggtgtcaataagaaagcctcccttagaagaaaccactctatggagatagccttgaactcagagatcagcctgcctctaccttcccagtgttgggataaaaggtgtgcaccaaagccagctgaagaaagctatcttgaatggtcctcagagtgtcatgacacctggcttatgatttgcccatactcctgactattctgaagtatgccaatacatatgctgcaaagcagcctcagatagggacttaagggaaggctccagaaagcgctatcaccttgagaggtcataggtctgtggggacaataaaggcaccatgggcagccttcaatagttctatctacaagaaaagaagcctggagccgctgtgtagtccagttcagcatgtcagataaaagggctagaaaccagtgcttgtggggagccagatgctgggctagcctctactaatgtgtttgtgccttagttttaacaaaaaagtcataaaagtttttaagcttataaagaaaaaacatttttttggtccagctgtataataattttgtgctaattgttataaagctcaaaaattgtaaaattaaaaattttggagccagcaagatgactcagagggtaaaagcttacttgccttgcaagcccagtgtcctgaggaggtgccacagtgaagtcacctacgggctcattcctcgggatgcacctgcccttagggacaatggccagcttctcgggctcacagtcctgactttgcactgccttgccaccgcccctgcaactccattgcttataaatctctagaaattctcgacagtgatgctttctgctgactgacttataattaatgcaaaagcatcttaaaggtttagagcggaggctgtcacgttgctatcactgtgaccctttaatgcagttcctcatgttgcagtgacccccagccataacactgttttgttgttacttcatagctgtacttttgcttgttgtgaagtataatgtaaatacctggtgtgtgacccgaaggtcgggaagcatcgctctggcgtcctataacagcaaggaccataggcctcactggccctcagggaacactgctgtgcactgagccaaggcctgctgtatgaagccaggagaccaaggccagtcagtgaggttgaggagcacatggccctgggcctggcctctccagacgccagtgagccactcactacctgcatagagaggggctgaatgccttggtgctggctctcatctgacctttggctcagcaactctggatggcactggaagggatgccctcgcctggggagcactgccccccactttttccacagtgctaaaccatgggggcgggggtgtagaggagggacagatctgcccaagtcccagaacgggcaggcaacagtgcagggctgctgggtcaagcagcctgagctacctacccctgccacccttctgatgaggaccgggtcacttgtctctatgactgagtggagaggagcctagctgtgtcatgatgtcccctcctccaccaccctgctcctctgacccctccagcagctcagctgtcacctgcatcctgtgagatcgaggtaacaggcaaggacacctaggagctgtgaccaacagccacagggctgcagcactcaggtaaagctcctggaagctgaagtccaagcctcaactgaggacgagaagaaattccattcgattttagagacctgtctgtagcaccatacagagacttcctcctgtcatggtgacagcagggcagagctcttacaagccctcctctcggaaggcgcagcatactgccccgctgaggcagtctcatgctcaccctcctcccagtgcaaaccatgggacagtcccggaatagttcctttcccccatgttgcccaaaagccacacaccccttgtacgaaaaagatgtgaaataaccaggtgactccacggtggctctggctctgtgtcacagaggcgcagtccctctcacaggccaagctctcccagcttccctgggctgggcctcatactcggggctccactctgcctccagccccagtttccccagaccagaactgtctgcatgtgttttacatcattagctgagacaacagaaagaaacggaagcctgagaatcaggtctgccatgagactggggggtggaacaccatgctctccccatgttagccaagcaagaactggtccacctgtggccacaagcccccagggactgcacacaaatgggccaagaacccatgtgcat

SEQ ID NO: 98 - DNA, 2923 bp, Mus musculus
tgcgcatgcgcgccgcgcttccgcgtttgtgtgggctgggttattacgtcattgggccgcgcggcgcggctggggctgtggttgccggaagttgagcggcggctggtaagaacagtagccatgggggaccctggactggccaagttgcagttcgccccctttaatagtgccctggacgttggcttctggcacgaactgacccagaagaagttgaacgagtaccgcctggacgaggcacccaaagacatcaagggctattactacaatggtgactctgctggtctgcccacccgcttgacgttggagttcagtgcttttgacatgagtgcctccacgcctgcccactgctgcccggccatgggaaccctgcacaacaccaacacacttgaggcttttaagacagcagacaagaagctccttctggagcagtcagcaaatgagatctgggaagccataaagtcaggtgctgctctcgaaaaccccatgctcctcaacaagtttctgctcctgaccttcgcggacctaaagaagtaccacttctactactggttttgctgtcccgccctctgtcttcctgagagcatccctctaatccggggacctgtgagcttggatcaaaggctttcaccaaaacagatccaggccctggagcatgcctatgatgatctgtgtcgagccgaaggtgtcacggccctgccctacttcttattcaagtacgatgacgacactgtgctggtctccttgctcaaacactacagtgatttcttccaagattgtcctaaagctgttggctgggagaagaaccagaaaggaggcatgggtccgaggatggtgaacctcagtggatgtatggaccccaaaaggctggctgagtcatctgtggatctgaatctcaagctgatgtgctggcgattggtccccaccttggacttggacaaggtcgtgtctgtcaagtgcctgctgctgggagctggtaccttggggtgtaatgtggctaggacactgatgggctggggcgtcagacatgtcacctttgtggataacgccaagatctcctactccaatcccgtgaggcagcctctgtatgaatttgaagattgtctagggggtggcaagcccaaggccctggctgcagcagagcggctacagaaaatatttcccggagtgaatgccagagggttcaacatgagcatccccatgccaggacaccctgtgaacttctctgacgtcacgatggagcaggcccgcagagatgtggagcagctggagcagctcattgataaccatgatgtcatcttcctgctaatggacaccagggagagccggtggcttcctactgttattgcagccagcaagcgaaagctggtcatcaacgctgccttggggtttgatacctttgttgtcatgagacatggcctgaagaaacccaagcagcagggagccggagacctctgcccaagccatcttgtagcacctgctgacctgggctcctcactttttgccaacatccctggatacaagcttggctgctacttctgcaatgatgtggtggctccaggagattcaaccagagaccggactctggaccagcagtgcacagtgagccgcccaggcctggccgtgattgcaggtgccctggctgtggagctgatggtctctgtcctgcagcatcctgaggggggctacgccatcgccagcagcagtgatgaccgcatgaatgagcctcccacctcgctgggacttgtgcctcaccagatccggggttttctgtcacggttcgataatgttcttcctgtcagcctggcatttgataaatgtacagcctgttcacccaaagttcttgatcagtacgagcgagaaggattcaccttcctagcgaaggtttttaactcctcacattccttcttagaagacttgaccggtcttaccctgctccatcaagagacccaagctgctgagatctgggacatgagtgacgaggagactgtctgaagcaagcaaccacagctcaggagtacctggccctcagcgcaggactggaccgcaggactggtgatctgggccctgccacctccctggtcctgatctccacatctccaaggacgagggtgtaccctctgccacccagttgcaccctttcctgtgccatctcaccagctctgaactcaataataaccttggcattgccactgatctggggctcaggtccttccatgtgcactaatctccccccccccacacacacactgttgctgaaggacaccccaggacccaacatagatcagacaaggctgtgctaggagcctcaccggtagggcacctgctctgggccctgggtagcagtgagtgctgagtttgtagcctcaagtgttcaagtggcacaccaagccaccctcccccagctgtgggcatgctgtgtgccaccctgttccagggatgggagaagctcctgccacagccctgtactgaaaagcagggaagagctctgtaggatgggtgtgtccagctgggcctagtcaggtgccctcactcacggggttgctcctggggcaaggcttgtcttcctcttcactctgggtgggcccttggcagctgtggccacccatcctaaatagatgagctgctcccctcccacacctgtgcaccttcactggggtctcaggtccagaacagaagcccatgcacggctggcttagcaggtctcaggaagggagactagagaggaccttggcctaacacagatgctgcaacaagcggccctaccatctgtgcaaggctccccacaagtagccaggcctacctgggcacagggccccacagcccacatgccaccctaggagtcaagagccacacagcctcggtttaagagcactttattattgttcttaaggctacttttaagtacaaaaaaaaaaaaaaaaaa

SEQ ID NO: 99 - protein, 663 aa, Mus musculus
CACAPRFRVCVGWVITSLGRAARLGLWLPEVERRLVRTVAMGDPGLAKLQFAPFNSALDVGFWHELTQKKLNEYRLDEAPKDIKGYYYNGDSAGLPTRLTLEFSAFDMSASTPAHCCPAMGTLHNTNTLEAFKTADKKLLLEQSANEIWEAIKSGAALENPMLLNKFLLLTFADLKKYHFYYWFCCPALCLPESIPLIRGPVSLDQRLSPKQIQALEHAYDDLCRAEGVTALPYFLFKYDDDTVLVSLLKHYSDFFQDCPKAVGWEKNQKGGMGPRMVNLSGCMDPKRLAESSVDLNLKLMCWRLVPTLDLDKVVSVKCLLLGAGTLGCNVARTLMGWGVRHVTFVDNAKISYSNPVRQPLYEFEDCLGGGKPKALAAAERLQKIFPGVNARGFNMSIPMPGHPVNFSDVTMEQARRDVEQLEQLIDNHDVIFLLMDTRESRWLPTVIAASKRKLVINAALGFDTFVVMRHGLKKPKQQGAGDLCPSHLVAPADLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSPKVLDQYEREGFTFLAKVFNSSHSFLEDLTGLTLLHQETQAAEIWDMSDEETV

SEQ ID NO: 100 - DNA, 160482 bp, Homo sapiens
  misc_feature (1)...(160482): n = A,T,C or G
ctagtcttttatctctctctttgtcttcttgccattgggttaggacttttttctttaattattttagttatttctgtattgttttatatacataatacaaactttaagaggcaaaaaaggtcatgcagtgaaaataagtctccccacactcctctctcctcacctcctagcagctttcttgggaggcaaccgccactgcacatttcctgtggggatttgatcttaaaaaacaaaagatttagatccatgtggacagaaacttttggtaagtactcattcagtgacattttctgagctcctacttgtgctgagtgtgactgagttttattttcattaaagtctgaaatttgcaccaagtttgggtggtagacacagccccgggggattgtattggttaaccacacacgctgctatttcagtttaatcttgactgaacttcttggctactgcaggctttcttacaccactagagttcttgctcattacagtgttgaatccctatcaaaacctttcctgtttaattggcagtgacacaatcccatcttgtgtaactcaggatgtttcacatcctgaaatagtttgaaataaaattgaaacacacttacattgatgcctatgttaatttctttccttgactgtgtctgaatataatgttgaagtgtgatagaaacaatcctttatctttctaagctaagcagaggccgaagtttcacttgcactgtccagggttatacaggcaagccttactttttcaggaagtaggtaatgtttggatttagattagtgacacatgaataactctatctatgactcacttccccccaaattcccctccgaccattacttcttaaatcttcccttccagcttaagcgctgtagtgatgttacatagacgtgtatgttcctaagtgatacctttaccatagattgtcctgtttaggtatttccagaagattcctcatcatgctgatgttgcttaagacttttctgttttcagcctgtcatggaacggtttcagcagctcaacatcaactatatcctcttatgaaataggcccttggattctgttcagaatttccctaaggccaaataagtcagaaaatatttgaaggatgtgcctcttatgcaaattacttttgtgcaatcatggatcactgcagcctcaacctcctggtgggctcgagctatcttcctacctcagcttcccgagttgttgggactaccgatgcgccctgcaatgcccggcaaattttaaaactttttttgtagaaatggggtctcaccatgttgcccaggctcgtctcaaactcctgggctcaagcgatcctcctgcctcagcctcccaaagagttaggattatgggcatggaccactgcactgggccttttttttctctctctgtaaaagtagtttatttgttctgtttacaaagtacagggaaggaataagggcaatacctggaacccctttggtcgcacatcttcccagtctatgcttctataaataacgtttgtacaacagcaaactcatattgtccccatgtgttttctcacatcctggtagctgcagtctatagtatagaccgggtaggaaatagatgcctgattcacagggtagggctcccctccaattagtgttccagctcacttttgctaatattgaaacagaagtaactagttgttcttaaaaactctctcatgaacaagtaggtcataagcaaattatgtctgcacaactcctagaattgtttcaaataactttatagaaaggcagtgactaaggccctttcctctttcccatctttctaagtcctaggctgccttcattcagcacctggactgccgcctgggtcccccacatcccagcgcggtgatggaggaggggcaggccaggccaagcatgaggaataagctgtctttactgggctcagaccaggagcccatggtcttgaggaactctgtatttatcagttttcttctccacgttctcttccacctgtttctgcagcctcatggcctgtttttacttttggtagtggatcttggccttctccttcctcttctcctccaggtagctgtcactgcctggtacttccagccaacctcatgaaccagccacccccaggtaggcagactttattttaggcttcagacgcacaaccttgaaggcaccaggaaccactatctgcaattaatatacaaaatgtctgttatcttctttttttttgagatagagtttcacccttgtcgcccaggctggagtgcaatggtgcgatctcagctcactgcaacctctgcctcccgggttcaagcagttctcctgcctcagcctcctgagtagctgggattataggcatgcaccaccatgcccggctaatttttgtatttttagtggagacggggtttcgccatgttggtcaggctggtcttgacctccttaccaagtgatccacccacctcagcctccaaagtgctgggattacaggcgtgagtcacttcacccggccatgtctgttatcttttaagtagtcatccttagtcgcttttacccagctaccgaagtgctgtagaatagagttttcttttttgtctttgtgattctctggcactggtaaaattccatcttgatgtccttagcaggtcatcaaaattatgatgaaaacaagttacatttgtccttgaagagaaagttgtggatgactgacatatgtagggacttgatgatctgtcacacagaggattttagatgaaatccttttgtaccactgtctgcaactgtgttgatttccttccacattggatgatagctctggccagggcctttttgttttgactgttggagaggaggttagcttgtgaataattggttattttttagcatgtgtgaggctgatgggcagtagaaagttcctgaaaagaagtttcttccttcaaggcagtgtaatatagtgacgagaacaggggctttgaagctagcagacccgggttatcatctcagctctaccacttcctgtgtgactctgggcaagttacttaagctcccagtgtctcagttttctcttcagtaaagtaggcataatcttaccactggggttgtcaagggaataacatgtaaactgtttagtgtagtgcttggtacagaatgagcatttaataagaacagttactaatatgacattactactgctgttatttaaatagtttttaacagtattatcaaaacagcaagcacagttcatggtggtaaatgccctaatggaagtgttcatctgtcaccattgagaagggaactgttaatatccactgactgttactgacagcttcataaggaccttgtgagatgagaagtacttttcctggtagagaggggaaaggtttcctaggaacatcagccatgcagaagatcaggaaactagcaggctaaggctgcagcaccttattctctgtgtagtaaggccagtaagctttcgtttgtttgtttaaacaagggagccacctgtgcagatcattcctggtggcagtttgtcaccttgtttggaggagatgggccaaaggcagtgacccgtgagtatatcactgcaagagccgaggtgtgagatgatggagcctggcacgtagcagtgggaatggagagaaggcaggcagacctagacaggaagcatgaagttgcatgaggagcatgggcttcagagtggcgtgaatctggaagctgaatcctggttcccctactttcctagctgtatagccttgtgtgaatttatttttttctttctttctttcttttttttttttttttggagacagagtctcgctctgttgcccaggctggagtgcagtggcacgatctccatcttggctcactgcaacctccgcctcctgggttcaaacaattctcctgcgtcagcctcccaaatagctgggattacaggcgtgcaccaccacacctgggtaatttttgtatttttagtagagatggggtttcaccatgtttgtcaggctggtctcgagctcttgacctcaggtgatctgcccgccttggcctcccaaagtgctaggattacaggcgtgagccaccacacccagcctccttgtgtgaatttcttacttcttggaacctcagtttcttcctctataaaattggagctattccttagggcttctgagagaattgaattcaattgaacaacccttgctgctgtgcctagttttggtctgtgttcagtaactgttaaccttcatctcattccagaggactgtttaaggttgagcttctaggaattagtgctttattgcgttgagagagagaaaaattgaagatgactttgaaatttcttccttgaattaaggtgatactattaagcaaactaggaaatacagagaaaggggcagaatttagggaaaatatatgttgaattttggatttgttgaatttgagattctgaggaatctaagtcctggctttaaaggacacttaaatatatgtttagaggttagagctagaagtacagtcctgagattcattggcatacagacagaacttgttgtagaaagtgaatgatttggccgggtgtggtggctcacgcctgtaatcccagcactttaggaggccaaggcgagcagattgcttgaggtcaggagtttgagaccagcctgtctaacatggtgaaaccccatctctcccaaaaatataaaaaattagccgggtgcggtggtgcatgcctgtaatcccagctactcaagaggctgaggcaggagaatcacttgaacccgggaggtgaaagttgaagtgagccgagatcgtgccactacactccagcctggatgacagaatgagactctgtctcaaaaaaaaaaaaaaaaagaaagaaagtgaatgactggccgggcggggtggctcacatctgtaatcccagcactttggtacatcaaggcaggcggatcacttgaggtcaggagtttgagactagcctgaccaatgtagcgaaacctgtctctactaaaaaatacaaaacattagggccaggcatggtggctcacgcctgtaatcccagctacttgggagtctgaggcaggagaatcacgtgaacccaggaggcagaggtttcagtgagccgagatcatgccactgcactccagcctgggcaacagagcaagactccgtatcgagagaaaaaaaaaaacattagccgggcatggtgacacacacctgtagtcccagctacttgggaggctgaggcaggagaatcgcttgaacctgggaggccgaggttgctgtgagctgaaattgcaccattgcactccagcctgggcgacagagcaggactccgtctcaaaaaaaaaaaaagaaagaaaaagaaagaaagaaaatgaatgactgaggagagggctgagcatggaagccttcaaaaaccaacagtagaagaaaacgctagctgcattgtagaggaaaagagggaaagggagagattagaggcccaggaaacaacaggaggctgtgagagtgtttctacacgtgtgcctcaaatcctcaaatcacctgttttctttttattttattttatttttttttgaaatggagttttgctcttgttgcccaggctggagtgcaactgcaacctccgcctcccaggttcaagagattctcgtgcctcagcctcccaagtagctgggattacaggtgcactccactacacccggctaatttttttttatttttagtagagatgggggtttcaccatattggctaggctggtcctgaactcctaacctcaggcgatcccccgctttggcctcccaaagtactaggattacaggcgtgagccactgagcctggccaaatcacctgttttccattgggcaaaattataaaaattctttcaaacaattaaaagccaaaaaatatttaataggagttgagggtgcattcaaatacatttgaggtgattttgaggtggggcctccaaaaataagtgccagtgacctaggcttcaaaatagcaccaaacctacagcagcatcacctgaggcactaggcaaactccagactcctggcctccatcactatcccttctcttatcgaatcttctttcctccacaggaagtgggagtgagacccaggcatcctcattttttaataagtgctcaaaggccgggagcagtggctcacacttgtaatctcagcactttaggaggcctgggtgggcagatcacatggtcaggagttcgagaccagcctggccaacatagtgaaaccacatctctcctaaaaaacaaaaattagccgggcatggtggtgcacacctgtagtcccagctactcaggaggcttaggcaggagaattgcttgaaccaaggaggtggaggttgcagtgagccgagactgtggcactgcactccagcctcggcaacagagcaagactctgtctcagagaaaaaaataaataaatatgtgctcaagatggtgaatgttggaaaacgcttggtcaggcgctatctggggatgtgatgctgcaagccacactgaggcagtggggaattttagggacagtgatgtgttgtcttttgtgatcaatgaagcttatcaattatatagaaaaataattattataattcccacctcattccttctgtttgcttttcagtttttttaagaccttgttgtgagtctttcattcattcaaaattggatttctgttgccaaaacatctttttaaatgtggaaagcatattcagcctgttgaaaaacaacaacaaaccacccattaggaatccagtggcagactaacctgccccactggaacttgctatggacacagtcagttactcccctctggtgattctgccttttatagcctgttctcttttaagcaatctacaatgaaattgcattttagaaagccaccaccgcactccttttaaacattaaatacaatgtttaaatgaccagtcattttctttgattcctagtgtccattcatcattactcttctcaaagtttttttactgcttagagttggtagatatatgtactgtcctggtgttccaactacagctttctttgttttactggttctatttctttctttcttttctttctttctttctttctttttttttttgagatggagtttcgctcttgttgcccaggctggagtgcaatggcacaatctcggttcactgcaacctctgtctcctgcagttctcctgcctcagcctcccaagtagctgggattacaggcatgtgccaccacacccagctaattttgtatttttggtagagacggggtttcaccattttggtcaggctggtctcaaactcctgacctcaggtgatccacccgccttggcctcccaaagtgctgggattacaggcatgagccaccgcgcctggcctactggttctatttctttttactccctaactgcggacattctctaggactttgtggggctttttctttctctgagtaacttctaagaactgatcattgtcacctgtgttagctgttctctcagtatccatgtccagttttcttggcttatctttgccctgctgttgtccacagctgaaaatgtctttcattattactcttctgaaacttgctttgcctctcaagggtcttctctttcactcaagctgccattctcctagccatttgtggcttgacaccccaagagctttattctctcttttcattgcttgagtccaccaagataccaagttaggtcaccttttattttaaatcagccccaacgagggtcccctccttttcacttttactcctctgctctaatccaggtcttcataaatttttgggcttttagctgatttccctgcctgcctctttcaaagccctttacccactgcggaatcatatttaccatgcaggactgccactggcttcctcctccaaaattcgttagcctcacatttgaggcttctccataggtgttcacccatgtcacctgctcagctctgtgtgtgctgctcctgcacagcacaaaccctccacatgaggacagctggtttcacgtgtccctatttctgccatgagtattcctctgctcttcttgttccttctgccctccacccatcttcccccaccccttacccatccttttcaacatcactcagtgcccatctgcttcacggtgtctttcccagggctctgccccacattcatcccattcttcttgatttgaataccttttatgtaggagcactaactttgtatttcattatacagtttctatcaatccaaagctccttatctctaattctaaatccaacaagtttggaaaactgaaagctttttaatagtcttggcacaaaactcaagcaaaacctccctgagtagatatgagctgtttttaaaaaatatatcccatttggccaggtgcagtggctcatgcctgtaatcgcagcactttgggagaccagggtggaaggatcacaaatccaagagctcgagaccagcctgggtgacatgacaagacctggtttctactgaaaatacagaaaaattagccagtcacggtagcccatgcctgtagtctcagccactcgggaggctgaggtgggaggattgtttgagcttgggaggctgaggttgcagtgagctgagattgtgccactgtactgtagcctgggcagcagagcgtgaccctgtaaatgtatcccatttacagtgactgttcatatgttctgctgcagaaatacttgtatgtctggttgtggggtaattggacagaatggaaagtgaagggaccttatcaatttgctttttggagctgccagatttctttagtattgtccttctcaaactggggtatgttaccccggagagtatggagggattatagaaagttacagtatacgtatgcatgattgccaggaaggtcaaatttattagatgattcgaagggggaaatgaaataataaaatatatatcatggcacaaaatacaaaatttccatgcattgaaaagataaaatatgagatttcaaagaaatttaggcactgtgggaggtggggagaagcatatcctcattatctgcttcagctagaggtgttaaagcactgctctcagacagaattctgacagtttgggttgttgcatttctgagtggctggatttaggattttgtacttgcagagttctccaggaccacacaagatggcaaaaatttctgagacagtgtctgtgtcgaagaaggaataacagtagtgcatcagtcagactgactcaaggaaggaagaagcataaacattaaggccgcaaaggttacttagaaaaatcactgtgtcatcggtgaaaccctgtctctaccaaaaatacaaaaaattagctgggcgtggtggcatgcgcctgtagtcccagctacttgggaggctgaggcaggagaattgcttgaacccgggaggcggaggttgtagtgagccgagattgcaccactgcactccagtgcaacagagtgagactccatctcaattaaaaaaaaaaaaaatcactgtgtcatgaggagaatcagcttgacaacacaggccaattaggatggttttcaaagttgtgtcttaagtgaaataagccagtcacaaaaacacaaatactgtatgatgccatttacatgaagtagtcaaacctgtatagacagaaagtagaatggtgggtgcaaggtcctgggggtaaggaaatggggagttattgtttaaagagtatagagttccagttttgcaagatgaaaaagttctggagatctgtttcacaacgttgtgattatacttaatatcacctaactgtatacctcaaaataatcaagatggtaaagtatatgttatgtgtttcttaccacaatccaaaaagaagttgtgtttcaaggtagcctgtaaacatctcattactttttgtttgtttgaattaaactttattacaaatgttctttctcaccaggttttgcatggatatgttattttgctgtgttctgttttgttttttaataggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtaggtgattgtaaatttcattttccatcatcttctgttatcctcacggtcctccagtatagtgtcagctttcctttagaaagagacagccttgtcttttataatcagtgctcttcactagtttctattttacttcctgactttttgatcccagttcattttcatttattttctcttgttgtggggaaaaagaaagagagtagtgaaactcaaattattaatccaaataatacccattacttagcattgctgtgggaagagattggaaatattttttccattgaatcttttttatattcttggcgaatgtctcatattcacaagagctctgtcacattctgccatttatctatccatacatatattatctatgtagcatagataatcagaaattggatggggcgccttgggctcaacaaagagaagaaaactattcataagcatttttgttatgaacgctgctatttctgacttgtcattgaaaatgtgataatgcttctgtccaggtgactctgctgggctgccagctcgcttaacattggagttcagtgcttttgacatgtgagtatttatttgttcaaaatctgaagtaaagaatactacttttggcaaggaataagcatgcttgcctccctcataggtggaccacaggaggactagggaagttcccggtgggcagagtcagcccccctcatgattctcttatacctcccatagagatgagtgctggatacttaggtctgcctggttaatttttcaccacctatttatcagagtcaattaggtgccaggtgccatctagattgattgagacatagataatatccctcttgattttgattgtagttaatattttgtgttcttttcttgatacctctcttgattcactcctttagtccatgggcattgtccatgggcattgatcaatgaatgtttattagtctacttctgtatacaagccactgtgcaaggcattatagtgctatataaaggaatatgatagatatatccttgaagaatttttttaaatctgcttgggagctgtggggagttgctggagagaagagacacacttttttttttttttgagacaggatctcactctgtcacccaggctggagtgtagtagtacaatctcagcccactgcaacctcttcctcctgagttcaagcttttctcgtgccttagcctcccaagtagctgggactacaagctcacgccatcatgcctggctaatttttgtatttttttggtagagacagtgtttcaccatatttgccaggcagatcttgaactcctgacttcaagtgattcgcctgccttggcctcccaaagtgctgctgggattacacgatcgagccaccacacccagccaagagacacatttattgagcacttaattaggcattttcataaacatctgttctttgagactcgccaggtgtgatttttctctcttttttcagatgaggaaagcatgggatgaaaggtaaaaatggcttgcccagggtcacacctggccaaatttagaaagcaggggtgagagaaaaaaatgtatttataaatgtatttctgaaacacagtatgagtagctacagggattttgctatcttctacagaaatagagaaaccaggagggggatacaaatttaggaggagacaagtttggtttagaatatgttgagtttgagatgacagtgtctgctagaaatgtccaggaggaactggagacggggagaaaggatcagactagatttgggagacatccaggtagaggagaaagagaataaagatagtctccaacttatggtggtttaatgactttttgactttacgatggtgagaaagcgatacacattcagtggaaattatactttgtggacccatacagccattcggtttttcactttcagtacagtattcaataaattacctgagatattcaacactttattatggaacaggctttgtgttaagatgattttgcccaactctaggctaatgtaagtgttctgggcacgtttaagggaggctagactaagctatgtctggcaggttagacgtattaaatagagttttgatttatgatatttttttcaatttatgatgagtttatcaggacatggtaagttgaggagcatctgtatagtataagaacaaaaggcgcaaacagtgaatggctctaattagggaggtgaaagatgatacagaactagcgaaggacacaggggttgtcagaggaaaaccagaaaagtgttagagaaaccaaagaaggcaatgctttctggagggaaagagaaactaacagtgtcagaagcacagaggtcaatgcgagggccactgtgtttgttgattaagtcattgtggtccttaagaattcagtttgagaaagagggtggagctgaaaccaagatgagggcctttaagattattgagaattgaaaaaggctacagtgttttttctgctttattgtacctcagcagtatcaagatggggaattttaggaaggtgaagaagtcttataggtctttctggcttttgaaagtggcaatggtcaactattaggatatttaaaataaagtgtccctagaattttttttaatctcagaaaatcaatactttttttccctttatctcaatccagttgcaaaatttgaaagcacgatgtacatccacaatgattttagtatttgtatctttaaaaatgtatgtgttggtgtttcttgttccctttggagctttcttgctccatcgtaaactgcttgtggttacctgtcaaaagaaataaaatcctaataatctctctcttgttttggcaaactaacttattttggagccagtaagatatgacgaggaaactactggaaatgtacaagcattaaattgtctgaagatggtacgggggagcatcaacagtctgttttgtgtaatctggagagcctcatatttatctcagactaacctcactcctatccttatccttctactggactgtttgttttataaggttttaataattttattctttagaataattaattagaaaaatgcagttcacagaagttaggtttgaacttactacaaaatgtgagcatcttaaacttaattaatctaaaaattttggttgaaggagataagaaaatctgtgatcctgcagctatgactttcacacaaattgctcattttcactcatcatattttttctttaaccgttgaataccctcagtgtgcaaggcactgtggtagacagtgggatgtgaacagaaataagatgtggtccccattgtgtgaaaatagccctggattcgaagtttgaagatttggaatctatggctaattaactgtgctacttcaataagctcttttagttttctcagcttttgtttcctcatctttaaaatgggttcttgctttctaatgttctttccagttttaaaagtctgtcactttctgagtccctattaggatggctgagaagtttaatgaaagtgcttgggacttctcagaaggcctgatttctttattccaaattatttcctttattattaccccatttttcttttgattgctgtatatctgcatgggttggtagagaaagtctttatgaatttatttatcaaagaaggaatatctacaatgtgcagatgtgtgtgtgttaggaatacaaagacttatgaaatatgttctccagagctcctctactgtatgagagagagaagtagaaggcaaatatttgcattatagtgtgctcagtgctgtaataagcatggagaggtaatcattatttcaggaaaacttattgattgcttcctctgtgtcttgataacagaatgtgctaggtgctgggcatacagacaggaatgacatacagttgaatagctaacaatcccagtactcacttatagatgtcaagagtatctcagctttgcatagcactggataagtctcttctactctgtgcccctgatagtcttatggatctctaaggatcctgttctctgaattgtattagatgaattgtcagtcaagtagtattttatcaggcaccaactgtcttaaactggaatatgctgtcttgagttagggtatcctgctgaatcagacccaaaaatgtaagggcccaaacactaagaagttcatttcttgctcatcaaatagcccagggctgctggtccagtcttcttccatgttgtggctccattatccctgaggactttgcattgtgtgctgattaagacagttgtcactttcaggtaacaacagattaatgaggaaagacagccaaggtgcaaacaggtggaagagacacacttagtctcttaaaggccctggagggaagggacatttatcactccactcagattctactgaggagaactcgtggcctcacttgtcttgcaaagaagactgggaagcgtggaacccagctaaaacgttatgtgtgctttctgtttctgttgacaaggaggaaaatagattttgattgacaatctctatacctatgtgaagctgagaaaaaaaaagaattttccgccaggcgcggtggctcacgcctgtaatcccagcactttgggaggccgaggcaggcggatcacgaggtcaggagatcaagaccatcctggctaacatggtgaaaccccgtctctactaaaaacacaaaaaattagccgggcgtggtggcggcgcctgtagtcccagctgcttgagaggctgaggcaggagaatggtgtgaacccgggaggcggagcttgcagtgagccgagatcctgccactgcactccggcctgggcgacagagcgagactccgtctctaaaaaaaaaaaaagaattttcctttctctgggcctcaaatgatcaacatttgaatgaagaacatttctgtgggtttctttcccttgaggaatatttgtctttattcataagaaattttcttttcggccgggcgcggtggctcacgcctgtaatcccagcactttgggaggccgaggcgggtgggtcacgaggtcagggatcgagaccatcctggttaacacggtgaaaccccgtctctactaaaaatgcaaaaaaaaaaaaaaaaaaaaaaattagccgggcgtggtggcgggcgcctgtagtcccagctactcgggaggctgaggcaggagaaaggcgtgaacctgggaggcggagcttgcagtgagccgagatcgcacgactgcactccagcctgggtgacagagtgagactccgtctcaaaaagaaaaaaatgtttttcttttctatgcctcaagttggacctaattagagaaatagaaggcataattcttgccctcaaagaactgaaaaggtagtgaaggaagtaggagtcttaggcacactcgtgtgtggggcagaggctgtgtctttcttattctctgctgtatcaccagcacccaacacagatctggggtgtactatttgctcaataactgcctaattgaattacaagcggtctaagcgcatggctgtcaaaatcacatgtggtgtggttgatggaaagacaccagtggactgtgttagaggatgttacaaacagaaactctgcgattgctagggaagtcaggagatgacaaagaagcatgacccccaactgactgtgactttctgggttcccagcgttccctgtgggcatgtgaagctgtgtgcgaagtagattcctccaggtatgatgagcacaggtgctcttccagaggatttattccgttctgaccacctgcctgcctgttggccaagtgtaaataactggtgcaacacagccccagcactttcctgagtcatcgctgtgagactgaatgaagtgaaggccaagtgtctagctgtaatgtccccaaagcaggcccagtcttccggcctttgtgagatccatttttactaggttagtatacgcattatcgcaagttcactattggccttagtatgtggagaaaatttctaatttgaattctttttaggagctatgttgagatataattcatataccataaaattcaccccttagtttaaaggggtacgattcagtggtttttagtagattcatagagttgtgctgccattactattaattccagaacatttccatctcccaaaaaagacacccttagcaattactctccatcccccctcctccatactcaccagccctagccaaccataactctactttctgtctctgaggatttgcctattctgcatatttcatgtaagtggaaccataggaaactaaactaggaagtgtcagaaccaagatttgaactaaattctcttgtctccaagtctcaggctccttccctctcattatcactttttaaattcattttcctgccacctcccatggtggaactttagtcatgaaagatgcttctcctttgaagcttccgattgtcctggctaattaacttgcataagtgctgatgctcctaggagcctagccatcttgcagttgcttgagttcttggtatgcagttttctcctttcacaaaatgaggctttggtatggctctcacacacctgggaagtttgggaagaagggtaccttcctcttctgtgcttgtgtccaaattagatcatggcattcttccttctgtttccacatcctgtttcagcagtaatttcataaagccaagtctgaatgtagaaggcctagtttaccaactgctctgctttctttgccttccctctgggcttaatcttttccctttgtgatttctctctcttcaagaccagcttggatgtcctcatctcacctggatgaaaaatattcttttattggaggagcatggtgacaaacaacttgtgatttgctgactcatacctcccaagagaaggttctggccattgaaagctagctctccctgaggacttggcatttgagcctgacagacggcatttgacagagccatgtcattcattgcaccccttcatacctgttctaggtttagatttctactctttcagccccataaacccaattttacatggactttaaatgaaaagacataggttcttctaaactatgcagctgtcatcagtgcagtcagtgaaaaggcattctgtctgcattagctgcgacaacattagtaggctactaatgaaatgaatattttcatttaacatctgtaaactctgaaatgcaagttaatcatttcagagaagagaccagatttgtccacatctgaattcgtattcagaatcaactcctcttctcttctcctgactttgcttactctgaggactgtgaggcctttgggggcaatgtagagtgtgtaaacctggtggcacgacagattgacaggtagcccaggtgtgagacattttgtctgcagacaaccgtcaggggcttgcccagcagcagttttgtgcagagccctgtttggggtgggctaggttgtggggcagtcaggagaacacatactttctatcctcaaggagcttagtgtcctccagctgggtgggtatgactgtagttcttgaaaatgctagaaaatattatgctgagttttatgtgccaactcttagcagagaaagtggagatagctttccggaagaggagagattgattagagcaggaccttgaagcctgggagggtctgagaggtggcgtaggcacagcacagtaccttggactcagctagttctggttttagattcaagctctgcctattattatgtgaccttaggcaagttgcttaaacctttaaatgggggaaaagagctgttatgagaattcaaactgtgcacagctcaacaaacaatatttccctcaggttaaaggtgggaaagaagaacaaataggaaatgaacttctctttgggggacagtagaacagcatcctgataggttagagtatagggaatatataggcttttaggggggaatggtgcctgttttttagttcttgagttatgatattcatctttttccaagaaaacatacagttaatcttctgtttgccctgcagagcaataccctttttatcccactacagtggtggttgacttgtctctccctggctgagtcccagctgtgcctgactaaccgtgtttctcttgtatctaggagtgctcccaccccagcccgttgctgcccagctattggaacactgtataacaccaacacactcgagtctttcaagactgcagataagaagctccttttggaacaagcagcaaatgaggttagctgtgaaaacgtgatgtatgtgtcatatttcctgtggtcctggcaggtgcagtgtttgtgatcaggcacatgggtctgctgcagaaactggcatatgaagggaacttaaagacacttgtgggctttggtatatttctccagagagaatactcccagctgtctccttctgtattggcaggaaggtcagggagaggacatccaggctctcacctgggataggctggaaataacatggcagggcagaggttaagtaatcagtttgctgctcatctccagccagcattttgaagcagccagacctctgagagttgtgttcctgtggctgaatgcctctaggcactctgtttattgtgccttggagaggcttggcaatcctgtgcaccatggcggtagaggagattatcatgtagtctctgcagtgtcttcacttatctactgcatctgattttcaaggcctctgtggcctggccctgttttcctcttttcctttctgacctctttactcttgcccttgcattctctgagtctgtcatagcaaatcacatgtaattccttctacctactttctgttctgtcctctctccttgggaatacaatatcctctctgcctggaatgtctttcctttgcttctttacattggagttagtgagaggaattaaaatgggaggtgggggcagtttatcccaatcctgtctaaccgctgtaatcaaggagtctttataccagtctttatcacgacatgaatcttgttggtgtgggtgcagtggtcaggtcctgaggcaggcttccttcacatccctcgggatggacgcagctgtgactcaggagaggatggtcgtttttcttgacctgtggcttgactgctcctgggcctcctgctttggctgcacatttaaaagggagtctccaaagaattgggtcaggccttaatcatcttggaaaaaagcaggctccgcccccacaggaatatcccacccctcaactggggcccagaattctcctagcagcttctgccccatgccccctcggcttaccggaaactgggggcctctcttcagtggtccagcttctccaaggccagtatgtcagtagcaggaacttacttctgcttacttatttccctcttccacccacacttagggaatgattcttattagtgcaactgttttgtcttgcttagtaacaccaagtttagctacgaatcttagctacaaaaacatcttgtgatccacagctgctgaccagcaccagcatttgctcctagtctcagtacttgctgagtatacataaatttgaagtttgttcttctttcttcatctctcagggcaagataatctcaaataagacttcaagaaacccctatgtgtatttcacagcatttcctttgagagcccctcccaggctctttactctccccgttccccagcagagtctgcagaggattcctcccataaattctacctacttctgtgacagcaaatcctacatggtggtgaagttatacatttacgccagtctctctatctagactgcgagtgtcttgagggtagggactgactgtgtcttttatttctgtaaccctgatgtgcctggtatatagtagacaataagtaaatatttgctgaaggagattgtgaaggcatgaaaatggcctggttgccccctcggtgctgagatctgctgagaggaggcgcctgggttccctcacttggcttagatgttgaagggagtgtggctgggagagaggcagtgtgaagtcggcagagtgaggtaacaacccacttcattgtttggggtaagtggtgctgggcctgtaggaaagaagagcctggtgcttttcagctccacacttcacctgagagtgagaaactcagagatgcctggtaacctgccttgatgcttttcttcttcttgcagatatgggaatccataaaatcaggcactgctcttgaaaaccctgtactcctcaacaagttcctcctcttgacatttgcagtaagtaaatgggctctcggttgcaccgaggttggtgaaatcccctggcttagcccagtgtaccagtagaacagtctgctcttctctccgaagctactaccttctgttacttaaataatagctgttaacgaaacgctcatttgattagtggccagatagtgctggcacctattaccaatgctaacttaattcacccctatggatcatactggcagtaattgcatagtttatataacacagggcatgataaagtcaggttcagggaatgtggtttcattgttgctaacgcctttgttaaataccatcctaaataccatctaaataaaggaaaggtgcttctggattagaggagatcacactgcatagcttgaccacaaaatcgcttgttgatttttttttttttgtttttttaaagacagaaacatgttttctgtaagcgaaatctaattaaaatgaacgttaagggcagccttgaaaaggaaatcgtattagggtaacatgtgctgcccagtgaagaaggggtaggatgtagatggaaggacctggccttggtgagggaaaagtagggaaaaggtaagggtcgattatagagataccagctatgcatgcatgcgcgtgtgtgcgtacacacacacacagataccagttatacacaggcacgtgcacacacacagcaacacacagatgtgtgtatatatatctgtgtatataaaactaatttatatcctttattattatattgactatataacattctgtcaaatgtatgtttcatagattcctgttatatatttaggtggtttctaatattcactgttataaaaaatgctagtctgggcacagtggctcatgcttgtaataccagcactttgggaggctgaggcaggtggatcacttgaggccaagagtttgagaccagcctgggcaacaccttgtcacttcaaaaaatataaaaattagctgggtgtggtggcgcctgcctgtggttccagctactggggagctgaggtgggaggatcatctgagcctgggagattgaggctgcagcatgccatgattgcaccactgcactccagcctggacaacagagtgagaccctgtctcaaaaaaaaaaaaatactgtggtatattgaaaaatatataatattagccatattgatcttttctcctgctcattttacttctttagaataagttctttggagcgggcatataaacacagtaatgttgctgtgtattaagtgtgctgtttcaccacagcatcatcagctttggacattaatcctctttcccacttctttttttggcaagttttccttccccgacctcccaccgttcctcctagattcctagatgcaggggaggcctctgatttattgcccaaggcaaaggagggtatgatagcaatcaaacaaggccagtgggtggctatctacaaggaacacattttctaacaagttataatgctttctatgtaatagtggaggagagagaaaaatgtttaaattttttgtctgattacttggctcagtttggcattaataatctgtctatacgtttgggtaattctgtagttttttttttttttttgagacggagtctcgctctgtcacccagactggagtgcaatggtgcgatgtcggctcactgcaagctctgcctcccaggttcatgccattctcctgcctcagcctcctgagtagccgggactacaggcacccaccaccacacccggctaattttttgtatttttagtagagagggggtttcaccgtgttagccaggatggtcttgatctcctgacctcgtgatccgcccgcctcggcctcccaaagtgctgggattacaggcatgagccaccgcatgcagcctgtaggctctttactgggataaattgtaagcattgctagttaaagatttctagttacttgaacgtcagtacgctttctgtaccaagaattctcatagtagaacatgctgacagtttgcatttaatgagaaaaataacattagctcttacttaaagttttaaggtttgcctagagtcagtatgtgtgttggtcttgctgccttgtttactgagcattcttagcctgacttaaaaaaaattgtaagtatctactttttaaaatcttcagacaccaaggactttatgtttaatttaatggaggtcatttctatcctgaaaagaatcctaagaaatgcaagctttttgacttttgaaaatgacctgataaagtttcttagaattcgtgaggtccggccgggtgcagtggttcatgcctgtaattctagcgatttgggaggccgaggtaggcggattgcctgagctcaggagtttgagaccagcttgggcaacatagttaaaccccgtatctactaaaattaaaaaaaaaaattagctgtgcatggcagcctgtagtcccaactactcgggaggctgaggcagaagaattgcttgaacctgggaggtggaggttgcagtgagctgagatcgtcgtgccgttgcactccagcctgtgtgacagaacaagactgtctccaaaaaaaaaaaaaaaaagattttgtgagtttcttcatcttgaattgtttaaccttttactaaatatcggttatgacaaatcatttaagtacaaagaagagaaaataatctctggaggtgtttttgctttccttctgctgttttttaggactcataggactagacagttcattaatttcagctttgcagttcattttgccattgtgaagagggaattttttcttagttgatcaatgaatagcagaattagagaccgcagagattacaattattagactttctcatctgtacacatgattacatatacatttacattttaaaagtcatctagtatgatttcatttatatgaaaagtccagactaggaaaatccacagagacagaaaatagattagtggttgccaggggatgagaagagggggaatggggagtctctgctaatatgtatgagatttctttttggagtgatgaaaatattctggaattaatagtgatgatggtacaaccatatcactatactaaaaagaaaccactaaattgtatactttttaacatggtgaattttatggaacgtaaattatatctcaataaaaagtcatctaacaaccatccaattttaattcttagcaagattcaagaagaaatattaattagctacataaactgcattcatattcagtggtcacaggcttgtaggcaagctgccaaatacccacatatgtctggaatgctaccatgaatttaattaaggccccaaaagctgtaagaattctgaagcaagagccattagcgtgagtgggaacagtgtcaaagacagcctcacaaatcctttcccctggatctcctaccctggtgggggatcggtcagatatacccgtgaagatgtaacctcttctattcacccatccagcttactacttagagcctctccatggctctaatcatgcactcgctttatctctgctctgtccacaaagtgagctgcctggtgtctgggactggggtttattcatcttattgtcagtgtcttatgttttgccttgtacatagcaagggcttgatagttgttgacttaaatccactaagccatttacaaaagcaatattgtattatttcaggcatgcatacatatgtgaatagcacagcttccttaataacatgtaatttatttgattgtgaagagaatggtaactgtttggaagttgtgcttctgtagatagtacattaagtatctatggtcagtggaaaaaagcttaagttttggaagcagagttctgatctcttctctgccccttgccatcttttttgttgttgtttaggttttttacccctttgtaagattcagttttctgtttataaaatgggataatagtaaatacctcccaggggggttttgtaggttaaaggatgatgatgataatatcaattacatattgcacattttctgttagcaagtggtcaataaagtatattatgtttgtcatcatattattagtggtggtatatgagactattttgggaatacaaaagtcctttatttgatcatgagttctgttggggatgaggatatttgataagctggacagactttgtttgcatagctttgctatcttaattggccttgagaagctacattaatagatgcatttcaccttaagttaatggtgctattctaataacttatttatacttttttttctaggatctaaagaagtaccacttctactattggttttgctatcctgccctctgtcttccagagagtttacctctcattcaggggccagtgggtttggatcaaaggttttcactaaaacaggtatcaacaaataaccaaaatgcacataaaattgggttgaatgtgcaagagtagttatgtagttctttccaaagacaaacaggcacttctctggatgaagacgtggtaactgaaatcctccaaaggtggtactaggagcagacttatttagaaaatgtttgtaaagtcatttttttgtatatatatttatatatgttttgagactgggtctcacccccattacgcaggctggagtgcagtggcatgatcactgctcactgtagcttcaacttctcaggctcaggtgatcctctcatctcagcctcctgagcacctgggactacaggcatcccatcacacctggctaatgtttgtcttttaatagatatggggttttgccatgttggccaggctggtcttcaacacctgggctcaagcaatctgtccacctcagcctcccaaagtgctgggattacaggcatgagccaccctgcctggtctgtaaagtcattttgaagatgtagtgcacagtaattttccaggttttcagtggtatttggtgaaatgctaagccagtaagggggaattataggaatattttgaaacactgaaagaatttaccaaaatgtggtcttcattttcaatgtggggaaacataaggcagtatagtctgggaaagagtctttgaaacaaaacagaaggcattctcctacccttgtaccaagttgcagaacttttctacctggagcagtacatgcagagttagtcggtgacatttgggatagataataagttcattagagatggttcccagaagagcagttaaaataatcaggctggtataacagagaccctaaactagagaattcttattgttgttaaggcaaagattatgtgtcaagatgatttgaattcttgaaacacatcaatcactaaagccctgaatactgatgccatcattcagggagctctcttggagctgttcagggagcagccattattgattaaattttttttgttgttgttgttcgtacaaatccgaggttgtggttttgtggaactaatttcccaagaggaaatataagtaaggaaaaaggattttggctgagtattgactgctggcaggtatggggtttcttttattgaggacaaaaatgttctgtaattattgctgtggtgcttgcataaccctgtgaacatactaaaaaaacaaacagcacattgcattatgtactttaaatgggtgaattgggccaggcacggtggctcacaactatagtgtaattccagcactttggaacgcagaggtgagcataccacttgagctcaggagttcaagaccagcctgggcaatatcgtgaaaccccatcgctataaaaaatacaaaaaagttagctgagcatggtggtgtgtgcctgtggtcccagctactcaggaggctgaggtaggaggattgattgagcccaggaggtcgaggctgcagtgagctgtgattgcctgggtgacagagcaagaccctgtctcaaaaagtagtaaatgggtgagttgtatggtatgttagtcatgtctcagtaaagctgttgaagattatggaaaggttcggggtaaaattcatcaggggtagattcatgttgggttatcataggagagaaagaatgtttcgttaccgctctaaaactctgattgacagcttagggaactaccatgttgtagtccctttgtgcccctaagacacacaccaccatgcccctggaaagtgttatataaaagctaagtggtattatttggaggcacttctatgttcacttgctgtaatagagtaagaggagtgtgatcagtcatttctagtcttctggttttaaggtaccttttttttgagttagtttttagcccagaactagaaatgtaattttctagagaataacaacgtgttttctgttttcagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaaggtcagataaactttgagtatcattttattatatagttttttaaaaaatctgaagttcatgttacaagagaccactgcaaaattcaaacttgtttagatttccttagccttcaaaggatgtttaagaacatttccttatctctatcctctcccacccctacagttatcgaatcagctcctctaggtttttctagctctactacagctcagaataattttgataccttactctttttttttgtttgtttgtttgagatggagtctcgcactgttgcctgggctggagcgcagtggcgcaatcttggcttactgcaacctctgccttcctggttcaagcgattctcctggtcagcctcccgagtagctgggactataggtgcccgccaccatgcctggctaattttttgtatttttagtagagacagagacgaggtttcactatgttggccaggctggtcttgaatgcgtgacctgcttcggcctcccaaactgctgggattataggtgtgagccactgtgcccagccaataccttactctctattagtgctaaagttatttccgttttccctcctgatgtattttaccctctatgttttaatttttattcccagaactaccctgtagttcaggcccctcatatcacactcctggacacttagaatcttgtttccatgttgtgcaacactactgtagaagaatctcccttgaactacccacatttagtgtatcattcattgaccaagagcataatggtgtcttccttctggctccaagctgcctttcctgccttatcttccattattttcctcataaagcattgctccagctaatcttatctatttttctccagaatctccatccccttcccgtcagatacatctaaaactttttttgtatctttgtttttcctcgtgttgtatcatcttcctaaaacatgttctacttgtgaaaaccctaagaaattctctctgtcttattgaaattctatctccactgtgaagcattatcatggtgtggccatatatgatctatccctatctgaagtcactgcatttattccctgatcctcatttgcaggtccagtaccttgtacaagtttctttttgtgccatattagactgtaagctccaagagggcagggcccaagtcttatgaatttgtgtctgcatagtgtctagtacttgtctgaggcccacaataaaattcttttgaatgaatgaaagagtaccgtaaatgtcttttagaagtgatcagatatataggaagttgtcttagccatacaggagactatgaattaaaaatatcaaagattatgagtgttatgaagttctgaaatcaaatggaatcatctccatagccatgtgaatatatcagagctgaaaaaaggaaagcctttaactgacggtctggttattctttagcctgaacttaggatgacttttttttttaaaagcacattttaaaatcaactacatttacattttatttttcagaggaagcccacctccccttttttgttgtatttttattagagatggggtttcaccgtgttagccaggatggtcttgatctcctggccttgtgatccgcccacctcggcctcccaaagtgctgagattacaggcgtgagccaccactcctggcccagaggaagccctttttaaattgaggactgaagattgaatttttattaaaattctttcccccaggtgatttcacagaaccacagctaaattagtatagcaataagaccgttaataatttaaagtccaatctagtgtgaagtcctcttgtcatagcaggcaggattaaatggcctgtgtttggaagcgaccgtaggtcaggttgtatgtggtaaataagtggtcctccccaaagtgcagctctgccaaaataataacagtttgaacagtgctttacaattaatttaaaagggactttcacatacttgatctttttatgataagtctgtgaaacaagtgttagttactacctgtggttagttaattagtatctgcattttctgtttgagactcaaagtcacacgaccacattgtctgattccgaagcctatgccctttctttctttctttttttttttttttttttgtttttgaggcagagtcttgctctgtcgcccaggctgaagtacagtggcacgatctcggctcactgcaacctccgcctcctggcttcaagtgattctcctgcctcagcctcccaagcagctgggactacaggtgcgcaccatcatgcccagctaatttttgtatttttagtagagatggggtttcaccatattggccaggctagtctcaaactcctgacctcgtgatcctcccgcctcgccctcccaaagtgctgggattacaggcgtgagccactgtgcccggccacaagcctatggcctttctaccattcccttgaccttggggaaactgcataacttttctttgtattagtttatctgttaaatggtggtaatgccacctccttataaggttttgtgaggattaaacatgataatgtgaataaaatgctgagcacatggtagatgctcaatatgtatccacttcctttatgtttcaacagcagtatattttgaaagacaacaaatctctggggtctcctctgaagtgctctgagggattcaccagaaacctgtccctgagactaactgcctgtctgcttgtcggattcaggcacactatccttcacttggttagggtggtatctcaggaaagcctggaattactcagcacacgtgatgaacacctccttatgggccagaaattttgagatacagttgtacttgttctcacaccacctaaggtcttctagaggagatcagacattgacctgtggaaaattaaggagaaattcaagtaatggaagataagttcagagaattgatacgggtgatactttggttggtcttctatgccttatcttattctaggaaagatcaccagaagccttagagcatgatggcctcataggagttttatagccttcatgctgcctttcctacctgtggccctgaatgttcctgtctcccctccacactgctgtccaagtgcattttctaacgtgtaaatttgatcatgtaactcttctacttaaaacccttctaaggttcctgttgacttcgggataacgttaaaactacttagcttggcgtttgaggtctcttcagttccggttcctgtccaccactagcctcatttaatatttcccaagatacatcctgtgctctggctacccctgtgccctccaaatgccgcagcttcccccatctctctgcctgcagacatctctctgtctcccttctgtcacctggctgctgcctcacctacctttctgattcattaccccaggaagcactggctgattgcttgcgccatttcatttctctcttctgtgttctggtagcagcctccttcctagcactgactagtctccaaagtaattgttgatttgcttttctgcctgccccatatccccagcctgtgagcaactttagcacagaatcttgtttgtccccactctgcgtcctcaacatttagtgcaatgctggacacttaagagacacatgatgtgagaatgctgagaggaaagagagagaattgtggactggtatgaaaattaaagaaggcttttgccgggggcagggccgaaccctagagaaataatttctagacatcattttcagtggttcttgcttttattgcattaaccttgttcactctctttagcatgattccagtttccctttgagccacgacatttccttgaaggttttcaccctcttttttcaaaaataggcattcttttcagtatgaaatcctgcacttgtgttctggcttcatgttttacttgattctgccccctcctcctcctaccagcactttgttccctgaaaagtcactgctgctctttgagccctgtgtcctcatgtgtaggatggagaaatgttggaatccctctgagtttctctcttcaacctgtttctcttctgggttatctcattgtgcctacaactccagaaaccatttcctcccaagtaattcaattttctctcaccggcctgaacctccctctggaccccgggccatattatccagccacctgcttgcctccttctgcaccttacaatctttgccccaaggctggtccttttctggcttcattggctcagaatgatgctgcttctatccagtcacacaagccagaaatctggttatcctaccggacagctgtcttccccctaccacccctgtgtcttgtggatttcatgtcctgaatgtctctcagcctaccaccttgcgtttcttctgccaccacctcaatctctgctatactgcagcagcttcctaacaagcctccttgtatctactgtgggcctctccagttcattcccatatcatccccacagttttccttagaaaagcagatctgatcgtgtccctatcataatgaaacacctgaatgtcttcttccctgtgctctaagagtaggggctaaattctttaatacggcctacaagagtctgtgtggcctggcccctgtgggcatccagccccaagtcattccgtgttccctgccacagggcttttgcatgcaccttttgcctggaactctcttctctctcttttctttacttctacccctccctccccctacctcccctttgctccgttaagtgctcactctttcaaggaaaccttccctgacctctataaaaaggtttattccttctgttgcgagctctcatagcactgtgcatcccttcttcttttttttttttgagatggagtttcactctttgttgcccaggctggagtacaatggcatgatgttggctcactgcaacctccgcctcctgggtccaagtgattcctcctgcctcagcctcctgagtagctgagattacaggcatacgccaccacacctggctaatttttttatctttagtagagatggggtttcgccatgttggccgggccagtctcgtactcctgacctcaggtgatccacccaccacagcctcccaaagtgctgggattacaggcgtgaaccaccacacctggtccataattttacattttcttgagtgatctttgattaatatatttttctcccatttaaatgtaagctctaccaggacaggtaccctatctttgatttcccaccattgtgtctgcatcccatggcatcatgcctggtgtgtaaaatgcaatggaaggatgaattcatgcataaatgagttgtgaagactggagattgctcatgggaagcacctgggtcagtgcctggcacacagtaggccttcagtgagtagagggtagctcttattattagttcattgtaagtgttctctttaatgtgagcattctgttgtctggttaaggccacgtattttacaaagactttcccaaattgtctgtacacctcaatttatgtctaatgagttacacacatggttactggcgtgacaggagacagaatacaggggaggtatatgatctgcatggctgattcagagcaggggttcttaatttggagtagggtgcagatgcgtaatgtctgggaatgttttggaagtaatggatcctcaccctagaaaaatccacatgtgcacacagttctgcgtctaatgtcagagacgcacagagtgctgacatgcttggaggaagatgaaggaaaagacaggagttagcctgcctagtggggagcctatggattgttaaggtcaggaggtgaatgagtcctctttgttccaagtcagagtgggagctttgcatgtggaggtactgttcacttgtgtgtgaagccttggctgactatgagagagtgggtacctgcccctgaagaggacacattgccagccaccaacagctgggactgccatggtctcagttttgaccgtgtgaccagcatgcagctggtcactcatacatgttatcacttatccttacatgccctgcaaagtgagaagtgttgtctgcattttacagatgagatgaatggaaaagagactagggaatggaagcctcttcaaatgtgaatgatcttacctcctacagtgagaatgcttcctatagtgaaaaaggaagcagccattttttttctgctcagctcacaatgtgttggggtagagtaggaaggccagacttcagttcccaacagcttaatgggtcgaaccctctgagcctcagtttcctcagtgtgtataagcatacagtaacaacacccccttccttgtaggtggctgtgagaactaagaatcattaagtttcactcacatgttctaattgttcccactatattttcttagaatgtttttcagttttcattttcaaaggaaaattttctttgattaaccccagtttccagctattccataaaaatggagttttaaggtcccgagtcacacagccaactctgcctttaccaaaggaaggcataagagaagcccctcctgagattggcagggttgccagttcagcagcccccgggacatccaagaaagttttaccagttcactgatggtattgtctttaaatgaaagctcaaaagcaaatgcgcctgtgattggtttcatctcacttcttgggtgatgtatggttgttactgtgattgcttaatgctggagttctttgtcatttatagttaaaaatacctgttataacccaatacatgtctttgaatctgcacccacacatacacataacaaacaagacttttgcaaaataatgctttcctttttctgttttatctttttgaaaaattctagttgtgacccagtaaatgatttaagaatcgcaaatagctcaccacctgcagtttgaaaaatgctttgtgaccattttatgaccattttggaaatactggcaaataaatgaactgtactaggtgaggttccattcattagttttacttccagctatatatctctgtttttaaaatgtcgcaaaggttttcagctattcttttacatttttaggtttttttaatatacaaactttttgtatatttccttttaatcctgtgcattttttaaaactaagattgtacagtattttgttttattgtagcattttagcataatagtattatattctacacaacatcctttttaatggatgtatgatagtatttttaccaaggttttgacatttatatttctcataattttttcactattaggactgctttgtgcatcaaatttttcctctttttcctctccttatcccctgtagttttaattatttccatagaaaagatgtctagatgcggaattactgcgttacagagtttgaggctgagcgtggtggctcacgcctgtaatcccagcactctgggagacctaggtgagaggattgtttgaggccaggagttcaagaccagcatgggcaacatagcagggctctgtctctacaaaaaatttaaaaattagctaggtgtggtggcacacacttgtagtccaagatactctgaaggctgaggcaggaagattccttgagcccaggaatttgagtctgcagtgaactgtgatcgtgccactgcactctagcctgggcaacagaatgaaactgtcaaaaaaaaaagttagaacatgttaaggttcataatcagtggtgtgctggtaaatgtttaacagccagctcttgtgaggtaggaatagtcctgtttttgtagtgttttcttacttgtatggtaccagtactaccaccatggccaattgcaggctaccagtgtgaagtcctggaatgccgaattgaaaagagacattaacagttggctcccagaaaagcctgtatgggccaactccagcacaacactgcttatcataaatgtttccccaagaccctgccagcttccctcctaccagctgtgtacccttaccaggatcagatgttgtagtattgtacacatgtgttaggttgaaaatgggccttaagttcttctctcaatgaaatgtggattccacagtcgcactccattgctacaacagatcaccatctttcaggccagttcttgtgattacattaaaaatagctcataacattgtcccattaccaatcttttggggaaggttacttgactcttctacttcattcagagcagttattgaagattgaatgtttgggaaatgttgtgtaatttcaacaacattagcctttaattctagggctttaaaatctgtggacaagagcaatagccaaggagcaacaatttatatgctgttagttgggctctttcttcacttagtgatctctccgcatcttggcagctgtctgtgactttgaagtgcattaggtatttcagttttttcccccatactttaaaaacgtgtaatctcctttgtgcatttcctgttatatcaagtgtttgagttctaaagacagccatttgttagattagcatgttttatgggatcattgtggaaaatgttcttgctgaagacaagcaagttagcaattttgccctcttttctttctcacagtgtactttttcagcaaattgcttggcagactgatcatgactgaatcatttcaatgaattgtatgctctcagccaagtagaaaggaacatttatttcataaagcttctaaacaaagtttttcttcagttacgttgagcttctttctgctgatttgtattacaaaaggaagtgatttgcccaagttcgcacaattaatttgtggcaaagccagttctaaaaccagaactcctagtcagtgattatttatgaaaaatatttttttaaaaattctgtttaaccgtagtataagctggcttacctagcattgtgccaactaatcattcctccaatgattaagatagattctgagttgattcctaaagcacttaaagattttggggtcacttttgaatcatcaaagaaagattaaatgatgttcagcttagtgttaaatggattttgtcattttcctattcgacgcctgccttctgcacttatgcctcatatgggtaggaaagttaccttaaaccattttcaagctgacctgcttttatgggtaagtggtagattttcctccttagcagatcattcctgctctctatagcccatgttaggtcaggttgctctaagaaacttattcctagtcttttctgctcaaaaaaagatttttttttcactattctaccccattgcctttgtccttagggtaagaaatatgcttattctttgaaattaagcatccacttgtagcatctaacataatattctagtttatataatttagatatcatttagttccaactctacatttgcacatgataaagcctagaccccgagaatatttgatagactagaacttatccctttcttttctttgccagttaagaaaaaataaccttgaaactgaagacagctaactatgtacagtcacatgccacatgatgtttcagtcaacaatggaccacatatacggcagtggttccataagattataatactgtatttttactataccttctatgtgtttagatttgttcagatacacaaataccattgtgttacagttacctacagtattaagtatggtcacatgctctccaggtttctagcctaggaacaacaagctataccaggtagcccaggtgtggtgtagtaggctatacaatctaggtttgtgtaagaacactctgtgatgttggtatgacggtgaaattgcctaacgatgcatttttcagagtgcatccccatcgttaagcatgactgtcatggtggtggattggactgaacaaagaggtcaatgaagttactgcaagacagtgtatttatgttgcttttgttgttactatttgttaagcgctggcctcattctcagtttctgtgctaagtgcagttaagaattatcctataggccaggcgtggtggctcacgcctgtaatcacagcactttgggaggccaaggtgggcagatcacctgaggtccggagttcgtgaccagcctgaccaacatggtgaaattctgtctctactaaaaatacaaaattagccgggtgtggtggcgcatgcctgtaatcccagctactcgggaggctgaggcaggagaattgcttgaacccaggaggtggaggttatggtgagctgagatcgtgccattgcattccagcctgggcaacaggggcgaaactacatctcaaaaaaaaaaaaaaattttatcctatagatgagaaaattaaggcatagagaagttaagtaaattgctaaaggttacacaagagcaagtgatccagaatgtttgattaagggcccaggtttatgaagtcatttgcaaattgtaactcagtgtctctgtaggaacggcattttctagattgatactgcctaggttcttcctaagtaacccatttaatagcctttgtgtgttttttgttgttgtttttcctttgctggtttgaataccctttagatactctgtaagattgagctttgatatagtctgtgttgttttgtgacctatagggtattttcttcttaaacattctctaaagttctatgattctggagcctgaagaaatcctttgagatgaaaggttcaaccccttcatcttgcaggagagaaaggaacttcccccaatgtcttaggatcagttagctgcagaattaaaacacatacctgcttactgttaagcaagtgagtttttcactacatcaggccattttctaattgtaagctgtttcaatgttttggaagtagaaatgctagtttctcccttctccccctttttacacttgatagagttgtaaatgctgttttttttttgttgttgttgttttgtttttgagacagagtcttgctttgtcacccaggctggagtgcagtggcccgatcttggctcactgcaacctccacctcccgggttcacaccattctcctgcctcagtctcccgagtagctgggactacaggtgcccgccatcatgcccggctaattttttgtatttttagtagagatggggtttcactgtgttagccaggatggtcttgatctcctgaccttgtgatccacccgcctctgccttccagagtgctgggattacaggcgtgagccactgcacccggcctagagttgtaaatgctttttatgaataaaagcaatgtgaagttgaagcgacgattgctaaataaatgtagttgtgtggcagacgctatctgtcatgattggcagaggggagcaaaataaaaagatgtccctgatggaagagtagcaggtggggtggccacatggaccagaagagctcaaggaagacaacttcttaattcggtggaagccctggactggaaatcttgttctcagagttctctcacttctcatccgaagccctctttttttaaatcttactttcacattctcacctaggagaatcccagggttaaaatgccatgagaccctgtaatgttgagaaaggaaagaaggaaggaaaaggaacttgctgagatgctgcatcacagttttgtatggaagcttcaggtctgcgtcagtcaggcatcacttttcctgctctagctgcctcccaggatccctgctcaagatctttgcagagggggagtccgtgtattgaagcctggagaaatgtactagtctgtcatctattcaatagatacttgctgactctcaggcactgtgcttaggtaactagagatggaaagatgaatacagtgctcttgccttcacagagagttataaaccagcaagacatcaaatataacatgcatcctgtgttttctttattctaaaatgcttgtttctccatattttaatttttctacagtcaggaatttcttacaattgtgtatatttatgcagtgaaccctcttttaagcaaatattttcttcttttgactgtagacagctagtgctaagatgatagtgtacataagaatcacatgcggtattcactggacatgcaggtattggtggtacctagagaggtctgggatcagattgagtgtatgtatgtgtgtggatagggtgttgtgcaagttcatcaagcttctaggcaattctgatgcaggtggtctctgctggaccatactttgagaaattgctgcagacaatcaagaagtttgtaacttgcacattagaatcacctgaggatcttttaaaataaccagtactcaagccagactccagatcgattaaaccagaacctctggaggtgggacccaggcagcagtatttttgatagctccccaggtgatacccaagcatcttcaagtttgagatccacggccattagaaggttgaggaggagcagtgcttctgaaacttccatgggtgtatgaatcacctgggttcttattaaaatgcaaactctgattcagcaggtctggggaggaggccggggattctgcatttctgaaggctcccagggaaggctgatggatgcatgctgctggggcatggaccacattttgaggagtatgggaagatgtagggccaatccagagttttcaagataatgacagttcagagatgttttctttggtctgtaagagcaccctctctaatacaccccaaattcaagtccatggagtggaccagctgcatcagaattattcaggagcctggtacagataaagatacagattgctgggctcaccactggagattctgagtctatcaccaataatgatattagtagctctatgtatgtgctggacttttcatgtttagtatcagctcatttaatcctcactacagctctatgaaataagtaatatattatttcctccatgattaaactgtggcttggagggttgagtacttttccctaggcctcatttagtaagagactactcagcgtagtaagctctgtttttaaaagtgccctagatgctgaaaccttatctctgtgggaaaggaaatctcaaataaaaatatttcctgaaaggatgaccatatctatgaacctgtttgtattaaattaaatacgaatctgtctatttgcgtttaagaaacgaacatgcatttagaaaaaaaatgcttcaattttaggaataagaaaattttatataacggaaaaggtagcaaatattttaaagagtgtctttgaaataatacagtaaatatctgataagaccatagtaaaattcattttcagagattgagcagatgaagactacttaattgtccttcaaaaggaaatagaaaaaatttggtacatcaatacaatggaatgccattcagccattactcacaatggttatagaacatttactagcatagaagacagttcacaatacaataagagatatgaaacaatatttaggccaggcgcagtggctcatgcctgtaatcccagaactttgggaggatgaggccagtggattgcttgaggtcaggcgttcgagaccaacctggccaacatggcgtaaccccgtctctactgaaaaaatacaaaaaattagcagggcgtggtaacacatgcctgtctgtagtcccaggaactagagaggctgaggcactagaattgcttgaatcctatgaggtggaggttgcagtgagccgagatcgtgccgctgcactccagcctgggtaataacggtaataacgtgagactctgtctcaaaacaacaacaacaaagacagtatttatagcatgatcccatgtttgtttcaaagtcctagtaattaaaatatatttatgcaaagaataagttcatgggcagttatacaccaagatgttaatagttctctcaggatggtggggttatgggtattcttctgaatattggttaagctcctactttgtggctgatactataccaagcattgtgggaaataaaagggagtgtttagggtgattccatccttacagaactaactggatctagatttaacaaaaatttatcagccgtgttttcatttaacccatgctatgcttatgaaggaaacctatgggtcaatttatggttctctgccagcaatttccctccctcacccctactcactctacatccttcctttctttcttccacccatttatccatccatctacttttttatcatacaaaaaacattcaccgagtgtctgctctgtatttatgaaggagagatgaaaaagatactttctgctctccatatgctctttgtcttccttttattaaaataaactttttattttgggataattttagatttacagaagatagtggcaaagacagtacagagaattcccatgtaccttcacccagtttcagttttttctaatgttgtcacattatatcaccacggttcatttgtcaaaactaagaagccagaattcttacattactattaactcagctctagacatttccgatttcaccagttttttcctgcaatactctctgttcaggatccagtccaggatactacattgcaattcgttgtcatgtctcctccttagtttcctctgatctgtaattgcttctcaggctttctttgattttttttgatgaccttgacatttttgaggagtactgattagttatttttatagaatgtcccttaatttgcatttgtctgatgttttcttgtgattagactggggttatgggtttttggaaaaaataccactgagtgaagtacccttatcacctgatatccacatgacatccttggtaatgttaaattgattgcttggttaaggtaatatttgccaggtttctccactgtaaagttactattttttctttggaagtaaatcactaattccagctacctttaaggaggggaagggttaaattttgcttctgaagagggcagtatttgcttatatagtttggaaattttctttaaggaagacttgtcccttcacatttattccattctttatttatatcagtgtggactcgtagatacttattttatactttgggttataattcaacatcatattatttatattgttgcacaaattgttccagccttggctattgataactcttacagttggtgcctgtatcaccttggcatgccccaattcatttgttttttgagtacctccttctttcctgatattataagatgctccaagcttctcttgtattttccctgcctgagccctagaattaaccatgtgtccaaggagccccgatttattttcttggagaatggtatttagaagtcagtatctgggtgctgggtgctcattgtctttgaaaggaaggagacagaaaatgaaaaatgttatatacaaggttcaaagagctgtgaaagcagcaaggacaggccaactacttctgccagcagaagtcttcactgaagaaacggtattttaaattgagtagagttttccagatgaagatcgggattggagtgggatgggaaaggggagggaggaaatatatgttagcaaaatcaagagtaactggctgtttaacttgatctgactgtacacttacattggtagtggcccttctttgattttctcattgcataaaaatgagcaattttcacagattatatttctttgtttacaagaggattttctctacaaactctcttgactgtcctccttcattccccatcttccttccagtcttttttccttctacgtgtatttagctcctactttctgccaggcacaatgcaaggcacagggggtgcagacaagaatttgatagcccctgctatcaagaagttctgtagtgcagtgtgagatcctgtggctttcttctcctccccttagccctttaccagatgtttaatttttaaggctttgcagaaagcataaaaaagcaaagaggaagtatgagcaatgtctgtattgtgaagctgacatgatactcgacttactcagaaagtcttttttgttcacagataacaattggtgtatatgatccctgtaacttagcccagtaccctggatggcctttgaggaattttttggtcctagcagcccacagatggtatttacaagagtgtgtgtttgtctgtctgtctgcctttgccagtatatgttttacaatgtgtctgtttctatttgtatctctgttttcctaaatgcattattttttcattttgggcatggaaaccaggtaatcaataaatcagtcataacccaatttccatactagtgaaccttaagcaggtctgttagggacctgcatactctgatcattctgtgctaaagatgttttagtgtatggtagagttggtagccagaggtcctgacacaaattctgtagccctcccttctagctgtctgggtttctttcagataggattttcctactgctgtcattctccatttttcttaaccctaaaataattaaaacagaggatatcttaaaagccaatatacatttgaaaagatgcccaacatcatgtcattaaggaaataaaaattaaaaccataatgagatgctactacatatccaccaaaagtatttaataaaaatgtctgtaccaagtgttgtcgaagatgtggagcaaatactgctggaaaaatgttgggcagtatctaccaaaattaaaaatatctatggctcagcaatgttactctcaagtatattactcactgaaatacctacatagatagaagcaaaacacatatacaagaatgtttacagaagcattattctcaataaccaaaagctgggaatagttcacacgttcttcaataatgaaatgaataataaatttaagtatatcccttatgatgaaatgtcatataacaatgaatctgagtgaactattaatacagaaatcagcatggctgaattttaaaaacataatattaagtgaaataagttggacctaaaataatacatactccatgattccatttatgtaaagttaaaataggcaaaaccaatgtatggacttagagtagttgttacttttgaaggcagtggttaatgactgagagaaggcataagacagccttctttatacttgggatttgtgtaatgtgtctgctttacttaaataaaaatgtttatttaaaaatatgaagatagataaattatagattgttctctgagggagacaatccacaattatccaggtggtaagtctacacagtgcaaatgggcttcctaactactgactgaggtactgctgcttaatatggaagttcagatggggagagcagagggaaccaaaagaacccacgtcctagaggattttttctaaatgtcttgtgagcattttttccgcatttaaaagatttacttgtcggaattatttatgtgcaatatgattgtagaaagaaatcacctagaaagaaatcacagccaattcatttttcagcctctaaacacttggacagaggagccatatatgaatatgttcaaaagagttaaggccatctcctgtgggtatcagagaggcataattagaatgcattgaattctctccaactggtttgctgaagctcttatgtgagctttttcttttccttcctttaaaaaaaaataataaataaataaaaatccgggcatgacaacaggagtagcagtttccagtctgttgaagttgtttgcttccgtgaccgtaccatgcagggggcgagagacgttgcccacagcatcatcttcgaagtgaagcttccagaaatggcatttagcccaggtaatttgccggtctttgaaaatgcatataattatcatttatcagaaacggaaccaggtttactttcttttcatatcgtcacaatggcagaagaaaggaagagaaaagtacaacttgtacctctttgccaatgcagacacctacttcgaacagagggcatgctctgctattcagactggaacaaaggcaaagattgtgaccaggaaattttctctaggcagttttttcagtcttcaggatttgttcccctctgctccccccgttttcaattttacttttctttaacacaaaatctttattcctgtccattcttaaaggaaggatgaagtattaatgcacttaaatatttatttgttatatacttaaagttgtatgtgatcctgttctccatatagtaaaccagtcaggaaaaatgccatttctccttccacatttaatatcttcatttgatccttatgtgacagttatcagcttttacccccattttataaattgagaaacttagactgagagacattttatctatagagagatatatgtgtgtgtgtgtgtgtatatatatacacatatatatatttacatatgtcacagagattgaatacatattcaagtttgagtaaaataaggatataatgcccagctccggatatatttctttttttttttttttttgagatggagtctcactctgtcgcccaggctagagtgcagtggcgtgatcttggctcactgcaagctccgcctcccgggttcatgccattctcctgcctcagcctcctgagtagctgggaccacaggcgcccactaccacgcccggataattttttgtatttttagtagagacggggtttcaccgtgtgttatccaggatggtctccatctcctgaccttgtgatccgcccacctcagcctcccaaagtgctgggattacaggcatgagccaccgctcccggccagcttcgggaatatttcttacccggaatccatgtcctatgtcaaagtcagagcacgatgtctggcacatcataggtgcttaataaatgttatgtaaatttcctagctcacataaagcccagcacttttatacttcttgccagaataattcctcatctctatgtgatttatatgcttttcagagcactttcacaacatttattattattattattgaggcagagtctagctttgtcacccaggctggagtgcagtggcatgatctcgactcactgcaacctccgcctcccaggttcaagtgattctccctcctcggcctcccaagaagctgggattacaggagcccgccaccatgcccagctaatatttgtatttttagtagagacaggtttcaccatgttggtcaggccagtcttgaactcctgacctcaagtgatccacccaccttggcctcccaaagtgctgggattacaggcatgagtcactgagcctggcctcatatatattatttagcttgttccttatatcatcctcatggttccaaggcacatttctttccttatgccatagatatgccttaaaatgtgtgtgtgtgtgatgggggaggtggtgtcaaaatctcttccaaggccaggcgccgtgggttatgcctgtaatcccagcactttgggaggccgaggcggtggatcacctgaggtcaggagttcgagattggcctggccgagatggcgaaaccccgtctctactaaaaatacaaaaatgagctaggtgtggtggcgggcgtctgtaatcccagctctcaggaggctgaggcagaagaatcgcttgaacctgggaggtggaggtgtagtgagccgactgcactgctgcactccagcctgggtgacagagcaagactctgtctcaaaaaaaaaaaaaaaatctcttctgagatatcttttctagagtgctacagtcagaaggattcaggattggcccacatgacattttttcagcgattctatgctctaacacagatgtctttacacaattcgctgaaagattgacagagtacttctgcttgatcaaaggacgatgctgcttttcagtttagagcctttgcctttctgctgtttttagatatttgcattggatgtagcaccctctcctggcaaattctaaaatagctcctgtgtaatgttaacttacatgctatacctttgttttattaaaccacacttaaagatagtcgcaggggtgtccaatcttttggcttccttgggccacactggaagaagaattgtcttggaccacacataaaatacactaacactaatgatagctgatgagctaaaaaacaaatgcaaaaaaactcaatgttttaagaaagtttatgaatttgtgttgggccacactcaaagctgtcctgggccatgggttggacaagcgtggtcttagggaatgaggtgagagttagctaaaaagtaatgtgggtctggtctgtgtgtctgacaagctgccaggcaccttccatggggtaatcacttaattctgccaaccactctgcagagaggcagttttctttccacttttatgacaaagtcactgagttattcttacatcctactctctatgataaggctcatgcttgatgatgctgacattttttttgctttttttgagacagagtcttgccctgtcgcttgaggctcgagtgcaatggcacgatctcggctcactgcaacctccgcctcctgggttcaagcgattctccagactcagcctcccgagtggctgggattacagtcgcgtgccaccacgccttgctaagtttttgtatctttagtagagtcggggtttcactgtgttggccaggctggtctcgaacccctaatctcatgatccacccgcctcggcctcccaaagtgcagggattacagatccacccgcctcggcctcccaaagtgctgggactacaggcatgagccactgtgcccggtcatttttttttttttttttttttttgagacagtctcgctctgttgcccagactggagtgcagtggcaggatctcagcttactgcaatcctgggttcaaaagcaattcttctgcctcagcctcctgagtagctgggactacaggtacacgccgccacacatggctatttttttgtattttagtagagacggggtttcaccgtgtacccaggctggtcttgaactcctgagctcgggcaatctgcctgcctcagcctcccaaggtgctaggattacaggcgtgagtcacacgtccagccgatgctgacatttaaactcaggaaccacaccgtacatttccatttgaaaaaggttttctgtcgtccactaatgcctttaacacatcttcttaatgcctgatattaaatgtagattatttagcttaggaaaggcaaatgaatttcctgtttttcatgtaaattaatatgttccctcttagctgtaaataaaactttatggtaaatacaacttcataaagaatttttctatatcataatgtaaactgaaaatataagtatggttgtacttttcaatacttctaagacatcccatagttgccatggtaatggtataaggagtattattttaaattattttattttattttattttttgagacagggtcttgacctgtcacccaggctggagtgagtgcagtggcaaaatcatagctcactgcagccttgacctcccaggctcaaaccatccccccagcttagcttcccgagtatctgggactacaggcatgtgccaccacacccaactaatttttgtattttttgcagagacagggtttcactatgttgcccaggctggtcttgaactcctgggctcaagcaatcctctagcctcagccacccaaagtgctgggactacaggtgtgagctaccttgcgcagtcgaggagtattattttaaatatcctatgtcttcttttgcttcctcatggtgtgttgtgttacagctctggcacctggtggaggaagatggcagacactgctgcgggtagagatcccatcttaactctgttttttcttgtgctgctcctgcttgcccactatgggagacagcacctaattttttcctaaaaaatattttcttggccaggtgtggttgctcatgcctgtaatcccagcattttgggaggccaaggcaggcggatcatgaggtcaggagattgagaccatcctggccaacatggtgaaaccccgtctctactaaaaatacaaaaattagctgggcatggtggtgcgcacctgtagtcgcagctactcaggaggctgaggcaggagaatcgcttgaacctgggaggcggaggttgcagtgagccaagataagtgccactgcactccagcctggcgagacagcaagactctgtctgtctctctgtctttctagctctctctctctctctctctctatatatatatataatttaatttggtgtatgtcttataggtatagattatatggatgcaggtatggtaaattacatactattgccatatgtgttatttttttcattattaagtttaaagggcatctaattttcttagaaatggctatagcctttattattattattattttttgagagatgaggtcttcttatgttgcccaggctggccttgaactcctgggctaaatccttcctcctgcaatctttcctcctgccttagcctcccaagtagctgggactacagacatgagcccagcatctgtaaccttttgagtatagagaacttttaatttgaaattatgtcttatttttgtctaataatttcttacctgtatcaagagaaaacctaggctggagttatggattacaatactaggctgtgattctgtagttcttgtcaagttccttgctatgtatcaaagacacattaaaaaaaaaacttttattttcggttcaggggtatatgtggtttgttatataagtaaacttgtttcccaggggtttgttgtacagattatttgatcacccaggtactaatacctagtacctagtattttttctgatcctctccctcctcccacccttcaccctcaagtaggccccagtgtctgctgttcccctttgtgtccatgagttctcatcatttagctcctacttataactgagaacatgtagtatttggttttctgttcctgcactagtttgctaaggataatggcctccagctccatccatgttcctgcaaaagacatgatctcgttctttttttatggctgcatagtatttcatggtgtgtgtgtaccacattttctttatccagtctgtcattgatgggcatttaagcagattccatgtctttgatgttaagagacacatttttaattgaatctaagagtagtaataaaatcaaacaaaatatcaattaatggcaggtgggaactcttttttttccctacagaaaaacaatttgaagtcttaacctctttatgaaactcaaatctgactgggtatggtggctcatgcctgtaatcctagctgctccgaaggctgaagctggaggatcacttgagcccaggagttcaagaccagcttcagcaacatagcaagaccctgtctcaaacaagaaaactctattatttcagttttaatttttcatggcattaaaaaataccacatcagagtgcccgatttaaaagggggaaggacgtttgttttctggcttcttgctgtgaatgataccctcagccaaactggggcccaactagctttcaaggataattggtcctatggtttctcattgaccgtcctatcccagaaacaaaagatcgtgtaaaggaaatcagtaccttctaggtcccgtaattatattgggcaatactatttttttaaatgtcaacagctgaaaagtttcccaaggaaaggaaaattgtgatcttgatagaaattcaaaagtaggagaatggacaaagaaaaccagtgtacaggccgggcgtggtaactcatgcctgtaatcccaccactttgggaggccaaggcgggtggatcacgaggtcaggagatcaagaccatcctggctaacacggtaaagcaccatctctactgaaaatacaaaaaattagccgggcatgctggcgggcgcgtgtactcccagctactcgggaggctgagacaggagaatggcgtgaacccaggaggtggagcttgcagtgagccaaaatcgcgccactgcactccagcctgggcgacagagcgagactctgtttcaaaaaaaaaaaaaaaaaagaaaagaaaagaaaaccagcgtataattagaaacaaaattaaaattcccccagtcccatacatcttaacttcaagtcaaggagtttctcttcctgcagagtctgttgcttaaggcagacagtggaggtgatgctggaagtgtaggctgtggtggggtgaatttcttgcttagtagttcaggttttattgtgagcagtgggaattcaatgagaaagggggagtagcagaggtcctgagatgtagggagcgcaagagagtgggatccactagcaagatttacaaggctgtggttccaccaaggcaagcaaagctttcattaacatgagaaggtagcaggtgtgttctgcaaagcaattgagatgtttaagagaattttgcaacagtagaatacagcagtgtttccctgaatgtgtcccttgagattgtaattggtatacagggaaatgaagggagatatggagagccacgtaagtgtgggaaacacaaagccaaatcaaatcacgtgggttctgtactgcaggtttctcagagcttttatctccctcatgtgcaatgtgaatggccaggtttgagtggtagtgggggctggatatagaagatagatataagtatagaagcatttccaaagtctgtttagctacaggatccttatcctctgagattattgaataggacacactttgggaactgctagaattggagttaattggagttacagaggctcccatagcagggattaaaagagggctgcggggaagggagaagtcagggaagggaaacttctgaatggataaagatgagcttaaaggaaagggcagcttaatcaaatgacagtcaccttggactgtgatctgctcacaggtacagaagggacatacttaatttaaggttcaaatcccaataggaacctcagtgaaggggtgctgcagttacattggcttggcttgcttagatagagaagcctcagtggggttatacctaccccagaaaagattgtctttttttttttttcagcaacttccaataacagtgaaagttgagccaccttgggccagagttgagggctatttcagaagctcctgtacaggaagattgcttgggtttgatggtccctaaacaagagtcccagtagttgggaaagatggggaggcaactgtggcaagtctgtggaaattcaggccctcaagtctcttttagaaagaagcaaaccaaaagcttgtcaatgcatgggccattatgaatgtcgatcttttttatgtaaggtcgttgcttgatctgcttgtttttattcttccctccttcattaaactttgtgttttatttgccttaagattgtcctaaagcagttggatgggaaaagaaccagaaaggaggcatgggaccaaggatggtgaacctcagtgaatgtatggaccctaaaaggtatatttgggaagctgttttctccagtcgggctttttgtaaccaagacacacaccaagttctgtcaggccaacacaacattgtgtaattcagcccagggggtgccagtcatgctgccgtgtgttactctgctcttcaattgaagtttggttgtgagaattaatattaacaatgcatatcctgaagggcacactcttcatctgttctagacattctaaattttgttcttgtttaaagctcatgctctcagaccaccagcgtacctgtactgccgttcagtcctttatgcattgtcctctagcttggtcctattggcccactcccccgccccgtcccccaccccgccccagacagagtcttgcactgtgcaggctggaatacaatggcgcaatctctgctcactgcaacctctgcctcctgggttcaagtgattctcctgcctcagcctcctgagtagctgggattacaggcacgcgccaccatgccctgctaattttttgtattttagtagagacagggtttcactgtgttgcccaggctggactcgaactcctgacctcgtgatccacctgcctcggcctcccaaagtgctgggattacaggcatgagccaccacacccagcccttattggcccaccttgaaggatattagaagaattatttcatggaagccagtattgtgtttaagggcgaatctcagtgcactcttttttttttttctttttttttgagacagagtttcactcctgttgcccaagctggagtgcagtggcatgatcttggctcactgcaacctctgcttcccgggttcaagtgaatctcctgcctcagcctcctgagtagctgggattacaggcgcctgccaccacacctagctaatttttgtaattttagtagagagagggttttaccatgttggctaggctggtctcgaactcctgacctcaggtgatccgcccgctttggcctcccaaagcgctaggattacaggcgtgagccgctgtgcctggcctgagcgcaggagatatgggaggccttattaaggagatatgggagaaatttctgttttcagtactaggaaaaactttcctcttaatcagatggtgtgtttttattcatggacaccatgattcctataactggtcatgctcttcccttttcaccttggctgctggaactcagtatcaaatctgtggccccctcgttgcagaggactccaacagcatgctgctgggtgggaagctttctcctccctgcttaccctccagtttaattttctttttcctttgatcccaatttccttattatttcttattttcttgcatagccacttgaaatctttcagaacaagattattgcataaaggagtgactgaataagtaaatctctccttttctaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatggtaagtcggaggtggggggtgcaaatggcacctttgaagttgtagcttctcttcttgttttactctcatgattgccttccatctcccagctccccatcccctccatctctccctcccttcctttttccttttcttatctttttaagtgtaaaagaaatacaaccttttatcatcagatagaaacagaaagtcctccacacccatcgcaagtcccatttcctattaagcagactttgtagattagtatgcagcctttttcccagatgttattgtagacatatctaaatatagagaaatcagtatctttgctgatatttatttgtatttataaagattagatcatagcatactatctataacaggtttttatttttaactagatagaaaaatgactgtagctacctttctgtgtttccatagtatgtatgtgtagtattttgttgtatgactatgttctttatttaatcaatttcagattactttctatttttttctattagatactgttctctattagagaacattcttatacttgtatgtttatatatccataggatttttttttttaggaaaaaaaccctggacatagaattactgtgttagagagagtatagaatttgaatgtcaatattttatatatttgtttgtcattaattttttttttttttgagacaaagtctcactctgtcacccaggctggagtgcagtggcatgatctcagctcactgcaacctccacctcctgagttcagcgattctcctgcctcaacttcccgagtagctgggactacaggtgtgcaccattacacttggctaatttttgtatttttagtagagacggggtttcatcatgttgtccaggctggtcttgaactcttgccctcaagtgatccgcctgccttggcctcccaaagtgctgggtttacaggtgtgagccaccacgcctggccaaacatgtttttcaaacgaaattgccttccaaaaatgttacacatatgagacacagaacttttttccacgctcttgccaaaactggatatatcaacttttgaaatctcagtcagttaagtaacatttattgtttgaatttgtgtttctttaattagcaagggtgagtttaattttatttcttttgtgagttttatttcttttattcatgttctttgggttgtgtcttttattgatttagagttctttttattggggcaattaaccttttttctgtaatatgatgcaaatatttttctcagtttatctaaggtgtctttagccatataaaagtttttttcagctttatgttattatatgtgtcagtcttttcctttgtgggttatggaactcttgtttttatgttagagctttatgaatgtggaaattttttggttacatgataaggggtaaagatctagctacttttgcacaaaatggattgttagttgttttaatggcatttattcagtaatctaaatcatcatttttctgtctttatcaaatgctaaacccccttatatacctgagtctctttatggattctctattttgactcattgatctatttttttattcctatattcatgctcactgttttagttgaaattacaatgaatttatagataaattagaagggattgatgtatttttatgacattaatccttagttctgggagcatggtgtatctcttaattagatcatctttgtttttcagtagcattttctttatataggccttccatgtatctaattgggtttaaatatggtatttctgcatatttaatgatgttttttcctttagagatattttctcccgttaaactttccagttgactattactgggatgtaggaaaaatagtgaattttgcatatttgtctttggccatctttctaaactctcttagttctaagagttttttgattcttttgtagcttaatagtattcctcaccaacacttatatcttccttttccttgtcttataagattggctagaactccacagtaatgtagaagaatggcagtgagagttgatatctttgttttattgctgactttaatgagagtgcctcttgtttttatctttaattttgatgttggtttctggtaagtgttctttataatttaaagaagctgatttctgtttctgcacgtttatatcagaaatgtcgagctttatcaactacgtttatcaagacaaagtattctaatgttgagcattcctagaataaaccctatttgtacgtggtatcttattcttctcatatactcttgaattcaattagtaatgttttgtttttaaatgttacattttggccgggcacggtggctcacacctgcaatcccagcagtttgggaggccaaggtgggcggatcgtttgagctcaggagttcgagaccagcctgcacaacgtggcgaaactccatctctacaaaaaaaatataaaaattagccaggctgtagtggcgcgtgcctgtagttgcagctgctcgggagctgaggtggaaggattgcctcagaccaggaggttgaggctgtagtgagccaagatcgtgccactgctctccagcctgcgtgataaagcaagacactgtctcaatcaaccgatcaattaaccaataaattttacatctcacttcataagtcaaattggtttatagtcatgttattccttgttctatctttgtatattttatagctacattatgctagctttataaaataaacttaaaacgttctgcctttttctaagttccagaacaatttaaataaatgaattatctgttctttgatggttaggtaaaattcagttataaatccgtctgggcctgatgcatttaagaattttgttgggccgggcacggtggctcacgcctgtaatcccagcactttgggaggccgaggcgggcggatcatgaggtcaggagatcgagaccatcctggagaacacggttgaaaccccgtctctactaaaaatacaaaaaaaaattagccgggcatggtggcaggcgcctgtggtcccagctactcgggaggctgaggcaggagaatggcgtgaacccaggaggtggagcttgcagtgagcggagatagcgccactgcactccagcctgggtgacagagcaggactctgtctcaaaaataaaataaaagaattttgttggttggggtagtaagggtggtgggaatctttgtaaacttttacagatgtttctgtgttgactcacctttttagattttgtactgcttttctagctttaaaaattaattgacataaaatacatatggtattctcttttaaatcttccttttatcttttaaaaaatcttttcatattcctaatgttgtatatttgtgttttctcttttttcctcatattaagccttgctagagaggcttgtctatcagtttttttggagcattactttatttattctataatttttgtttctgtctcattttgctttcagattcgtaaatatctacttttatctttattaattttttcctccttctgtggaatttattttactgtctttttctaggttctagaatttttagatgcttagattttcctaacatttttcaaaatttcaaagtcaacataaagccattatagaaaatataaaagtcataaagcaggaaagaagacactcattttcctaccgctttttcacttgtcacatttcagtgtttaatgtgtattttaacattttattagatatataataatgtcctttgctcttaccaattaacatgtcattaaaaatgatgcctgtctatgaggcctttttattttttgggacaggttctggctttgttgcccaggctggactggaccttgtgatgttcccaccttggcctcccgagtagtcaggactgcatgagttcactgcaatgtctgctaaagctttatgactgtagaatatgccttctgataggatgaaacataacttactgaacccttctcctaatgttcagcattaacattgtttccagttttttacaattgtaaattgtgctgcaaagaacatctttgtgactgcatcttggtcagtatgtcagattatttcttaggataaattgctggaaataggtcataggatatgggtattcttaagattctagaaacatactgccaaattgctttccaggaagattagaccactttaacattctcaatcagtaggatgattttctccctaccacatcctcaccagcattgagtattgtgattttctttaatctttgcagattagccatttaaactgtgtagcattccaggaaaccaaaagttaagtgtgtgcaaatacacctgcatgtgactaacctatggcatgtttgtaatgtatctggctttcttcccactacccagcacgttcccagagtgccttccttgctatccactcatcagttgctttaaggaatgcaaaaatacttcagaaataaacattcccaaagcaagcacaagtgactttattctgcctccatggtaggttgcttagatgatgaaaataatttacaaaactgggtgggtagaccaaaaggttaccagtgggcttcaaaacagtcagtctaacctatgcttatgaaaggcagattctggcctgtcgttctcgacacagaaaacaaatcttgggtccttgttggctggatctctgaaaccttcaatctaattgagtctctcagtttctaatggaaagatattgaaataagagagagcagaatcttagccttgtagccagtcatggcaggacatctcttaggtcagtatgcttacttatgatctactaaaatatacccactgtaccctaccccaagaagtaggcaacttcatttggttgcacctctggagagctcattcattcccaccattaaccagatgtatctcttaggcaaatcacttatctttcctgggcatcagtttccatatctgtaaaacaaagtaattggaccaaggattttagagatcccatctacctttaaaatcgtatggttttataaaactgttataggagacataattgaagtctataaaaccgtgaaaactatttctaagaatatagacttgttccctaaattccagattattaataaggctttgcctcttgaagaaatggtacaaaatgttctaaaatatcatacagtgggaaataatttgtgagtcattttttggaggagttcattcaggctttaaatgagcttcaagagtagttgttatttatacttaattattcgttaagggaaatcaaggacatttaggggctattgctaatctttttaaaacaacaacatagacaattcttatgggattcacctccaaatctttggtgacactgtcaaaaataattattagtctgttccacttgacattttttagtcttattacaggaaaccaggcactgagtatataattatgttgttttctaaggaaagtcaacattctgtttatcgtaacctgaatttgcacaattcagtttctgaagtttcttgtgttttgaggttcccaagcttctccaaaccaatattctttttgagatttcaagagacagcaccctgtgaaatgttcatcagaaacacaccatgatctcctgtttccacacagggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtggtatgttgttgcttttgcagaggttttctgttatatgtataaatgtttaagtcttgggaaatgaggcctgtggcattgaagaaagagagtcagatatctgtcactttctaccagccactcgctatgtggctgaacctctgtttcctcatctcagagagggataaaaaaacacaaccaggtcaggcatggtggctcatacctgcaatcccagtgtgtctggagttggttccttcagtgcgttcttggtcttgctgacttcaagaatgaagccgcggaccttcgcagtgagtgttacagctcttaaagatgatgtgtccagagtttgttccttcagatgtgtctggagtttcttccttccagtgggttcgtggggttccttccggtgggttcttggtcttgctgacttcaagaatgaagctgcagaccttcgcagtgagtgttacagctcttaaagatgatgtgtctggagtttgttccttcagatgtgtctggagtttggtgggttcatagtctcgctgactttaagaatgaagccacggacgttcgcatgttacagctcttaaaggtggtgtggacccaaagagtgagcagcagcaagatttattgtgaagaacaaaagaacaaagcttccacagcgtggaaggggacccaagtgggttgctgctgctggctggggtggccagtttttattccctgatttgtccccacccacgtcctactgattggtccatcttacagggtgctgattggtcagttttacagagtgttgattggtgcgtttacaaacctttagctagacacagagcgctgactgatgcctttttacagagttctgactggtgcatttacaatcctttagctagacatagagcgctgattggtatgtttttacagagtgctgattggtgcgtttacaatcctccagctagacacagtgctgactggtgagtttttacagagtgctgattggtgtgtttacaatcctctagctagacacagagcgctgattggtgtgtttttacagagtgctgattggtgcgtttacagtcctctagctagacacagagtgctgattggtgtgtttttacagagtgctgattggtgcatttacaatcctttagctagacacacagcgctgattggtgcgtttctacagagtgctgactggtgcatttacaatcctctagctagacagaaaagttctccaagtccccactcaacccaggaagtccagctggtttcacctctcactagcactttgggaggctaaggcaggaggcttacttgagcccaggagtttgggaccagcctgggagacatagtgagaccctatctctttaaaataaaattagccaggtgtggtggtggtgtgcatctgtagtcccagctacactagtggctgaaacaaaaggattgcttgagcctaggtggtcaaggctgcagattttgagctgtgatcatgccatttcactcaagcctcggtgacaaggcaaaacactgtctatataataataataataataaataatccatctcacatattcttgtgaaaacgaaaggaatgtatgaataaatgttttgtaagttgcacagcattatgagtttaagttgaggaatttaggagtgtatatatttttatatcctgcctggttccaaagaggtttacagtggctcagatctaatgtgttatttttcctccatcaccaggatacttggtggttacttagtacaggtttatgaaattaaattgaatgcaagtcttcatgaagaagaaagattgggctgaaagtttagctttttgctctagctgcttctggtttttgagttatatcattagaaataccagataacaagagaaaagtcattcagctcctttcatttaaaatcttgacagttttctttttttaaggtcaaccagcaaatgatatcctgcctcttgaaaacttaatcattttatctgacaggagttagattaggtgtctccagagcatttgcttatacttaaagtgccagaagaggttctcagtcctaacaaaacaaacaaaaaaacccactttctcaaagtttctctctttagtcactttgtattagattcatccattttaaaaatctttgctttagaagcattgttaatgtttttgtccatttcactagagtccctgaggaacatcatcttgggtttaacagtattaattgaccacccactatgtagccagctatgtgctaaatgctgaaaaaaataagaatacgttgcaaccctgtcattgaggaggcatattagttagatttctgctgtgacaatattgcatatcacacaatcccaaaatctcagtggcttacaattgcaaacatttatttcatgttcatgggtgtgcaggttggctgtggttcagctgtgtcactaggctgaacttactcaataagccacataacttcgagtcaggttccagtccattgtatgtgttattttcaaaatctaggctaaaggaggaacagtcatgtgggtcctactcttcctatggtggaaggtttaagcttaaaagggttggtgattattatgccttaaagtcttagctcaacagtggtacagtgcaatgtcttccatttctgttaccaaagcgagtcacaggaccaagcccaaagtcaatgacattagtcaatgtactcttcctggtaggaggtcttgcaaaggtcatgttgcaaagagtgaggatatataatattactagagggaggaggtgcctaattgggaagaataatccagtctaggctgcgcacagtggctgaagcttggaaacccagtgctttgggaggctgaagtgggaggagatcgcttaaggccagaagttcgagaccagcctgggcaacctagttgagaccctagcccaaaaaaaaaaaaaaaaaaaaaaaagcaatgatccaatctatcattggagagtattatgaactccctttaggacccagacagacctggctttgaacctgagctctgtcacttattagatgcctgaaatttttgtttactcaaatcctagtcattgtcagtgacccaatacaattcccccttcccactgtttatttgtttagttgctctattacttacttgcgtgtcaggtagtgtatttaagacctcccgtgttccagggacaggggaactagacagacatgtggagcttaaagtctagtgggggatggtcattaacaaataatttcacaaatacttatcattgtaatacatgcaggaagcaggagctcagttgccatgagaatatataacaggtaggcctgacctagatgaggggtggactgggaagacttgagaaaacaaacccctgaaggatgagtgggagttagctagattgagggtagcagagctgtctgtgcaaatgcctgaggtaggatgagtgtggtacttttgtggaactgaaagaaaaccagggtggctgcaacatagaggtcaaagaagatgaggaggaagagaaggctgaggtgggagcaagggacgccatgctgggcctgagagagcaagtccaactgttcttggaaacagccccctggcatcgagcctcttccttcacacttacattgtgttactctgttttccctgttggactattaagtcccccaggccacggtccaagtcttttatacttttatccttcatgccttataaataataggagataatatacacaacccatcaaagtactggtgtaattcatcacgttcatgaaaaatacttgcgaaactatttaacttattggttagccagccttaaggggctttccttatatgcttgatttagtatagtttctttttttttttttattatactttaagttctagggtacatgtgcacaacatgcaggtttgttacatatgtatacatgtgccatgttggtgtgctgcacccatcaactcatcatttacattaggtatatatcctaatgctatccctcccccctccctccacgccacgacaggcacttgtgtgtgatgttccccatcctgtgtccaagtgtgctcattgttcaattcccacatatgagtgagaacacgcggtgtttggttttctgtctttgtgataatttgctcagaatgatgatttccagcttcatccatgtccctacaaaggacatgaactcatccttctttatggttgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataattctttgggtatatacccagtaatgggatggttgggtcaaatagtatttctagttctagatccttgagtaatcgccacactgtcttgcacaatggttaaactagtttacagtcccaccaacagtgtaaaagtgttcctatttttccacatcctctccagcacctgttgtttcctgactttttaatgatcaccattctaacttgtgttagatggtatctcactggatttagtatagtttcttcattcaacagatacttattcatcaccttccttctaccaggccacggagaaaaggcttgacctaagtaaacaagacatggttctgccctcatagagcttatattttattgaattataattgaaatactaaatgctaaaagggataagtagacattgctcaggaaatatagaagagcaggacctggacaagtgtggggcatgtgccagggaaagccttcttaaggaagtaacatttggtccaagctctgaaggaattgatcagaagaggtcttgaggagggaggcaaggaccagagagtggtgggaaaggccagtggccaggaggagcattccagggaagaaaattggccttttgaaggtaagaactgtgttaaatgcagacttcctagatatttggttacctggaaaagttagaaagattggttttattaatgcaagattatctaatttggggtattccttacttgttaagttattgcaagattctaatctcagtgcttgaagtcgagtgacatttgacttggaaaagaaaaaaataatgggtgatagaccctttaaaaatgtttaaattttgggccgggcacagtggctgatgcctataatcccagcactttgggaggctgaggcgggtggatcacgaggtcaagagatcgagaccatcctggccaacatggtgaaaccctgtctctactactaaaaatacaaaaattagctgagtgtggtggcgtgcacctgtagtcccagctactcaggaggctgaggcaggagaatcatttgaactgggaggcggaggttgcagtaagctgagattgcaccactgcactccagcctggcgacagagtgagactctgtctcaaaaaagaaaaaagaaaaagtttaaattttgaaatagtaaattcataggaaatgatttgatttggatgtttgtcctctccaaatctcatgttgaattgtgatcctcactgttggaggtggggcctggtgggaggtgtttgggtcatggaggtggatccctcatgaatggcttggtgccctctccacattaatgagtgagttctcgacctcttagttcacgtgagcgagagctagttgtttgaaagagcctggcatctctctttttccctcccttgccatgtgatgcatctgatcccccttcacctttcaccatgagtggaagcttccctcatcagaagcagatgccagcactgtacttctcatacaacctggagaaccataagccaaataaacctcttttcatttaattgcttcaaatattcctttatagcagtgtgaaatggactaacacaggaaatacaaagaagtgtaccaggaggtcatgagcaccctttaccctgcttcttctgggtgacagacttcaaggacagggtggtttcactgggtagctggcctgaaaagccttaaacactccctcagaactagagagtttgacatttgttttttgctctaaaatatatgtatcccagactaaccgtattctggccccagaccttccagtatgtcaaatgtcagctcataagaaacccttgcattttatctgcatggtattctttcactaattccttctcttctactccaggacataggtgtcatattgaccctttccaggtgcctttaaaaaagctatgataaaattacatgaaaagaagcgctctgctacagataccacacctgatcctggggaagagtaaattgaataagaaaacaactgatcttttataaatcatatagctatttgagggaataagatgtcggattatgaggccgggcgcaattgctcacgcctgtaatcccagtgctttgggaggctgaggcgggtggatcacgaagtcaagagattgagatccatcctggccaacatggtgaaaccccgtctctactaaaaatacaaaaattagctgggcgtggtggcgcacacctgtactctcagctacttgggaggctgaggcaggagaatcgcttgaacccggaagtcagaggttgcagtgagccgagatcacgccactgcactccagtctggcgacagagtgagactccatctcaccaaaaaaaaaaaaaaaaaaaaaaaagatgttggattatggagccacacttgaggttttaaaacccaaatctggacatctgcttcaaccctaatgagtagtggatactggactagctctgccaccataaacaattacacgctgggacaaaatacgtaaaattactcttttcagacagtgaacagtaggtagtgaaagactatggtcataggtagtgaaagactgtggtcccagacagagggaaggaaagatttgtcccagcttataacatgaaggcactttctggcccatgccatagcccgtgagagcccagggagattctcttggtctcagtgagctgaggaaacaaccagaattcagagcagctgaggtggctggaatttgcaggacgtagtaccagaaatgagggagctgtgcacaggagtgcctcggtagcaccctgagtctttgactgaatagcgagctgtgtgtactcacagcacgactctcgtcagaccaggcaaaaacacactaccagagagctatgagcagaatggagattccagagttcacacgagctgggagacactggagttctgtatacggagtggagagacctcattgaatactctgagcccttatgtgatacccagaatggcccctataaagtttcgaggggaaagcatcttagtggtcttgtgataaagatttcttaggacctagtaaatactatgaacaaaaaatggtaacttagttgactttataaaaatttaaaacttctgcttctcaaaagatgcctttcaaagaagggaaaaactagccaaactgagaagacatgtgcagtcctcttatccagaacacgcaagatgaacaactcctaccactcaagacacacaaagcaacttgtttttaagggggaaaaaagcttgaacaggtacttaatttatggtgaagatctatgaatggccattgaacacgtgaaaatgctcaacgtcaatagtcatcagggaaatacaagttaaaaccagagagatatatcactatacacctactaaaatggctaagattaagaagcctgacaatgctaaatgttgtcagggtgtggagcaaccaaaacacttatacattgctggtaaaataactactttggaaatctggctgtttctcatgaaatttaacatatgcctaccttgtgacccagaaattgtacctttagatctttacctaagagaaatgaaaacatatatacatgaaaatacttatacaaaagtgtccatagcacctttattcaaaacagcccaaatcaccatcaacaggagaatcgataaattgtagtataattataccacgaatggaatgtattattgatacttaacaatataatgaacctcaaaagcagtatgctaagcaaaagaagccaaacacaaacaagtatataccctagcatatcatttatgtgatatgttctagaatagtctaatctatggcttatgaagtcagatcagttgtcatctgggggcaagtggggaccgactgagggggagcacaagaccatgttctggcgtcatgaaaatgttctatatcttgatagctgtatgcagtggttaatctatcatttgtcagaatacattgaactgtgcatatgagatctgtgtatttcactttatgtaaattatacctcaacttggctacacctttgaatcatcaggggagttttagaaaatattggtgcctgggctcattcttagagatttccatttaaatggtctggggaaaagcctggccattaaactctctaggtggttctgatatacagccaagtagaaaaccactgtgttgaaagttgctgaattccagcctcttgggtgtggacataactgatgggctctaacgttagcttactggctgaaattttagcaagtagagatttatttaggttagcaaagttattttattattcaaaagttcagaattggtattgcatgattatacttccatcttggtgtcatgaaaatatatacttaatagttatttggatcaagctaccaccatttaacatgctttgtcaattgtagtatgtcagtaaggtattgcaggtattattattactgtagttgttgcttttattattgcttattacggcatttggtacatagtaggtgcacaatacttaatggattaattaatgagatcctgatagctgtgctagtctcattattaaaatagatgtgtgctgtgctagtctcattattaaaatagatgtgtttttgcacctttcttcttcctgaaatcctttctgcctcaggtcctttcctgctttgcttgccactcttttttacattccttttgaaattgttgttcttcctttcttgaattccagagattaggtttaaagttgaagataataaaaaaaatccacaatctacaaatttgatatttctttgtaaaaagatctgcttgctgtgtcccttgagctatttttccagtaggtgaggggttttggcaaatgagtgaaaaagctgatgttttcaaacacttccctatggccagtggtatacaggggttaaaggtacagtttatgattctagaacacattttttgtggaaagtcagtgtccctggcttcattagcacccatatgtgactcactgttaatgtgccaaaatattatgtggtcatcaaggggcagatggtaaattataaagctgttctaaagcccatataaaaaatcccaattcaggggaactcaggttgatggacagcttctacttttggacagagagtgaagccttactctgtcccacactctgacatcacccaccataactcctgccccgataaaaatatctacatactcctaagtagattttttggctctaagttagcaagtagagttttttgtatttgaggttttttaaaatgcatatacccctgaaaggattaagacaagatcatcagtcattgtaaccttatgtgaatgtattaaatcaaattatatttgctagaacactccatatggagatgtttaacactgaggaaacagaagggagggcaatttggaagcaaataggaagagatagcccagttggaaagaggtactttggcagggtacggtggctcatgcctgtaattccagcactttggaggccgaatcaggaggattccttgagccaaggagttcgagagcagcctgggcaacatagtgagacctatctctactaaaaattaaaaaatcagccaggtgtggtgacgtgtgcctgtagtcccagctacttgggaagctgaggtgggaggatcccttgagcccaagaggtcatggtttccgtgagctatgattgtgctagtgccctctagcctgggtgacaaagtaagaccttgtctcaaaaaaaaaaaaaaagaaaagaaaagaaaaaaaaagaggtacttgggtaggcagaaggtgctgtgataaagtttcttggccttggatggctggaaagagccaaagatacacagttttctccagtgtccttacctcaggtaggatgtgccccctccactttggaactgagatccgtatgtctctgtttgctgccctgccctgcctcagggccctggggtgataggtcaaggtgttctaggatgcagaggtgaagaagagagagggcgtgggaagggtgcagcataatagtgcacagggagctctcatgtatgtgaacacaagtaagtgcaggcagctgtgggaagtgtgggctctgagatattacctataccattgctccagacataactacgtcctggtgtttccctagaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaaggtaggccctgtctctaattatgatttatgatttaatgcaccaccactccagagggaggagtgtccctaaccttcccttccccagggcagagatgtggtttgtgtgacctggtagcatagtgccaaagggcttctgcttcagactctgtctttgcctcgcacaccatcacccaatgtaataagtaccatttactgcttaattttcataataatcttttgagatactctacactgaaagatatactgtacttacattaaaacgtaagctccaagaggacagagacttggtcttattcaccactacttggtcaatgacaacttcaaggggcaacaatgttgaatagtgaactaaatcatggtgcatacctatgatggaatagtatgcagccattcacagttatgttttcaaaggactttaataagatagaaaatgccacattatattaaataaggaagatacaatattatatatattttataccaattatgtttatatataaacattgatatgtattttcttaagtatctacttatctgtctattgagagaggagaaagaggacaagaagaagggagaaagagagggagagtatgggagagaaagggagaaaatagtaggtaaaaaataccccaaactattaatagtaattttttgagctgcgggttgtgagtgatttttgttttcttttgtagtgtgtttattcttatttttcaaactttctatataatcagatatttgggataataagttaaattagaactatgaaaagttgttatagtataatgaaaaaatggtttcttaaaaatttatgtgttgggctggacatggtggctcacatctgtatcctagcactttgggaggattgcttgacccaggagtttgagactagcctgggcaacatggtgagactctctctctagaagaaaaacaaaaaattagctaggtgtggtgatgcacacccgtgctcccagctactcaggagggtgaggcaggaagatcacttgagcctgggaggttgaggctgcagtgaaccgagatcacgccattgcattccagcctgggcaacggagtgagatcctgtctcaaaaaaaccccaaagaaacaaaaaaacaaaaaaaaaccaactatgcggagccaggcatggtggcatgtgcctgtaattccagctactgggataccaaaaaaattctatgtgaagggtgaattatatggtatgtgagttatatctcaataaagctgttataaaaacaaatctatgtgaacatgacagtatagcataatggtggaaagaatgtgtttgagaactatgtagacttggttttatatacctacctcttgccagataagtgaccttgggcaagttatagaactaacttctctgactttcagtatcctcatctataaataagaaatgtttgttatgagtttttttgtttgcttttttctttttcagagatagaatcttgctctgtcacccaggctggagtgcagtggcggaatctcggctcactgcaaactccatctcccaggttcaagcatttctcatgcctctgcctcctgagtagctgcgactactggcgcaagccatcatgctcggctaattttttgtatttttaatagagacagggtttcgtcatgttgccaggctggtctcgaactcctgacctcagacagtctgcccgccttggcctcccaaagtgctgggattacaggttatgagccactatacctggtctgttatgagtttcaaatgaaattaaatgagataatttatgttcatcacttatcaagtcttttgtaattaataagccctcagtagtgggtagattttatcatcattagcttttataatctaattacacttacatgcaaaaaataaattttaaaaagttgagcaaatatggaattagccacagcttgaaatatatgtgtcttttaactctgctctttcattccttgaaacctgcagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagatgtaagtggatttctctatagttccaaatatttcctatcaccaacttgtacactgaggcagaccgacttggccctttcatttatgactatttaaatattatcttttaacaaagagaagaattctccaatttggggaggatggcattatctcattatgaaccttgactggcgtcatcaactgtacacctgttccttgttcaccaatataaacgcggctacaaaccatatttttggaaagcttattgaggaaaccacagcagactagtccctgatagcactccgtattgtctccggtgcttctcttagtcaagataacattacaaatcaggagtctaaagaccagattccatcaatggcttgacactgcctcccaggtagttctaaaaagtctcttaggttccctctacctttgcaaaataggagtgatgtgtaggcttgtcagatttagtaagtaaaaatataggattcccagctaactttgaatttcagttaataatgaattcttttttttttttttttgagacagagtttcgccctgtcacccaggctcgagtgcagtggcacaatctcggctccctgcaacctctgcctcctgggttcaagtgattctcctgcctcagcctcctgagtagctgagattacaggtgtgtgccaccatgcccagctaatttttgtatttttagtagagacggggtttcaccatgttggtctggctggtctcgaactcctgacctcgtgatccacctgcctcagtctcccaaagtgctgggattacaggtgtgagccaccacgcttagccaataatgaataattttttggtatatgtcccatgcaatattcaagacccacttatactaaaaatttatttatctgaaattcaaatttaactgagtgtcttgtattctccctagcaatgctaatagaggagggaagaatacctgccctgtcaactcacagtgcaaagtgggtcaagtgcgacagtgctttgaacagcaagactacactgtacaaattaagattctatgactttcagaactccacacaagtcagtctgtatgtaggtctgttcctttatcagaacagataacgatttccagtgaaacaatgcagagatgttttctgtaacctcccctctatttttcctttgttttaaaacttttcccttaataactcatatctcttttggatgactggcttttatgccctcccaatataaagaaaagaagatgaccattctcttttatggagaaagatggcttgatgatctctgttatggtgttataatatatagctggtcttgttatttagtgattgtcaacaaatacgattagtggtcccttgcagtaaagtcccatctgctcataaggtaaaatttttatagagtcaaaaatatctctaacaacctcttaatttgcccagagttggatggttagactctctttggttgaaccagcaaaggcttgtgcttagagccatgttgtagaaaaaaaaaatacttgtagtaaaccctagaatcacacagagaggtgatgcccatgttgtgagaggcacataggaactgagggccgcaggaatagtaaattgttgctcccatctcacggtcactttgaggtgttagctcagttaaaatggcagggcagaatcatttgcacttttcaaatcattgttcctttctgtgtctctgtcacttaactaccaagcacagtagaactgaattgagtcacttaaaggaacacatgatgcagttccattatatgaggcagctaagccctcatttttggttaatatcccccaatctgtttaggctactgatcctttttagcatatcacctcatttagttacctaaattgtatattttgtttatcttgataatctcaagaaatgatgtacttgaggctggatgttctttgccaacaatgagcatctggttataatttaaagctttgtcacagaggatttcatacttgagacagctagagttgaatggagtagaacgttctgcacacaccaatgattgtttctttgcagtcaaccagagaccggaccttggaccagcagtgcactgtgagtcgtccaggactggccgtgattgcaggagccctggccgtggaattgatggtatctgttttgcagcatccagaagggtgagtttgctagtaggagatgagtatttaaacaaagcttttgtaggcagttgttcatcagtgtctcccatggccttttctcagtctgactttacagagaatttcactatttcaccctcaaaaaaacaagactagaaaaagcaggtctggttctttgggctgagataacttggcatgtttcctttgtggccacatttctgcatctttccggacaaagtcactatggtttattttatttttccaacgcttatatagggcttactttgtgctaggcactgttctaagcaccttagaaattttgcctccttcaatctttttttttttttttaacgagacggaatttcgctcttgttgcccaggctggagtgtaatggcacgattttggctcactgcaacctctgccttctaggttcaagtgattctcctgcctcagcctcccaagtagctggaattacaggcatacgccaccatgcccggctgatttttgtatttttagtagagatggggttttgccatgttggtcaggctagtcttgaacctctgacctcagtgatcagaagtgattcacccaccttatcctcccaaagtgttgggattacaggcgtgagccattgcacccggcctcctttaatcttcatagcaaacatattaggaaagaactattattattagtcgcagttttgatggggaaatcaaggcatagtgaggataagtaagtggccaaatttacatagtaaatggaaaagccagggtttagctcaaccagtgtggctccagactatgtttaatgactttgttatgctgtttgcaatacaggcagcagaaaatcgaatttttgaaagatttatttttccagttctcagaaagtcaatatgcaaattaacatgaatattctatttcttgtgtgactcaaagctttcctcagcagttgaaaattgtggttgtatatgtaactagtatgggtactctgagataaatgaaaagcggggcttttttgtcttcctctttgtcatccaccttagctatctgtcatttaagtttattgccactctctgacaggaagtatttgggataaaatctttgagagctgactttatgcttccttgacactgagcctctgtctgccacatttgccctggtcatagtttaaacaccaggtcctgtgtcacatctttttggtgccacaagtatcactccattgttcagagagtagtgtattagttctgcccaattcattcttcacttttatttcttccatttcattagcatttatatcagctcaagaagttaaggttagaaaattttccacttcaaattttcagtacagaaatgtgctgtgatgtttgacaagactatttcatagtaagtgagttaatgtttattggcctctgatatgccgaacattgcactcggcagttgatgtagtagattcctcatttattaatcagagctccctcattcctactttatagatgatggatctgaagcacagaaaagttaagcaacttgcctatggtcacaagctcaggtctttctgactccaaaccatgcatgtttaaattactcttcttgccctttgtcccagggaaattagttttttgctaacttacactgcccagcaaggggcattttagttatccttatgaatcttatgtagatttctgctagatcatcctcccatgtgttaaacttggattaaatgagcagctctgattgtttcctgtcctcaggggctatgccattgccagcagcagtgacgatcggatgaatgagcctccaacctctcttgggcttgtgcctcaccaggttagtgatgtggaagtgaaatcacaattcttttggtacagggggaaagcatgtggggtctctttgccattccatctgcccagcccacttcatatccaccctacttaccctgcagctgggatttcaatgggagagctttctgaccacctggaaggtattccattctgcgggatagtgatgggaggaaatcacgaacgagaagcattgcccagagtctttgatgcgttttgtaaactgactagaggcctcataatgcaataggaacagaaaaaacaggctttggaatcagtcatacaatggtttaaatcccagccctgccgttataaagatggccttctttggccaagtcactaaacttctctgaggcttagttttcttatctgtaacatagagaaggtaatgctgacatcacctggtagttgtatggattatggatggttgctagaaagggctcagcaacagtgtatatcataggccctcaacaaacaatgcctgctgtttctttactgttgtttgttattattattgactctgaacccaaatagaaaacctttataggcaggcatgagaaaaacattagaagcatgcagggtcaccaaaaagtggggtgtcttttcagaaaaagaatccaaagcatcatgaggaagttccatcccttagggagtaaaaagaaaaaggcagtgggatgatcttttagaattcatgttgcctcttcagtcattttcattactatatttttgggagattgaagaggttttccagtcttatttggaaatcatttttttttagattccatgtatgtatcctctcctgtaatgtgactgctgttcccatcagtgaaatcgtgatggtgcccaccagtcctatctggtgatttgcaaggacagactcagacgagtgcagagagcagagtgactcagctcatgcttgtctctctcttcctcctcgccacccaccttctgccagctagggcggcactgtcatattcagtttaggatgagaatcagaagaggggaaacgacttcttcatggtcacagagacttagtggatgagccacaatccatacctaaacttggcagtctgacaaatgttctttcaaaggtcttgtgagttgaaagatccgtggcctgcatgttgggagattttgcttcctgttggtaccccagcccccttgcacaaaaccacccataatagaacttgtgggccgggcgcggtgactcatgcctgtaattccagcactttgggaggccgaggcgggtggatcacgaggagaggagtttgagaccagcctgaccaacatggtgaaaccccgtctctactaaaaatacaaaaattagctgagcgtgatagtgtgcacctgtaatcccagctactcaggaggctgaggcaggagaatcgcttgaacccgggaggtggagggttgcagtgagctaagatcgcgccattgcactgtggcctgggcgacagagtgagactccatctcaaaaaaaaaaaaaaaaaaaatagaacttgtagagttcacttagcctcccagagtctcagtttccaaatcaagaaaagcaggtgctttactttgtgtccaggattacatctgacacggccttgaaaaccacaaaacactatgaaaatgtgcccccctctgtcccccacacacaaggtggcatttttttttgacatgcatgtgttaatcttttctacagagacatttcacgtaggacccaaaagacgcggtaataaccatctatcataaggaagctgatctccagagcctacctctgctatttatgctgtcgtatctcatttgaatctttcccaagtctcccgccttcttctgaccttgagatgtgccctcatctcctttacagactttatattgagaagggccttaattaaattttcagtcatgcccctgcactggtttccttctttaagtcctttatgttaaattactgcagttgtagttttctcagtgctgaggccagagggcaaaacagtctctttatagaaggggcccagtgtcaaaatgcatgtgcccatgtttttaaagtactatggcaactaatccctctcggtgttatttatccccattgagcctcagaattatttgtcattcaccaactcttctagttctttctcctcgttttcaaatgtctgaaggattattttggttgttggccatctcttcatttgcccttttcaaagactgaagaataacgcagccatatatgggaaaagctgtgtgtgtgtgtgtgtgtgtgtgtgtgtgtgtgtgtgtgtgtgtgtgtttacttgcttacattgtttcaagtttcaagcctttatttttagctactttctaagaaagaaagtggagaaagaactttaaaaattaatcagggttgtgtggtccccatgtataggctttaaacaacttttttccccctaagtggagtgagtccatttatgcaaccatgttttgattaggggaccatcgtttccacgtttccacaaaaacactgggctgtgttgcaatgccctgttgcaaactcagcacttccctcctcctcttcctggctcctagagacaaatgatttcctgttggagaggaacttggtaaactcctttgtgtactttgtatgcaaagaagaccagtgaagtttactgggctcatttttctcagttcccaagaggagaagttttattaattggcccctgtggaagagatgtagtagaaaagtgatagtccttggactgagaatcacaaggccccccaccagcaactcattgtgtaatttggagaaagttccttaacttttcctgtgctctctgggtctctgctctcctctgtgtcagacctaggaggcctgaggattacttagttgttctgtctctgggtccacaggcagaatttggcccatccaaagactggccaagtgccaaaaaaaggcctgattaggccctgaaattcagtgaaattctgcctgaagaaacctcttattgaatttgaaaaccataaaccatttcaggtgagcttatgggtttgttttgggtttttttttttttttttaagtctctggcccaatgtacgtggattagattctgcaagcaggcagcagtaagtataagctaatttctgtctataaaaagaatgattaaaaaaaatcattttgttgatgtgtggaatagagattatcacacacatcattaagtggtaatgtgatgaatgatcacaaaacgaacagtcttatacccagcacacagatcagaacaaagtaactatcaagcaccttcaatgcccccctcatgcctcttcggattattattgcatccttcctatagagaggtaagcacctcttgattatcagcaccatgggagatgtttgtctgattttgaacttctgtaaatgaaatcatatagtatatactctttggaatctgttgtcttttgtagagggaactttttcattataaatcttatagtagtgttgttccttcttcccatcaacagtgttcttttacttaaaaaaaaaaaaaaaaaaaaaaagaagaagaagaagaaggaaagaaacactgctttttccctcccggctggtggctgagctctgcaaggccagatcctttttctggttctttggtaggaggcacagttcaggatttataaaatgtacaggccactcttgatatctccaggaagttggtttgccggctggcaagagatcctggatgtgacagaaattaacagcctgttggcctgctaattctttggctgtacctcctcaaaggatgataatgaggtgacaaggctaggcacagtggctcacccctgtaatcccagcactttgggaggctgaggtgggagaattgcttgagcccaggggttcaagaccagcctgagtaacatagggagaccccgtctctacaaaaaattagccaggtgtggtggcacgcacctgtgggagtttgaggctgcagtgagccagtatcacactactgcattccagcctgggtaagagagggagtccctgtctcaaaaaaaaaaaaaaaggaatcaaggtgacgctacaacagttgtccaaacaccaaggtaattgatggggcattcctgctttatcccacttgtggaccaagcagttcacatcttttgtctttaggtgaatgaactcttggttctaaagtactgataaaaaaagaccctgaatgtgtatatgccattcttctgagcttggaattgccaaccccagggttttctcagcttcatgaattcttttagcttcagaaaagtaatacaaagccaaaactagggcaggaccctgggagggacctggcctgggaaaactctaattgagtcacatgctgaggtggagctgggatctctagccatatctcgggatatttggcctttctgcacaggctgtgtcccccaaatcctcaagcctttagattttgaaaaaatctctttactgtgttcagaaatacttatctcagtgtgctcctagggacatggacagatggactgctgaggagggaaatcttagcagataagcaataagagcatatttcctgagatgcagcccaggaaaggagcctcctttacccctctggttctaaacctctctggttgatgatgatggatatagcagaaaaaatgggcaggcctcatgtttcactatatcaagtgctatcgtttgtgacctgttcatcttatttccctccctccagccatcccctcaacaggtaatctgactctgccaagtgccaagcactatgaagttcagggaagttaagtaactggcacaagatcacccagtgttgagttccatttgcgtttggggtaatctaaggtgatggatgtatcccaagccatttggatgtagtagagtctggttccagtggggaggcctctgaatacaaggaaggatccgggtataggtctaacaatgtctgggcttcctctgtgaggtcccagaagaagagtcaagattgctgtttccctggaggataaattataatgtcagcgttcagaagcatctcagattgcatctcttgtcccaggaggagttgggcctaaccttacaggttgaaggatgtcactttgccccatgagttttacccactggatgaggctgtcctgtttaggaggtgcgtgtttaggaaggcagcctgaaggttttgtgatcatacagatctgattagaaccccagctttgtctgttaatttcacattcagtatctcattttacaaaaccagttggggcagctcttagcacttgtccctgtttgaccttgggcacgttacgtatcttctctgaacctcatgttttatatctgtaaaatggggataatataataagctcttggaattcatggatggattaagtcacacgtactaagcattagcacagttctgggcacataagagacccttgtaaatatcggtttcatctttcacttttaattaaaatggaaacttatccactctcctaaaaaggaatttataaagactctcataaagctctgaaagcaatgagtagagagggagtggttgggaagatttgctccattctgcagtgtttttctaaggataacactggctcatgtccagcttagtttttctgcccccttggtgactctagcttaatagcgagagttgggtcagtggtgggagctgaagctcttagctgaaacaaagaccattctggtgtgcttagggttttgcaattgctacactctccattttggcattgaacttgattaagactcttttcagcatccaagatcgatctggagtttggagttagtttttatttatgcgaactccaagctttagaaatattgccaggcctgctggaagctagtgtgaagttaaagcagcaagttccagttgtggctgcaactgtgctttctcagaatggctgtttgttgctgggcattggatcttagcctcccatcgaggcctgggtctgaagctaattttactcagcttaggtgaaaacaccaccaggggtgggtggcccagaaagaaagaggaacctttctattcttgatctatttattttgtggccaactgggcataattgactaaagataattgaatccacctgataggtgttaagccctctaggtgttgagtttttgtttgggagttttgttttttttttaattcctctagcctctttcttcctttctacctctttgcttttcagctttattcctcaggctttagagccagaaagaacaaaattcagattcctggctttgccacttggtagctgtggacccttgggcaagccatgtcactttcctgagcctcctatgttcctatttggagatctgtgccacaagatggtagtgaggccaaaatgagatgcaatgtatgaaaacacccaggagccctgaacacaggcatggaattcagtaaattttagtgctctcctccctccattctctggggtatcattttccacattattcaaggacatgccttcctgcctggcttctaggattaggagggaacatttgtttatttgaaagggaaaaggaagagaagtaagtgctttagcagggggacgtagaacaggcagaaacaatggctgggaaaggtgctcagcgagtttgaggaagggaaaggccagtttacctgcgagacagcgagtaaaggggcacagcggagaaggcaggaatgcaggggccattggaaatggctggaccttcaacccggggccctgggaggccgttgaacgctgaggtgtgatatgagtagatttggttgctgcatggagaatagactggaggtgatacgagtggctctgggaataggatttgagtcgtttggtcttaaatcagaagacagcctaatccagggattcccatacctggccttccatcagaatcacctaaggagccatttcaaaatacccatttcccagcccatcccagagccactgagcgaaaacctccagggacattaggcatttgagaaccactgcttctgtccatgaaaacatggcttcttgatagcatcacctgggacaaagtacttaagtccttaaggtagcacaccaaatcctgctttttgaattttgtgcttccaccaacactagttgtgtttctaaaagacccttggcaccttgttcccagtgcacatctgcagccccaacaggtgttcctgcctgagagcctttggaagctaattagacacgcacaggtgtgcctaatgaattcctgccggaccacacgctgtccagctgggaacagcccgggagcgaggccaaacaaccatataaagcgaggccaaacgacctattctgatgctttttgcatgctgtctgccgtgttttcattccccacggtgaggacggtgtgtcctgtctcctaaggccctgtgagccaagctcagctacaacctggtgccccacatctgacaacagggatttccactcaaagtgcttggcccttttgggcctgggggtgatgagtgggactggagccaagaaaccacaggtaattgggattcttctaggctctgtgattcccaggtgggttttttaatattcagggagtagcaaagatacaaatattgtagagctagtttaggcgtacaattttttttttctagacgtttctatggaacactaatgttggtgattattttgcagggagagggaatggaggtaacagggacttagggttttcatttcgtacttttctgcagtgttttgaaaaattaagattataagccttttttaaaatcacctttttcaagacataactgatatatagtaaaatgaacccattttagtatgatttgacaagtgtatacactcacataactatcacttccacaaatgagatacagaatttttctgtcaccccaaaaagctcctttgtgccttctcccagttcatctccccaccctcagccccaggcaaccaccaacccaatttctatatggaccatttttattttttctgtatattttactgtactaagggaaaaaaaatgtaatggaaatcttaaaatgttcagagggaggcaaggtttggtcactctgaggaatccctcttactagctacaaagttggtaggtaagggctgggtgtgtgtgtgcgcgcgtgtgcgtgtgtgtgcgtgcgtgcgtgtgcgtgtgtgtgtgtgtgtgaaatcggccatgttttccccttgtggggagaggggagaatgagaaaacaatattcaggtgaggctgtttaaaagaaagttaaatgtttagataattttttaaaaaataggaaaatggaagtaaatatgtcatgggagtatgggttattgttttgtttgttttgtcatgtgtttatcgtttttattacagaaagagttaactttttttttgaaaagctgtttaatgcttaccctactataaggagaaactgacaacaaataggagaacaagagttgagagtaagctgtgtgagacttacgttatgactaactccaaaaggtagaaaatttactttcagcaagaggctttagtttcctgtgtggatggcaaaacacctttgatatcactttataaagccttttaatttaaatgttaatttaacatgaactaaattaggtggtgtggtggtactatttttagaaaatgcgcaaagaattagaggcttgctaagtgcttccatccgttttctgacagctaacaggtgatgctgagtggtacagagcaaaccacgggagggtgtaactaaggttagtaacaaagcatcctgtttcccttgcttgcctgatgggaaccacctggagctcttgttaaacctgcagattctcaggcctttccccagaccttttgaatcaagttccaggggcttcttctgatgaggcaagtttagaaaaacactgagcaacactttgctttatagactttgcacacttctaagtaggaaggtcacggtgaatttttctccacccaagcaaaggacaaatctttttaacttctttgggagttgcggcctggcctctctcaataggtatgtgtatatttattaggacctttgcataaggtacttggattttagattgctctggggtttctatgcatatgtaagtaaggtgcaacttctgctctttaaattttatgcagttcttataagattgaggaagtgcaatgcagagcatatgaatggtggcaagtcagagtttttcttgtggtttgtgtgggacctattttctctgtatagtccagatttgaataattttgtaagctttgggtttttgtttacttgtttattcatttcataatttattgtcttacgagcaaatcactgtgctatgagtaaatacaagtaaatacaagtagctcagcctgtgtcttgtcctctaaaagcaagaaagataaaaacatttcttaattatagtattcagactgatcctcaaattcatatggaagtgcaagggacccagaatacccaaaacgatcctggacgtgaagaacaaagttggaggactcatactttccagtttcaaacttagtacaaatctactgtaatcaagatagttaagtactcacatagagatagaaatatagatcaatggaaagaattgagaatccaaaaataaacccttaatggccaaccaatacagttcaattgggaaagaatgccgttttcaacaaatagtatggagacagcagcattccacatgcaaaagaatgaatttagacctttatttcataccatgttaaaaaattaactcaaaatagatcatagtcctaaatgtgagagctaaaactgtaaaattcctagaagaaaatatcataaatctttatgaacttggattagacaatggtttcttatggaagataccaaaagaccaagcaatgtaagaaaaaatggtaagtaggactgcactaaaataaactgttgtgcttcaagaaagcacaaaaagtccatgtgtggtggctcacgcctgtaatcccagcactttgggagtccgaggcgggcagatcgtgaggtcaggagattgagaccatcctggttaacatggtgaaaccctgtctcgactaaaattcaaaaaattagccaggcgtggtggcgggtgcctgtagtcccagctactcgggaggctgaggcaggagaagggtgtgaacccaggaggcggagcttgcagtgagctgaaatcgctccactacactccagcctgggcaacagagctccaaaaaaaaaaaaaaaaaaaaaaaaagtctgggcatggtggctcatgcctgaaatcctaatgcttgggaggccaaggtgggaggatcgcttgagccctgagtccaagaccagcatgggcaacacagcgagacctcatctctcttaaaaaaaaaaaaaaaaatcaaaagaattagctgagtgtggtggtgtgttcctgtagtcccagctactggagaggctgaggatcgcttgagcccgggagttcaaggctagagtaagccgagatcacactgctgcactccagtttggagaacagagcaagacactctatcaaaacaaacaaatgaacaaaaaaaccagaatgggagaatatatttgcagatgatatatttgataagaaacctttatccagaatatgtaacaaacttacaatacagcaatttaaaaaatgtttaaaacttggcaaatgatttaaatagacatttctccaaaaaagatagacaagtggtcaagaagcacatggaaagatgcttgacattaccagtcattagagaaatgcaagtcacaaccatagttagataccatttcatactcactaggatggctataatctacaagagacaacaacaggtgttgacaaggacgtgaagaaattggagccctcacactttgctagtgagatttttttttccccttgcccccaagatggagccttgctctgtcatccaagctggagtgcagtggcacgatcgcagctcactgcaacctctgccttccggtttcaagcaattcttctgcctcagcctcccgaggagctgggattacaggcatgtaccacaacacctggctaatttttatatttttactagagatggggtttcaccatgtttgccaggctggtcttgaattcccgaccttgtgatccggccgcctcagcttcccaaagtgctgggattcaggcgtgagccactgcgcctggccaagattttaatatgatgtggtcactttggaaaacaagttggcagttcctcaaaatgttaaacagtcgtcatatgacccagtaattctactcctaggtatatttccaagagaaatgctcatctactgatgaattgctaaataaatgtgttatagcaacacaattgaatattatttggcagtaaagaggaatgaaatgctgacatgtgatacaatgtggatgaaaatatgctaagtgaagccagtcatgtgtgatttcatttatagtaaataagcagaataggtaaaacaatagaagcagaaagtagattagtggttgccagtgtctgagagaggggagaatgaggactaattgctgggtttcttttgggggtgatgaaaatgttctgaaattagatagtgatgatggttgcaaaactgttcatatactaaaaaccactgagctgtacagtttaaaagatgaattttatggtatgtgaattatatctcaaacccgttatgaattttaaactccaaaactattcctcaaggtattttgggcataaagatcaaaaggatttcagagggtagagatactatttctagattgggtagtagattgagaatttgtgaatgaggtgtgtttgagctgagtggtttttaaggaaggtgaacacttagatatgtagctgtcaccaaaaggaagagttttgagtcacagaattcagcatgaggcaagctcaggaaatcaagaatatctttgggagggaagttgtagttcagcttagcagttgtacagagtctgtaaaaaaaaattcaatccaaaatttaattggaaaggtgggttgggcccagagcagagggaccttggagtgcaaggaattctctgccttatttattatttatattttatttttattttttgagacggagtcttgctctgtcacccaggctggagtgcagtggcaccatctcggctcactgcaagctccgcctcccgggttcacgccattctcctgcctcagcctcccgagtagctgggactacaggtgccgactaccacgcccagctaatttttttgtatttttagtagagacggggtttcaccgtgttagccaggatggtcttgatctcctgacctcatcatccgccctcctcggcctcccaaagtgctgggattacaggcgtgagccaccgcgcccggccttgtctgccgccttttgtcagctatagggagtgggtaaaaaatgacaggcctcagagctgtgtattaggaaaactgacagctgagcctttgcattagctagaagggagggagcccacctgtggaagtacccccttaggagtctcttgcagtcggttgagaagaagggtttcctgtcttgaattatctaaaactggaattattttggttaaattgtgggccttctgatacaaacttggtgaatttgaaagtcctcacacacatattattctacttcattttctgggaaaataaatctgtttcctagtaaagaactgtctgggcctgctgaacggtggtgtgtggaccctcattcaaccaatcccgtgcacggcatcttctttttcttctattcctcgccacctgtggtggtgttgttgtttttcttctctatttcctctctccctttctaccccaactggatctactttctccctgtccctcagctttacctgcccacctccaatgataagacagtatcagagaaaattaccagtatttgtgcaacataaagtaagtttgatgaaaaccatattagagaaaacagcatgcagaaacctttccatgaaacatagatggacacatgacttgtaggctgtgttaaaaaactttaatggaaaaatatgctaaatgtgatgaagttcttttctaagtaaacttaatataaaagtaattggggtatagaggagactcactgtgagtattctcaagcctgtaacttccagagctcgtgaagatttcagcattcccatttgtgacttgctattaaactcttttctgctattttgatgtctcctattttgacgtcctgaatagcaaacttatgaccctgattatgcctcaggtcatggattatgaaatggttaccacattcctgagatgttaggaactaaaaggttgtcatattttcatatgtttatgatgaggctatctaacttataccagttaccaattttttttttttttttttgagatggagtcttactctgtcactcaggctggatctcagctcactgcaacctctgcctcccaggatcaagtgattctcctgcctcagcctcccgaggagctgggattacatgggtgcaccaccacacccggctaattattttgtatttttagcagaggtgggggttttgccatgttgtccaggctggtctcaaactcctgacctcaggtgatctgcccgcctcagcctcccaaagtgctaggagtacagacgtgagccactgtgccctgccaaatttttaaaatgtctttatcaatatgctatgtgttttttaatgcaatccgagatcaagtgtttgatagaaatgataaattcgggctgggcgcggtggctcacgcccgtaaccccagcactttgggaggctgaggcaggcaggtcacctgaggccaggagttcaagatcagcctggacaacatggcaaaaccccatctctactaaaaatagaaaaaacttagctgggtgtggtggtgggcgcctgtaattccagctactcgggaggctgaggcaggagaatcacttgaacccaggaggcagaggttgcggtgagctgagatcacaccactgtactccagcctgggcgacagagtgagactccatctccaaaaaaaaaaaaaaaaaaaaaaaattgctgtaggcatgtttttccaggtttgatttttttccagagagaagtatgcacaaacagttaacactgttacagtgtgagcatcaggatggagttatccaaaactcaaaagaagcctttttctttaaatagtttgtcaaattgtttgtttttcggggggtgggggatttgagggagagggcatggtgttaataggatggctaaacggtggtggatcgggtcttctgttctgttcaagtgagagtgttaaagttgtgagaagacctagtgttgaagacaaacgctgtggtattctgagagggagggaagcagagaagctcaggccgggggcaggttcacatcaggaggtccatttttgagtcttggctccattacttactgtttacctgagccaagttgccattcttcctgagcctgaggtttttcaacataaaatggggaatttgaaaggtcaaataaattaattcataatatttgtgttgtctggtttattataaacgttgagtcctatggagagtttagagatgttaccattcatatttttatgatatatagaacagcttaaagctccccctttggtgtaagtatagtatatagaggtataatgttctgaataaattacttcagttatagtttgtgaaacctgattatagctgatactctggaaatgtaactcagttgtagtccagaattttatgctcaaggtggtgctgtttccccataaatctgatgatgttttacattttatctctatctgttccaaatcaagcaaataactggatatatgtctagggccatttcggccttccacagtcccccaagccatctttccttgtgagaccccacccaaaatcatgtcatagaaatgtgtatttaccccatattcactagaacacatgtgggagcttaagagttgagtataccagtggacctgttcaacattttggaagacatttgttaaaaaatactttagatactacagcttgctttttgtattttagagtcagtttgtttttaggtcagaaatatttgaaaagcttgtaagccctggctcctaatggaataaaggacctaatatagttcttctgcaaactgattacgttacaagggaaaatactcatttcgaacttatttttgctcataatctctttccgggccgccatattaatcatttcctacttgttgtcagaaaccagacgtgcatttcatagatgtggtcgttgtgtgtttgatgtgaattgttttgttttgtttgtttttagatccggggatttctttcacggtttgataatgtccttcccgtcagcctggcatttgacaaatgtacagcttgttcttccaaagtaagtcattttgtattggagggacttgtttttaaaagtgagcgggtcagcatttgaccgcagcctcaccagctggagcccttgaaaccaactaagggctttttgtgggggaagggtggggtctaaaccctcagaaaggactttgttttcatggatctgtattcattctcacagtggtttaaaaccagcctgagaaaatgtgtagggagactgagttaaaatatttcaactctgtatcaatacttgcatcatgctaattttgtcttgaatttgaactttactgctctttgttcctccccagagggttccctcctagccaggaccctcatagagcaattttttaaagcgttactctgagggtgaggcggccctggctatgcatcttctgcagatccacataattacaaagaaaaagtaaacagagattaggggcctggatggggagccactaaaagggccccttcagctttgatctttccagaagctctaaaaatagagctggtatgttagccatcgtaatgtgaaacggctgatatatctcaaaactacagtgatggcatctcgtgttttaataggctttcggataccatctgagtgatttttacatgcacactgtatgtgatagctgatttcctttcaagtgttcctttcagccttctgctgcccagcgacttgacctgggcttttaaggctcatgattgctgataagtaaagattttcatgttgaagtgctatacaaaataatgttggtgaccactaatccccaactgtggcttctcagttacaatttggaactatttttcgtgtagccttcgtctgtctgccactgtggaagaaagagaattctagggatgtatttctctattctgagttgacaagcttcctttgaaaactgtacttgggctatattttatgggaagcacaatcctgaccagtttctctaaaaattgaatgtagaattgacaagcaatgttgataaatttggttacgtttagatgctcaaaaattgagactaattattttctttttgcttccgaagtaaactaagcctgttttattatgcatcccaagtgcctatgttgagatttcaagcttagactttgtcagtagttacccatgagcccattctttctgtagtttcctttaagatacatctgctcaagccaggacctcaaggatgtctgcatgcacccccatcttcagaaatgcaagttttaggattgtatactacatctttagtggagcagattttttttttctttgaatggttgagctaactggtctcaaaataacttggcagtattaattttcatactgaaatcatttggcacaggtgccaggttttctatggctttatgttggtctggctagtcaatgaaataaagataattgggttctctaagtgaaatgcaaacactcattcattcttgttctatttctaattaaattagcctttcagatactgtttataaaagaatcacaagcataccatctaactgggcgttccttatactttaaaagagaatagcttagcatttttctttcacacttattgtaagcttttaattaaatataggtatcacttttttgttagcaaaattatttcctcttggtgatcattttgagagtcctgctttacataaacatgttggacgatttaatacaaactgacttggattttaacagctgtgctattcccatagcggtcacttttcatgtggtctgagtattaaatttcttttgtgctggaaaggttgcttcattggtgcacgtatttccttacagtagaaacgcagcatttacttacttggctaccttctttatttgcttaggagattgtcattctctattatctgcaaacccaacattaatactttaaaatgacaaatccaattacattttcatttctgtgtatttgaatttttcttaatgtatatttagtataatacatgttatacagagtcatgtcatagttgttgtttcaaaagattggggctaaaaattacttttaaaaatttatcctttgacattcatgaagtaattttttcctttggtagttttcagtatgtttcctcctccccaccaggatcaaggccatgcttgtgtcttgatttaaccacaaatagagacagactggggaagtagaataagtttctgctgaatagtgaagcacttgttcattatcttatttattaaaaacaaacaaagcaatacattatatacacatatatatagagagagagagtgcgagcacgcacgcacgcgagcgagagctttttatgtagcctgaggtggggaagaatacagtgctttgcttctaaagcaggaaagttggaacatttatccataaatcatttcttatcctatgtgatcttaggttggcacataacgaggtgaattgttccatcttaggggaaaaatattgaaggatggtggggagaggtgggtggtgaggagtcactttcattccagtttctacttattgtcttgcagaactttctaaacagatggtatttgtcaatgaaatttcaaaagaccttatttgacgtttatatgagttgctctttacttctacaaagaaattccaagctaactagagtattgtggtgttactaccagagggaaaagtataatttttaaaatcaatattcctgaaagaatttcctgtagtgcattaaattactttgttattgttagactttcacctaaatattttttggcagagtatttttgggtaactttctattgatataattttaagcttaacagaaacattggaagaatagtacaaggaactccggtatacactttacccacattcatccattgttaacattttgccccacgtatatttgctgtcgtcctccaatccctccttcttcccttcccctaccccatttttttcttgaaattttgagagtaagttggagacattctgatcctttaaaactgaatgcttcaatgtgaattccaaagaacaaagacattctcttacctaaacacaatatccttatcaaattcaggcaatttaatgtttgcacaatactattttctaatccacagtctgtgtattcaatgttgttgtttataccagttaatgttcattataggttttttccttccagaccaggatccagttgaggatcaaacattgcatttagttgtcgtgtctctggctcccttcaatctggaaaagttacttcatctttctttatctttcttaacttcagtgttttgatattttgccagttatttttgtagaatttccctccatgtggatttgtctgatgtttccctatgattcgattcaggttatgaatttttggtggaaataccaaagaagtgatgctgtctcctcatgtcaggagttatataatatattatatacctttcggtgatgctagttttcccttttccatatttctgactaccttctccaacagtgagaaacctgcaatctcggctcactgcaacctccgcctgcctcccaggttcaagcgattctcctgcctcagccccacaaatagctgggactacaggcacttgccaccatgcctggctaattttttgtatttttagtagagacagggtttcactccattggccaggctggtctctaactgctgacctcgtgatccgcccgcctcagcctcccaaagtgctgggattacaggcgtgagccaccgcatccagccgtatcctggatatatttactcacttgctgaagtctagaataatacaggaagtagtttcaaaattgctagcccatactactacagaaaataaacctagaaccttcagttcctatttgtgcatagttctttttttcctaggtaaaatttatatatggtgaaatgtatgaatcttaaaacaactccgtaagttttaacaaatgtatacacccatgtaacccacactcttcctatcaagatattagtgtttttccatcactccagaaagttcccaggtaccctttcccagtcaattctgggggaaggggaagtatgttgtatattatgactagtccttctctaaaaggagtaaagctaggcagcttcaggtgttctttgcaataataaccttgtttctggtacccagaagttgaccaaaaccttttttcagacctgcagagtcaggagcaggactgtgcaggaggagactgcgtgcagagtattcttgctcttgttgcacaattctattactcacaaccttcttgatagtgcaagaacagcctgttgtgaagaatcaggctccaaacttggtttgcataccatctgggacctgcgcagatgcagcaagatgtgcccagaaacctgatcttgagatttcagtgattagcaaccttaataatacactcattctggtgttgactatgcaataggttcttctgttgatgggttatgattaaactcctcaaagtgacttgctattagctttctgtgtgtatctgggcatatatcttgaagagtgatagggtaagggttaggtaggaataataaatgtcagctggtaaatcgtactttgttttggccttggttatagccagcctgtccatttatttttttgatattatataatcctacctaccttctatcatgttttcttgttacttatgaagcatgaaaggctaggcatggtggctcacacctgtaatcccagcactttgtgggggctgaggtgggcagatcacctgagcctaagagtttgagaccagcctgggtaacatggtgaaatcctgcctctacaaagaatacaaaaattggccaggtgtggtggcctatgcctgtagtcccagctacttggggggctgaggtgggaagatccttgagcccagaggttgagatcatgccatggcactatagcctgggcgacagagcaagactctgtcatgcccatgccccaaaacccccgccagaaagaagcatgaaataacaaaaagtcaacttagctgcttaaatagtgtttttgtttgtttgtttgtttgtttgtttgttttgggacggagtcttgctcacttgcgaggctggagtgcagtggcgtgatctcagctcattgcagcctccgcctcctgggttcaagtgattctcctgcctcagcctcctggggagctgggactacaggcgtgcgccaccacacccagctaatttttgtattttcagtagagacggggtttcaccatgttggccaggttggtctcaatctcttgaccttgtaatctgcccacctcgacctcccaaagtgctgggattacaggcgtgagccactgcgctcagccagctacttaaatgtttaagagaaacctctgtcccaaagcaacttgtcacctaaggactttgcaaatgcaccacttagaaaggcaaatcatagatttgaaaggaatggttaaactgttatctgttagcagacattcatttaattcaactgacatttgagtccctgctgtgtgccagagatacaaagatgattacaatagccactgtcttcaaggaacactgcctagagggtgagacagactcataagccaataatgatctgttcagttgtgaaatgccctacagcaaggtctgtcctcttgttacggcctcccaataccaattaattttgtaaatgtggaggactagggaaggccttgcagaggatgacttctgagttgatgttaaagggtcaagtaggagtttctagaaacacctaggggagagaacacaaggaattccaggcagtggagaattgcatgtataatagccagagacaacaaaacatggcagttatgaagttgtttagtagagcagttgtggctgagcctgggacacccaattttctacaaatcgtcctcttgtctttgtgagtgccgttttaattttggccatccttggagttggaatctggtatacgttgtctaatgcttaaagctgctgttttgaattttacgataacatgtaaaactcttgctcacctagcaccgagctttttagggagtttcctagcctaaggaatccagcagctgcagcagggtggtgtggagggcaggaagtcaggggatttccagggtcctggctctgcatcccttgctggactgccaagtgaccacaagcaaggtgctcccccactctgcccgccttcatttattttcttcagtgagtcagttgaatgagataagttctggctctctattgacactttattagcttttatattttatatttcctttatttcacaagcaatggatttttaattgcagaaaaatcagaaaatatatttaagaaagaaaataaccacgatccagccatttagatcactgttaattggtgatgtcaacacttcttgacttaaaatatatatgtatgtatataggtatacatagacatcatttttccctgaacattcctactataagggatttatggtactatattgaggatactccctgcttctcagatttgatagggttttaaatctcaatcatttacaaggactggccagagcccagtcggaagagctctctgcagcctgtgccaggaatctttgcatacagcttctcagtggcaaatattactcaaaactgggctgcagccagattttccttctcctttccaaaagggatataaatctctgatttggaaaatgatgagtaacccccaggttctcttttcctatctcatttacccagcaaggcctcaaatcttctattttaatgtatgatggattccatatgtatgattgtgtggtataaaatatatcccacatcttgtccttagcaactagtgttttctccaatctccagaactgcttggttcccaaaaggagatggaatatacagccagagctggtgaggagtatttagctacaagccttaacctcagaactcttggctcttcactgccttgaaaaaccttggacatttctccctttgcttctatttcctcatccatacagtggggaaaatattttctgtttcccagggaaattgcaatggctgacgtgtatccagttccctgtggccaagtaccaaggcctttgcccactcctgggactggtgttgacatcagaaataagaaaacaaagacccctgtgattgcattaggtctcctgagatacatgcagccttttctgggctcactgtccacacacaggtataatgggagggattgaatcagggatttgaaggccaaggctgccctggctttgaaaggctgcagaaaccttccgttcatgtctcttgacaatgacagccaaaaccttttccatgattccagagaacacggccttgcttgttacttttgacctgtggtttttaagactacctaattagtagttagaacttgtgatgattactcctttccctgtcacctgtggtcacaaacacatctagttttcccagacaaattttttcttacaggatcccttttgccactcagaccagaaagttgagggctgtgttctccttagatggttccattggcagcctggcccaagcatagtcttcagggtattgaaaaattgggttccttttagtttggaattaatctcattcacctctagtcttatccccaagcctattcttaaatttttttgagtcatggattgtgttcagactgatgaaagcagtcaccactgttccccttaaaaatgcaaagccagctgggcgtggtggcgcacacctgtaatcccagcactttgggaggctgaggcaggcggatcacgaggtcaggagattgagaccatcctggctaacacggtgaaacactgtctctactaaaaaggcaaaaaattagccaggcgtggtggcaggtacctgtagtcccagctactcaggaggctgaggcaggagaatggtgtgaacctgggaggcagagtttgcagtgaaccaagatcacgccactgcactccagcctgagtgacagagcaaaagaaaaaatgcaaagccacacagttttacagacaatttcagaggcttcatgaagtccctgaaacatctctgtggatcctagtaaagcaccattgctctatgagtgtttctttggtaccattcccaagctctcctagatgagacactaggatatgagagttgcaaccagtcccaccatggctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaaaagtatgtgaaagaactgtttgagaatgtcttattcctgaagttacccttatgacttgttcatataacatgttatactgtatttatgatagtgatatggatatgaacttaatcatagttttctagagtgtctgaccttctctagttttatataattctttcattatgaaagttttgttagtgctttttttttttttttttttaacacagaataagctacatggttctcttctctagaatatctaatgactggttaaatcacatagcaaagttagacatcttgaatttacagccatcatactaaaacgggaaaataccgcctgtgtgggccttaagctactgcaagtgtgccaaatgtgaacagtcagtgggagaatacacatgagcaagttttgcaaattagaggagtcttcttgacagtacacaagggtgtattcagcagagtcttgagtaaaggcagcatcattggaatatatgtgcagcctcccacgaggactactgtggagcatgtgttgaatcgtaatctgaactcacctgtcgtcataagtcttggcagctaaggtgtctttgtaattgactctggattcactgaagcatttggatattttaaagaactctattgaccttccaacttgggatagaaatccatgcaaaagcatatttttgtgttatgtgcgaaggcctgggaaaaatttggatttctcttagttctcagttgtactttgcattttcctttctttatatgtcagctcttccacaaaggaccttgaagggagagggtaacgaaagtggggattgaggcaagtggtaattactcattgttgtgttgaaacctcctacgtatcccaaatgtggaatgtgagctcaacatcgctctttcttaaagaagactatttattttgttgcctgagtaaaaccttccataaaattgctaataggcctatgtacaatattttcgttatttcagtttgacttgactgataaggaagattgattttaatcataaggcacacagattttttaaaaagtgagtgcaaaatgacttgctaatagactaatgtctgagtaagaaaacaaaaacatgtgtctcccagctctattggaggagcaagagtttcatttaacaatatctgctgtctttgcctaatcactcactagttgctatttttgataatattccaataggcgctgaaagtatacctggaaaatgagacctatgtcatcctatcccactcagcagaaggactgcagtcccaacaaatggaccctttcacagtgctccctggaggagactgtatgtttctgttgggctgtgctagtttgatctgttcttcttgggaaattgcttttactctcacagtattttcctcataatagcctcagcagtggtaactttttgacctttgtgggtgggtttgattttttttttttccagaaagtaatttgaagctgtgtgttgtgaataaagagaatgagcaatttgcaggaaatttttaaaaaactgtttaaagtactgcaaggcttaaaatggcacatgggtgtgaacaaatgagaacgttagaagggaattcaaaagtatcctatcttttgagctaagagctggcaggacattttgatatgactagtgcagcagcagtgagcactggctttatctgctacccactaaccatgtgaccttgagcaagtatctcaaactttgagcttcagtttcctcaggtatgatgtagttgcagtaccatagccatgaagttggaataagagctcgtgtgatgggtgtcatgtagttggcactgtcagtgttttccgttgatcttttgtctgaacagagatcaggtgccgttcccatttcctttcctgaatatactcatttttgtcatttacagccataaaaaactttccatctttagaagttgacaaaaaaggaggggaacaaaaaagggcctggcctcaagatgtgagcaaatactaatgtgcaagtttttagattctttttctttttctttccttttcccttttcttttcatgacagctgtaaatctaggagcttaattattaacctaaatgaagctgaggtttaatgttccccggagcatgcactgatggggaaggatgaattctcatttcctggaggctgaagatctgtgcaggtgtctgtggccaatgttaagcctacgactttagatgagctggcataaatcttgggagagttttcttgtctgtgttccctctgaatttctctgtgctgttagaggcagggacagaagagaaccagcatggcagtgctgggctcagggtgatgcctgcctgccagcacagcggttcttgtccctgtcccacattgcttcttggaagcctttttacagcctcaatcatcttgctttttctaccgcagctataaatgggttggaagccagtgcaacatgggcagggaggacttggtttaatcttttcaagtgctacagcatttctctgttcctttggcatcgttttatggatgttttcccagtatccctttccagtgtcttatgaattggctagcaagagcgcttcccagtctatcagatggagagagcattaggctcagagaaattacatgaaagtccaggatttccaacttcttgttcacttttctaccatattaatcatctctcagacagtgatgtggtaggattcatatgcatagaattccattgtacttattggggggggggtaatttcactttaaatttttagcagcttcgaggacttaattggttaggctccttcaggctgtctttggaaatcttgtcctttgaaaagggaatgctgatacccagaggaatgtatttcttatggtcatgtttcagactgtagcatcttgaaagtcatgtgggctagagcaacttctaggtgtcctttagcacagatgcaggctgggggttgagagtttaaaagctttttctcaaactgtttatgacaaacatagttcatctcccattttggttaattctcagcttaagtattttaagaaacatttggagggcagggacatgcagctgctaagaatccaagacagtgctgttttgaaaatgcaaatatttctggtttgcatttacttgaagtagggtagctttctcccatatattcccttgaatacagatattctttaaatgacatcattttgagtagaatacagagtccaggtggttttggggaaatcattaaaaaaacaaacaaaaaaaacaaaacaaaacaaaaaaacaaaagcttaggtatcattgcattctaggggccaagaaacagaacgatggtatttttggcaggcacccaggcccagcaaaacccacaccccaaggctgtctctgtagcttcctgtggttttcccactgaagagaaacagcctttctcttggagggcctgggatggcaaatacgtatatcagcttgatcagaatcataatattccggctttgaggttatgtcccaacaggcttcatttaggaaatttgatgcaccacaattgttgcaaactgagctgaactgattttgtggctcctaatggtgcaagttttttgtttgtttggtagaaactggtaacgtcctatattagaagttatgctaccaggtgatctgtaacaataaagtcaagtctcagactaaattttgccacggataagaacattagcaagcaggcacaaaagttagtcattcagcatgttcctgtggactgggaaaagccccaacctgtcctttggatatgtatctcacgtcaaagtttaggtagaaacagatgcagaaaaattctcaatacaggacacatctaaacttttcattggcgcaggtgatggaatcctctgttaagtgtccagacccaggaccagagtgccactgcagagagtgttaggctgcctggtttgccagattcttataacccacgtatatatgcaaggttagagatccctgtacagtatttccagccaacacatatatatattgaattctattgttttcatcggaaaaattatttctaccatcctttatacttgtgaggaaatcctctagtatagatttcaaagctgtagctgatgcttttgtaatagccacacctggggtatgcactcctgattagggtacctcagatactaactagctacccataagaggaagggagggagggagggagaaagggtttgtgtgtcttcccacatacttgcatgcattcatactgtgtattcagaaatatttaaaaataaattacagataataggtatctctttatttgaccctggaaatattatgtcttgtataatgttgccagccattcatgagtgacttgaaatgtcaactgacctttggcctgccatggtgttttagtcagagccattgatgaatggctcaccatggggcagagaagagagaagagaatgataatttttgatagttttgtaggttttttttttcttttatctcagtctcattcggttgcccaggctggagtgcagaggtgcgatcttggctcactgcaacctccacctccaaggttcaagggattctcgtgcctcaccctcgcaagtagctgggaatactggtgcatgccaccacaccaggctaattgttgtatattttgtagagatagggattcgccatgttgcctaggctggtctcagactcctgagctcaagcagtcctcctcccttggcctcccaaagtgctgggattacaggcataagccaccatgcccggccagctttgtaggctttttcaagcttttttgcattctttcatttgatattctggtattgtggagatgttgtatcccccactcaattttatacacaaatcgttgtccagggtcatagaatgagtaaattacaggaactataacttgaacgaactctcatcctttatagttcctctgtactataagggcaagttactaccaagaagagctattactattcttcaaagaataccatagaactttttcaccttggggcagttattgccaaggtaagaccatgtactaaggatatattatataacagaatgctgggagatttctgtcttaactagtgataggacaggtgatttaaaccagctctcttactgaagtcaccttaagaaactggatcagttgcttctaaaaatcttcttaaacatcaaatcactattataaggagattctgagttgagctttgagagagaatgtaagcacagaggagcaaagccgtagtattagggcaattttttgttttatggccatttgctgatcaggaaaaggaagttgagagcgtgagccacacctttagtgtcctttcaaggtgaaggagataaaacttgtagtctgggtgctttcaagcctgagaacccttataaatcattcttgactttgggttggaactctatcaagagatacacctaggagtaagggtgaagtgggtgtaaaccatccctcacattggctgtaacaatttcacattatttaagtggcccggaaaccgtaaggcttccttgcattaagataattctatttagctaatgcccatagttgccaggtaaaagcaatgaaatcttagagggaaatatgatcctagtcctaaaattatttatatagataattttgctgttacaatatccagccacagaggtaaccaggcacacaagaagagaaggtaccataagtgagagttggcagaagcaaagacaaaagaaatacagacatacagagattctagatattgtacttattagacatacactatgaaatactattcttacagcattaaaggaagtaaaagcccaaattttagttgtattggggactggaaactctaaaatacggctttccagatttaaaaaactgaaatctagaactgaaaattcaaaaacaaaatgaataggtgtataggcaattatatacatctaaagagcaaattagtgaaatggaaaataggttagaagaaacttcagagtgaagcactgtatacacaaagatggaaaatataaaaaaggtagaagatagagtgagaaagtctaacagtcataattggaaatctagaaaaaaagaaataatggttctatagcaacattgaatgggattatagataaactttttttgaaacaaatgaaaaacctgaagcctcaaatccaagaagcccaacaaatttataacagtacaaataaaactaaatccacaccaagacccatcataatcaaacttcagaaaatggaatataaagacatcttaaaagcagtgggggatggggaaaagacattaacttctgaagaatgatggtcaggcttacagttgacttgcagagtgtgagccacatgacaatggaaataacttctttagtgtgctgaaggaaagaaacgcatcccacaattttaaacccagcagataataccgttcaagaatgaaagggctgggtgcagtggctcacgcctgtaatcccagcactttgggaggccgaagcgggcagatcacgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgtgaaccgaggaggcggagctcgcagtgagcggaggtcacaccactatactccagcctgggcgacagagcgagactctgtctcaaaaaaaaaaaaaaaaaaaaaaaaagggggggggggaagagtaaaagtgaaggtattaaaggtattttgtatagacaagaacagagtccaccactagcgtgtttacacaaaaggacttttattgggtcctctccaagtaggaggaaggtgatccaaaacgttaaatcagaagtatagggaaaaaaaaaaaaagtatagaaagtggttaaagatggggataactctaggccaggcacagtggctcatgcctgtaatcccagcacttttggaggctgaggcaagcgcatcacttgaggtcaagaatttgagaccaggcttgccaacacagtgaaaccccatctttactaaaaatacaaaaattagccagacgcatgcctgtagttccagctacttcagggggctgaggtgagaggattgcttgagcccagaagtttgaggctgtagtgagctatgattgtgccctgtaccccagcctgagcaacagagcgagactgtcccaaaagaaaaaaaaatgtgggtaactctaaatgaacatttgaacatttactgtataagaaaatacaatattgagtgggatattttttaaaaatagaaatttaaggccgaggtgggcggatcactcgaagtcaggagtttgagaccagcctggccaacatagtgaaaccccgcctctacaaaaaatacaaactaaagtttagccgggcatggtggcagacacctgtaattccagctactcaggaggctgaagcaggagaatcacttgaacctgagaggtgaaagttgcagtgagccgagatggcgccaccgcactccagcctgggctacagagcaagactctgtctccaaaaaaaaaaaaaaaagaaaagaaaagaaaagtattaaaacttggaggaggtaggtgattggaattagtctgttctaaggttcttgcattgtcttggaagaggttaaagataggaattaatgcttgactgagataagtcaaggatatatgttataactgatagactaaacagtaaacaaatagaaaaattgtataacttctgattaaaaatgaaaaaattgaaaaagatgatttaaaggaagaaaaaaacaagtacaagatacaaagcacaagaagtcatggtaaactgaaacccacatgtatcagtaattacattaaacataattggttaaatgctggcggtagaaagattatcaaaccagatttttaaatttatatgcattatacaagcaatatatcttaaacttacagaatgactgaaaataagatataagaacataatattttagtattgaattttcaaaaatcagttgaaaataaacttaaataccacaagaaagctgctgtagctatattagtatcagacaaaacagattttaaggcaaaaagcattaatttgtaatacaattactttataataattggttttaattcaccaggtagaattctaaatttgtatgtatttaataacatgtctataaaatatataaaaaatttacagaactaccagaaataaatgatttttcccccctaagatggaagtcttgnnnnnnnnnnnnnnnnnnnntcctctaatttgcaaaacttgctcatgtgtattctcccactgactgttcacatttggcacacttgcagtagcttaaggcccacacaggcggtattttcccgttttagtatgatggctgtaaattcaagatgtctaactttgctatgtgatttaaccagtcattagatattctagagaagagaaccatgtagcttattctgtgttaaaaaaaaaaaaaaaaaaagcactaacaaaactttcataatgaaagaattatataaaactagagaaggtcagacactctagaaaactatgattaagttcatatccatatcactatcataaataccagtataacatgattatatgacacagtcatacagggtaacttacaggaataacgacatttctcaaacacgttttcttcacatactctttttgtttgttttcttttattttgttattgagcatcagtggtctactcatctgttgccccacaggcatggtagtcacgagtggacacgcatctgcgagctccacttgcaagcctccagcgctcactgggtatacaaacgattacttctgcctcagcctcccaagtagctgggattacaagtgtggctaatttttgtatttttagtagagacagggtttcgccatgttggccaggctggtcttgtaatcatgacctcaggtgatctgcccccctcagcctcccacagtgctgatattacaggtgtgaaccaccatgccaggcctatatttaggtacttaaaatactctaagtagtgatatatacattgtataaagcctgtgtgtgtaagaccatatatgtccatcaaagctttcccagttccagctgatggctcccttgtttcagcagtctgggtagcagttacaagtccatgttcctccctccctatcttacaaagttattgagggtatagacaagaggatgaagatgaatgtactatatgaataaaaaaaagaaagaaggggccgggcgcagtggctcacacctgtaatcccagcactttgggaggccgaggcgggcggatcacgaggtcaggagatcgagaccatcccggctaacacggtgaaaccctagtctctactaaaaatacaaaaaaaaaattagccgggcgtggtggcgggcgcctgtagtcccagctacttgggagactgaggcaggagaatgacgtgaacccgggaggcggagcttgcagtgagtcgagatcccgccactgcactccagcctgggggacagagcaagactctgtctccaaaaaaaaaaaaggaaaattttaatgaattattctcagtaattgatgaaaaaaggataccaaaagaaatcgggaagggttattgaacttggttaacatgattaataagcatattctagtgaatacatatagaatactgcacctaactgaaatatagaatactgcacctaatttgaaaagaaatacatattcttttcaagcacacacataatattttacaagaatttgctggcatagacgggataattaaacaagtttcaacaaatttcagagtgaaattatatagatgtatactgattccactgtaattatgcaagaaatcagtaataaacagataactagaaaatcatccccatgtgtttggaaattcagatacatacttataaaactcattaattaaggatgacataatggaaattaagaactattttaactgaatgattaaaaaaattataccaaaatttgtaggatatggagaaagcagtacttaataaaaatgtggctcatgcctgtaatctcagcactttggggcgtcaaggcaggaggatggcttgaagccaagagtttgagaccagcctgtgcaacatagcaagaccccgtctctacagaaaattaaaaaattgccaggtgttatggcacatgcctgtagtcctagctacttggaggctgagataggaggattgcttaagcccgggagtttgagcttatagtgagctctgatcatgccactgcactccagtgtaggtgacagagtgagtttgagcccttgctaagaaaagccttaaaacaggcccgaaattaatgagcaaatatttgtatcaagaagtcagtaaaagcaacacaataaatgcaaacaagtagaaggtagaaattattacagagaagaacagaaagacctgtaaaattgctaaacctatggtgaggctgagcaaaaggaagattaacatgtatcttagcattgaatttttaaaaatcagatgcaggctgggcgcagtggctcacgcctgtaatcccagcacttggggaggctgagataggcggatcacttaaggccaggcattcaagaccagcctggccaacatggtgaaactccatttctactaaaaattaaaaaattagctaggtatggtggcctgtacatatagtcccagctactcaggaggctgaggcaggagaatcgcttgagccccagaggcagaggttgcagtgagctgagatggtgccactctactccagcctgggcaaaagagtgagacactgtctcaaaaaatagaaaaatataaatcggatggaaaagaataaatttatagttcaatgttaaaaaacaaaatgaagtgatattattaaggaggcaggcagatttaggtgaaaaattatgaggaaaagtagagaaattattatataagtcgctggttttaagaggtaagtaaggagttgtaatgtagaagtggcctacctttccttccttcctttcctccctcccttccttccttccttctttccttccttttttgacagtctcactctatcgcccaggctagagtgcagtgacacaatctcggctcactgcaacctccacttcccgggctcagacgattctcctgcctcagcctcccgagtagccgggattataggcataagccaccatgcccagctaattttttatttttagtagagacagagcttcaccatgttggtcaggctggtcttgaactcctgacctcaggtaatctgcccacctcggcctcccaaagtgctgggattacacgtgagccacagtgcctggcgtggaagcgactttgtagggacttcggatgtaatgtgttgatgttcttgactgggttgtagttacacagatggtcactctacactatgtatagagtataatgtagcctatagactatattttacatttctgttacttcacaatgaaaaatgttaagaaaataaataggtgttctgcatgtatgcttctgctggcatgcccatcatttacactgttctttatgccagacaggaaggttcacaacctgacactgtgtctttcagagaatgctcatcccagcttgaaggctcttaacacaagaatttccaattagtagaggtaacctgctggtagatcatataactcatcaaccttaggctgtaagagactgagtccaatgtaagttttcaataatttacccacccacaccatacttaatttaagccagggtatatgaacttcctgaaactgaaactgttccctcttatgctgagtacccagataataggggtaggccaataaatcaatgagcagagaggactagcttgaagacaacagaaaataaatagggactgtggccaactagagctcaagttctctccgtggagcagctgcaacccaactctggatgattgttacttgcagactactgggaataacgttgccatattttctgattttttttcctttgaagagtagatagaaatgtgaattttaatgtgcaagtacctgatttttaagtgttggttcacaccgcaccccccaccccgaaatactgcttgagtcaaaccaaacctgtacctgggatatgtccagttagtttatgagaataacctcaacagccatgcagattggagagagagaataatgtataaaataatgtactataaccttcttgatggaacttgcctgcgaagcatgttcttatataattctcaacttcaaaattaaaagaaactcaaccaaaattcatacattacaaacgtcactcagggtaataattttcttagtgaaacctggctctctctgcaggggaatgaatttttttaccgtaagtaatttattaaagggattgagtaaaactgctaaatagtgatatcacgcaaagcaatttcttttaggagaaatagctaaagatggactttaaaaatgtgctgcttaatgggttgaatcccaagacgttgtgctcctgtttagatgtagcaggcattttcaaagtggtccgagcaccagcagcatcagtgccatttgggaacttgctagaaataaaaactctcagaccccgccccagacctaattaatcagaaactgtggggttgggcccagctacttctgttttaacaagccttcctggggattctgaagcatgctcaagttttgataaaccactgctatagcttttgtgctttgtgactttttttgtagaatgactttagaaagttaaactttgttattttaaggtttcaagtgaatattttcttcaatgttgacatcttccaagtatccttcaaataatatctttggtttggcttatgtcagtcaagtatgtgttggtttaaaaagatgaccgagaatagaaagttgtatcttctaaaaattcattttaaagtgagattcgtatataacagcagacacaattttatcctctttctgcctttcttatccactacactcatggtatccactcacagcctcactaaggaagtcagtccacttcatgctcagcttttaacttaggggttttttaaatgtatgcataggatgtatcatgcacagaatgccatagaatccttctctgacccctccttctgttttataagccattctgtgcataaggccacagtgacttcacactggactctggttctgcctcctactaaatggcagagtccaggagggtcccacaacctgtgtactccaggcctacagactataagctctaagtaatggatgctcagcaaatattttttctttgctctagggtctcaactctcagcaggattaatagctgtttaacctacggtgatccttttattagtttgttacagtaagaaatgcatgttttaattggattggaagccttgaaccttttcttaaataataaacatttttatgttgaggtaaaacttaaaaacagtaagtacacagatgttaagtgtacaacttggtgggttttttttcacatgtaaatacccatgcaactgagacaggaataataacagggtggtcgcaggagaatagaaaattccaggcagcagtttcacatgactagcaaaaggaaactgttgaaatagctgcatagactgggcgtggttgctcacacctgtaatctcagcatttgggaggccaaggcaggcagatcacttgaggtcagaagttcgaaaccagcctagccaacatggtgaaacccggtttctactagaaatacaaaaattagctggggtgtagtggcaggcgcctgtaatcccagctactcagaaggctgaggtgggaggattgcttgaatccaggaggcagaggttgcagtgagccaagattgtgccattgcactccagcctgggcaatagagtgagactccgtctcaaaaaataaattaaaaaaagaaatactggataagctaggggctgataagaccctgaaaaaccagggtgtgaaccaagctggctaagaatgactgcacccaacatggctgtggatttgacctaggtttcacctagaacctccttatacattcattaacatatcacacatgcaccagccccgtgaaagtcaaggccagcctgggcaacatagtgaaaccccagctccaaaaatataaaatcacagaatagaaggaaaatcaactgtcagatgctgctgagagactgaatgaggattataaatggcaagatacaggtcttcagtggtctttttatattaatataacacattttttaacaatttttttaatggagtcagggtctcatagccaccacacccagtttatttaacaatcgacgtcaacaattacctggttacatagacttaccagattaatttatcaatttagcagttaatcaaattagatttctcctgttttaaaaatattgaatataaatttcaatgcttttaaagtcttaattaaaaccaggaatctattctcttaaatgcttaaagtacattaagacatatcaaacaaacactttgctgtagtgattacaacgttgaatagtacactaacataccatttataaatatgttgatgctatggatctaaatttgtgtttcttaaagatattcaagagctttattgagatacaatttacataccagaaaatccacccattgtaagactagagtctgataattcgtagtaaatgtaaactgacgtgcacctatcaatctgaggaagtcttgacaagagtcttttggagtgcggagaggaagtcctcattggagtaagttaaagagagaatggagaataatatagatgtttcaagggttttcttttttttttttaatctcttaagggtattgggggaaggtagtaaggagaaggagattaagagggattatgtctaaaatggtaattgtttcatcttgtttgtgttcagagaaaatctggagggatagcttgtctgattccttctgtttagataataaaggatgaaaagacatcatttaagaaatggaaactagcaaatgtaaacttttatgtagtttttaaggttttttcttctggtgagttacttgcatttcattgggagaaaaatcttcctttaaatgttattgataatcaattattaagtaggtgaagcagtctggttcctttttcctcacattgctttagaaattaatacgaatgctaatgaaaaggcaaggaatataaaaaccaacaacatattaatgaccctgaggtcgaagtatgaatatcacaagggcaaaaatagttctacacattgggcatttcagtggatattggttactccttgacaaaagatggcactccttatgcagaaacacgctggatttcccaaagaagcgtataaactagagcaggttctcttaaatctttgaatgaatgcactgagttagttttggctgttactgctcttggaatgtctttttgtttgcatttttccaatttacctccttgttgacatatcaatatttaaaagaaatctcccccccagatttttgacctacaatagtataatctcaaatattggattaattggtcagagcatccatttaaacattttgatttttataatgtcctgcttattaaccagctcaatttttttttttttttttttttttgcggtagagtcttgctctgtcgcccagaccggagtgcagtggtgcgatcttctcggctcactgcaacctccatctcccgggttcaagtgattgtcctgcctcagcctcccgagtagctgggattacaggtgctcgccaccatgcccgactaatttttttatttttagtagagatggcgtttcaccatattggccaggctggtcatgaactcctgacttcaagtgatctgccctggttggcctcccaaagtgctgggatacgggcatgagccaccatggccggctccagctcaaatttttttaaccagccttcaatgctcagccaagccattaatacctctgccttgccttttatctcctgcttgcattcttaaggtcagctagactgagtttagggccttctcagatcttccctgagcaggtgtgtggttttgggcatgtacctagccttgtgcctgtgccatgttgtattagtctttctcatgctgctcataaagacatacctgagactgggtaatttataagggaaagaggtttaatggacttacagttccacatggctgaggaggcctcacaatcatggtggaaagcaaaagggaagcaaaggcacatcttatgtggcagcagacaagggcttgtggaggggaactccctttataaaaccatcagatctcgtgagacttattcactatcatgagaatggcatgagaaagacccgcccccatgattcagttacctcctattgggtccctcccacaacacatgggaattatgggagctacaattcaagatgagatttgggtggggacacagccaaatcatatcacatattttctagattcttaagaatatgcttcagcttttcaaagcctcctttagtattttccagattttttaaagctttttgttggcttattgttacttcagctgttacataccaagtcaggagatcatgatgttaaacagttgcctctgatagttttcaacagttggccctggaaaaaaggctgggtgaattctgaatcaggtcaaatgaggacattttgtcagtggatcttcctgacaccatacaggtgacattttctaaaaatgaagatttatagaagctctgactctaaactccacccccacccccttgcccccactgactattgggctgccggttttcactgtgattatgtgttactgatgttcaaggctactatggagcttgagggggtgaggcgatgagaataggagaagttgaaatgccaaaaagcttattgttttaccaagattcagtttttcttgaatacacagccccagattttgtcagccttctctttccccttatagaaaggattttcagaggttcttactccactatttttgctgacattgctatgtgtcatcttgtcatgtattttctgtgtttatcaagccctatttggcaataattatattttacaagtagtaagtgtgtagcatttctttttttttattatttttatttttgagacaggatctctcactctgtcgtccaggctggagtgcagtgttgtgatcatggctcagtgcagcctcaacttcccaggctcaggtgattctcccacttcagcctcccaagtagctgggactacaaatgcatgtcaccacgcctggataattttttgtagagatggggtttcgctgtgtttcccaggctggtcctaaacttctgggcttaagacatccaccgccttggcctcccaaagtgctaggattataggcatgatgcctgtaatcccactgcacctggccatgtgtagcatttctctttccttcctttccttttcttccttccttccttgcttttttttgtttttgtttttgttttttttgtagatggaatctcactctgttacccaggctggagtgtagtggcatgatcccggctcactgcaacctctgcctcccaggctcaagcgatcctctcacctcagtctcccaagtggctgggactataggcgcacatccccacgcctggctaatttttgtatttttggtagaaatggggtttcatcatattgccaaggctggtctctaactcctggactcaagtgatctgcccaccccagcctctcaaagtgctgggatcacaggcatgagccaccatacccagcccatatgtagcatttctattgccatgtttttttgagacagtttcttgccccatcacccaggctggagggcagtggtgcagtcatggctcactgaagcctccaattcctggcttaagtgattctcctgcctcagtcccccaccaagttactgagattacaagcacctgctactgtgcccagttaacttaaaaaaaaaatttgtagagatgacatcttgctatattgcccaggctggccttgaactcatggcttcaagcagtcctcttgcctcggcctctgtattagtccattttcatgctgctgataaagatatacccaagactgggcagtttacaaaagaaggaggtttatcagacttacagttccacatggctggggaggcctcacaatcctggtggaaggtaaggaggagcaagtcacatcttacgtggatggcagcaggaaaacagagcttgtgcagagaaactcccattcttaaaaccatcagatctcataagacccattaaccatcaccagagcagcatgggaaagacccacccccatgattcaatcatctcccactgggtccctcccataacatatgggaattatgggagccacaagatgagatttggttggggacacagagccaaaccatatcattctggccccgtccctctcaaatttcgtatcttcacatttcaaaaccaatcatgtcttcccaacagtcccccaaagtctcaactaatttcagcattaacgcagtagtccaaagtctcttctgagacaaggcaagtcccttctgcctatgagcctatataaatcaaaagcaagttagttacttcctagatataatgggggtacaggcattgggtacatacagccattccaaattggagaaattgaccaaaacaaaggagctcaggcttcatacaagtctgaaatccagtgaggcagtcaaatcttaaagctccaaaatgatctcctttgactccgtgtctcacatccaggtcatgctgatgcaagaggtgggaaggcatgattggttcccatggtcttgggcagctctgcccctgtggctttgcagggtgcagcctccctcctggctgctttcacagactggcattgagtgtctggctcttccaggcacacagcacagttgtcagtggatctatcattctgaggtctagaggacagtggccctcttctcacagcttcactaggcagtgccccagtaggaactctgtgtgggggctctcaccccacattttccttccacactgccctagcagaggttctccatgaggaccccacccctacagcaaacttcagcctgggcatccaggtgtttccatacatcttctgaaatctaggcataggttcccaaacctcaattcttgacttctgtgtacttgcaggctcaaaaccacgtggaagctgtcaagtcttggggcttgcattctctgaagccatggcatgaactctgtgttggcccctttcagccacagctggagtgtctgggatgcagggcaccaagtccttaggctgtacacagcacaggggaccctgggctcagcccttgaaaccattttttcctcctaggcttcagggcctgtagtgggaggggctgccacaaagttctctgacatgccctggaggcattttccccattgtcttggtgattaacattttggctcctagttacttaagcaaacttctgcagctggcttgaatttctcctcagaaaatgggattttcttttctattgcattgtcaggctgcaaactttctaaacttttatgctctgtttcccttttgaaactgaatgcctttgacagaacccaagttacctcttgaatgctttgctgcttagaaatttcttctgccagatactctaaatcatctctcaagttcaaagttccacaaatctctagggcaggacaaaatgacaccagtctctttgctaaaacatagcaaaagccacctttgttccagttcccaacaagttcctcatctccatttgagaccaccttagcctggaccttgtttatatcactatcagcatttttgtcaaagccattcagcaagtctctaggaagttccaaactttcccacattttgctgtcttcttctgagccctccaaactgttccaacctctgcctgttacccagttccatatttgcttccacattttgggtatcttttcagcaacaccccattcctggtaccagattactggattagtacatttttatgctgttgataaagacatacccgagactgggcaatttacaaaattaagaggtttattggacttacagttccacatggttggggaggccttacaatcctggtggaaggtaaggaggagcaagtcacatcttacatggatggcagcgggcaaagagagagcttgtacaggggaacgcctcgttaaaactgccatatcttgtgtgacccattaactatcatgagaacagcatgggaaagacccacccccatgattcagtagtctcccactgggtccttcccataacacattggaattatgggagctgcaagatgagatttgggtggggacacagcaaatccatattagtctcccaaaatgctgggattacaggtgtgagccatcttgctggccagagcatcttttcatatgcttacttgtatatcttctttggtgaggtatctgttaagatctttggctcattttttaattgggttgtttgtatttttattgttgtgttctaagagttcttcatgtattttggataatagtcctttattaaatgtgtcttttgtaaatagtttctcgtggcctgcagctggtcttttcatccttctgatagtttctttttcagagcagaaatgtttaattttaataaagtctagcctaccagttacagatggtccttgacttataatagtttgacttacaatttttcaatttaccatggtgtgagagtaataggcattcattagaaacatatttcaaattgtgaattttgatattttcccaggctagtgatgtagtatgatattctcttgagatgccatgcagtggcagcaagctgcagctccactcaaccacacgatcgtgagggtaaacaactattgactagtactctatgttgcactgtgttgccagacgatcttgcccaactgcaggctgacataaatgttctgaacacgtttaagggaggctagggtaggctcagctatgatgttcagtagttaggtgtaataaatgcattttatatttagggtgttttcaacttatagttggtgtatacccccatcataagttgatgagcatctgtttttctttcatagatcatgcctttggtgttgtatctaaaaagacattgccaaacccagagtcatctagattttctcccatgttatcccataggaggtttatagttttgtgttttatatgtaggtaggtctgtgatacattttgagttattttttgtgatggggtgtaaggtgtgtgtctagattcttttttttttttttccatgtggttgtccagttgctacagcacgatttgttgaacagattatcttttctgcattgtgttgcctttgccccattgtcaaagatcagttgactaaggtgggtctaattctgggctttctattctgttctgtgatatatttttttattctttcaccaaccacactgtcttgctgactgtagctgtacagttggtctagaagttaggtagtgtcaatcctccaactttgtcctttaatattatgttggcttatctgggtcttttgcctccctacaaaaactttacaatcagcttgttttatatctacacaatacattgctgtgattttgatgtgattgcattgactctataggtcaaattgggaaaaacttgacatctcgacatattaagtcctcctatccatgaacaagaaatatcactttatttttagattgtctccaacttctctcagcagtagttctccatatgtacatcttgtacacattttgttagatttgtacctaggtatttttgggtgttgctaatgtgaatgatattgtatttttttttaaattaaaatttgatagtatttgaacatcaattcagaaatttgtcttgttgacaaatgtactttattcatagatttttctttcaattttttatgtgatagaatacatataaaatttgccattctgtttttaaatgtacagctcagtggtattaaattccttcataatattggcagttatcaccaccacttaccttcacaattcttttcttttatagaactgaaactctataaccatcaaacaataactccccattttcttctctctccagccctgccagccacttttctaagtccctcataagtagagtcatacattatttgtctttttgtgattggcttattccatttagtataatgctctcaaagttactccatggtgtagcatgtgtcagaatttccttcctctttaaggttgaataatatttcattgtatgtagcatatactacattttgtttatccattcatccatggatggacacttggattgcatccacattttagctattgtgaataatgctgttatgtacatgagtgtacaactatttcttcagttccctgcttttaattcttttgggtgtatagccagaattgaattgctggattcttttgggtatatatccagaattgaattgctggatctaataattctcttttaatttttttaagtaactgccatgctattttttatggtggctgcagcatgttacattccaatcagcaatgtagaagtctttttttatcgtcacatgctcatcaacacttgttatttttctttttcgttgtaaaatagtagccattctaatgtatgtgaggtggggtctcactgttttacttgcagttctctaattatcagtgatgttgagcatcttttcgtgtgcttattggccatttgtatatctttagagaaatgtctgttcacatcatctgcccatttttaaacttggttgtttgttgttgagttttagaattacctgtatattctgtatattaatttcttatcagggctgggcacggtggctcatgcctgtaatcccagcactttgggagcccaaggtgggcggatcatgaggtcaagagatggagaccatcctggccaacatggtgaaaccccgtctctaaaaatacaaaaattagccaggcatggtggtgtgtgcctgagtctcagctactcaggagcctgaggcaggagactcacttgaacctgggaggtggaggttgcagtgagccgagatcacgccactgcactccagcctggtgacacagcaagactctgtctccaaaaaaaaaaaaaaaaaattcttatcagatatgattttcagattattttgtcccattccagaagttgcctttttactctgttgatgttgtccatctatgaaattcagtctattttttttgtttcctgtgcctttgatgtcatatttaagaaatcattgctaaatccattgttgtgcagcttttgccctgtgttttcttctaaaagttttatagttttaggtcttccatttaggtctttgatctattttgagttaattttttaatatggtgttaggtgagagtccaatttccttcttttgcctgtggatatccagttttcccagtatcattcattcaaaagactgtccttttttttttttactgaaacaccagggtattctgtctaggtcctgctgctgcttggtgcacagaaagccaatcactgagacaagtgtggccaagaaacaaggctttaagtctggtgctgcagccaaggagataggagctcagtctcaaatccatctccctgactgactaaaactagggctttatatagcagggaggaaacataacaatatgtaagaaaataaaaactagagaggggtaaggaagcatctggtgctgtgatctgatgagttccagttatttgattctttttttttttttttttaataggcctgaaggtcctttcctgagggaaggaactcagataaaacaaatatgagtttcaagctttaacagcagaagggtcaatttccatgtttatccaaaaacaactatctgtgggactcttgggttggtttcacttttttttgttggatgatcttggcactcttgtcaaaaattgagactgtatctgtgaggattgtttctgcgctctctattctgtttcgttggtctatgaatatgtcttgtctttatgcggtactatgctgaactttgtagctttgtactatagtaaatttgattactgtagctttgtagtaagtttggaaatcaggaagtgtgagtcctccagctttgctcctcttcttcaagattgttttggcaattaagtgtctcttaagattacatatgaattttaggatggctttttttttatttctgcaaaaaacaccgttggatttgtatagagatcacaatgaatctgtagatttccttgggtaggatcttaacaatactaattcttccaattcatgaatatggggtgtgtttccatttatttatgatggggtgtatttccatttatttatgatgtctttaatttcagcattgttttataatttttattgtataagtctttcacctgaagttaattcctaagtattatattctttttgatgctattgtaaataaacttatagtttctttttttagattgttcattattagtgcatagaaacgtaactggtttttatgttaactttgtatcctgctgctttgctgaattcagtttttgtagactgtagggttttgtacatgtaaaatcatatcatttgcaagcagaaatcgttttacttcttccttttcaatttggatgccttttatttattttccttgactgatttctctggctagaacttctagtactgtgttgaatagaagtggtgaaattaggcatccttgcctttttcctgatcttagagagaaagcgttccttctttcatcactgtgtatatttgctgtgggttttgttgcatatggcttttattatgttgaggcagtttccttctattcctagtttaagtgtttttatcatgaaaggggttgaattttgtcaaatgctttttctgcatcaatcgagatgattgtgtggcttcccccccgccccactttcttcagtttatatggtgtgttacattggtttttcgtccttgcattccaggaataaatctcacttggtcatgttgtataatccttttaatataagatataatctaatatgtagaaaactgtaaagatgtcacacaaaaaactgacttaataaatcagcaaagtagcagaatgcaaagtcaacacagtttactgttatttcattgaggatttttgcattaatttataagtggtattagtccatggttttctcatagtgcctttgtctagctttggtgtcaggctactgctggcctcatagaatgacttaggaagtgttccatctttaattctttagaaaagtttgaaaagcagtggtactagttctttaaatgtttgatagaactcaccagtggaaccatcaggtgcagggcttttgtttgccaggagatttctgattactgattcaatctccttattggttataggtctattcagattttccatttccttgtgatttcattctgatgggttttgtgtttctaggaatttgtctgtttcatctaggttatggtaattaggtttgtaatttcaaattccacttgttcattgctggtatactggaaaataatggagttttttgttttgttttgttttgtttttgacatggagtcttgctcttgttgcccaggctggagtgccatcttggctcactgtaacctccacctcctcccaggttcaagtgattttcctgcttcagcttcctgagtagctgggattccaggtgcacaccaccacacctagctaatttttaaatttttagtagagatggagtttcatcttgttggccaggctggtctcaaagtcctgacttcaggtcatccacccacctcggcctcccacagtactgggattacaggcatgagccaccgtgcccagcctagtcttatttattgactatgtatcctgcaccctatgtatcctgcagtgttgctgtgattgcgtgttagttccaacagtgtttttatttatttggattttctacgtgggcaggcatgtcatctatgaacagacagttttatttcttccttcccaatcagaataccctttatttctttttcttgtcttatttcattagctaggccttctattatgatgttgaaaaggagtggtaaggggattttcttgccttgttcctgttttcttgccttcttgccttcatggagaaacttctggtttttcatccaccattagttaaattcttagatgtagagattttgtggatgttctttatcaagttgaagtttccctctgttcctagtttactgagagtttttgtcataaatgactgttcaattttgtaaaatgttctttctgcacctattgatatgatgtgattttcttcttttgcctatggatgtgatggtttatattgattttcaaatgttgaaccaggcttgtgcacctgggataaatcctacatgatcgtggcatataattctttttatatacagtcatgtgttgctaaacgatggggataccttctgagaaatgtgtttggtgatttcattgttgtatgaatatcgtaaagtgtccttatacaaaccgtgacagcataagcctactgcacacctaggctatatggcatagcttgttgctcctaggctgcaagcctgtacagtatgtaactgtaatgaacactgtagacaactataacacaacggtaagtacttgtgtatctcaatgtatctcaatatagaaaaagtacagtaaaagtatggtataaaagatttttttaaaatggtacacctgtgcagaatacttaccataaatggagtttgtagggctggaagttgctctgggtgagtcagtagtgagtgactgtgaaggtctaggacattttgtacaccactgtagccttgaaaaacaacactaaacttaaaaaatatttttctgtcttcagtaataaattacctttagcttactgtaacctttttcactttataaatgttttgattaaaaactttttttactcttttgtaacaacacctagcttaaaacacaaattgtacagccatacaaaaacattttttctttatacccttatcctatacattttttcctttaaaaatttttattttattatttaaacatttttgttaaaaactaagacacaacatacacattagcctacgcctacgcagggtcaggatcatcagtatcactgccttccacctctacatcgtgacccactggaaggtcttcaggggcaataacatgcatagagctgtcatctcttatgatagcaatgccttcttctggaatgcagttaactttttttttttttttaaataagtagagggattacactttgctaaaataatgctaacatgtatagtatagtaaatatataaacataacatagttgattatcaagtattatgtactatatataattgtacgtggtacacttttatgctacgggcagcacagtagtttatttacaccagcatcaccacaaacatggaagtaatgttgttgcactatgacattgtgatggctacagcttcactagggattaggaatttttcggctccattataatctgtgggaccacccattgtatatgcagttcctccttgactgaaatgtcatgtggtgcattactgtatcattggattcgatttgctaatattttaagattcttacatctatgttcatgagatatattggtctgtagttttctagtaatgtctttatctggctttggtattagggtgatgctggccttatagaatgaattaggaagtattccctttgcttctgtcttctgaaagagattgtagatgattggtataatctctttcttaaatgtttggcagaattcccccagtgagcccatctgggcctggtgctttctatttgggaaggttattaattattgattcaatttattttatagaaataggcctgtttagaatttccatttttttcttatttgagttttggtggattctgtctttaaataattggttcaattcatttagtttatcaaatttctagatacggagttgttgatagtattcttttattatccttttcatcaatacagatctcatagacatgaaaaggataataaaggaatactatcactaaaaagtgattctctctttttgtcttagtctaattggaggcttatcaatttaccttgtcaaagaactagcttttggttttattgattgtttgtttctccattgattttctgttttcagtgtcattgatttctcctctagtttttattctcttttcttctgcttactgtggatttaatttgctgctcttgttacctaaggtgtaagatcagatgattgattttaggtctttcttcttttctaatatattatttcagtgatacagatttctgtctctaagcatttctttccctgcatctcatgaattttgatacattgtgttttcatttctatttagtttaaatattttaaatttatcttgagattttttattcatgtgttattgttcaaccttacatatattgagatattccaattatctttctgttgtgaatttctgggttccattgtggtctgagagcagactctttatgatttcttttcttttaaatttgttaaagtatgttttatggcccagaatgttctaccttggtgaatattccatgtgaatgtgagaagaatgtgtattctgtggttgttggatgaaagagagaggtgaattctatccagttgattaataaatagtgttttgagttcaagtgcgtcctttttaaccttctgtctgctggatctttctacttctgatagagcagtattgaagtctacagctacaaaagtagattcgtctatttcttcttgccgtactgttagtttttacctcatgtattttgatgcactgttgttaagtacatacgcattaagaactgtgtcttactggagaattgagccctttattattatgtaatgcccttctttatctaataacattatttgctttgaagtctgttctatctgaaattaattcagatacttctacttacttttcattagtgttagcatggcgtatttttttccatctacgtttaatgaataaatgtctttatttaaattgattttcttttagataccatataattgggttttatttcttgttccattataataatctgccttttaattggtacattcagatcactgattattgatataattggattaatatcttccatatttgtaactattttccatttgtcacctttgttcttttttgctatatttgtcttctagtcctttttcttgccttttgtggtttaccagcatttaaaaaattattattattattattattattattttttttttttttttgagacagagtcttgctctatcacccaggctggagtgcagtggtgcatcttggctcactgaaagctctgccttctgggttcacgccattctgcctcagcctcccgagtagctgggactacaggcacccaccaccattcttggctgattttttgtattttttttagtagagacgggggtttcactgtgttagccaggatggtctcgatctcctaacctcgttatccacccgcctcggcctcccaaagtgctgggattacaggcatgagccacagcgcctggcctgtatattttttaaggtagggtctcactctgttgtccaggctggagtgcaatcgtgcgatgtcagctcactgcagcctcaacctcccgggtttaagccatcctcccaccatagtctcccaagtagctgggactacaggcatatgtcaccatacctggctatttttttttttttttatattttgtagagacctggtctacaaaatgttgcccaggctggccttgaactcctggactcaagtgatcctcctatctcagctcccccaaagtgctggggttacaggtgtgagccactgtccccaaccaacatatttcaatatggcttcttttatctccctttgctggaagcaaaagagatttttctcgagtatttactgagagaacctggtttagctcctgtaagtaaaactcacaaaagcatgggggcctccctataactaggtccccctggagtttttatcactggggcttgtccacacctagcaatttttgtcagctacagtttgtttttctgcccctctcccagtttctgtggaggtttctgctccagcctgttgtgattctctgtatccacctgactgtctctccagttctgggagcagtggtgtcttagcctgttttcacactactatcaagaactacctgaaactgggtaatttataaagaaaagaggtttaattgactcacagttccacattgctggggaggcctcaggaaacttacaattatggtggaaggggaagcaaggcacttcttacatggcggcaggagaaagagagcaaagggggaagtgccacttttaaatcatcagatctcatgagaactcgctatcgcaagaacagcatgggaaactgcccctcccccccgatccagtcaccgcccaccaggtccctcccctgacatgggattacaattttagatgagatttagtggggacacagagccaaagcatatcaagtggtttctcctgtgacctcactgaagtttttgagaaatacatgcacgtgtattttttaagtcatcaagagcaagtaagtataatgctaaacaagaagttaataaaaacttcatgtttcctcccctctttgaaaatacattagcaattgtttttagatagagtgtacatttcctggagtcattgtttaagaataatagacaaacaagctgggcatggtggctaacacctgtaatcccagcactttgggaggccgaggtgggtggatcgcttgaggccaggagttctgagacgagcctgggcaacatggcaaaaccccatctctactaacaatacaaaaattagccaggaatggtggtgtgcgcctgtaatcccagctactggggtggctaaggcaggagaattgcttgaacccaggaggcagaggctgcagtgagccaagatcacgtcactgtactccagcctgggcaacagagtgagactcttgtctcaaaacaaacaaaaaaaaacacactacaaacccattttgcttctcatgaattgaaaatcattatatggtgttgtcaggagatcttagactctgtgaaaggcattttccagagagttgccgaaaattagaagggtgtgggggcgctgaaatgcctaggcagagaagataggtttgatatagtaaagagtaaggagtcaccaaagtgtcttagcaaggcaatactctaaaaatcatgttttaagaagagattctaccatctttgtccaaggtgtgtgtgttcatagagaaaacctagcctcccaaaacaagcaaggaaaatcatggattatgaaaggatctttctactaaaagagtcattattacttctctattttgcaaactctctcagtaccttcagaatatttacagccttccaaaatgtaatgtatacccttctcaggactatgcataatgcagttcacttaagaattgtgctatgttttacatagactgacaggttcttgttcaaattctttgtgataacatcttttcattttcttttcttttttgggtagttttaaatacattttcctttttaagaaggctaggatgtttggggggaaaaatccttgtactttttgtaagccacttataacacagattaacttcacagcacataaaaagaatactggagaacccttacatgattaaatatgcccctagaggattaagtttttccacatatttttaagccagtgctattaataatgttccagcattaaactttctgtacatcctcattatggaggaggcctttttttgtttttttcattctgcccttgctgttagtttttccgtggtcagatatgtagcactataaaattatctgtggaaacatacaatctgaatgtttaactggagtctaacaaagtatcatgtctggggctcttccaatttttattcaaagatgttgtcaatttttcaaacttaattgttcttttgtcttactggaaacctggcagaagatggctatttacaggcatatcttagattatggggcagaccaccacaatgcagctaatattgcagtaaatcaagtctcacaattcctttggtttctcagtgcatataaaagttacatttttactatactgtagtctattaagtgtgcaatagcattatgtctaaaaatacatgcataccttaagtaatacaaaatactttttttttttttttttttttgagacagagtctcacttgttgcccaggctggagtgcaatggcgcgatctcggctcactgcaagctccgcttcctgggttcatgccattctcctgcctcagcctcctgagtagctgggactacaggtgtatgccaccttgtccggctaattttttgtatttttagtagagatggggtttcaccgtgttagccaggatggtctcaatctcctgacctcgtgatccgcctgcctcagcctcccaaagtgctgggattacaggcgtgagccaccacgcctggccacaaaatactttttttttgctaaaaaatgctaacaatattgagctttcagcaagttgtaatctttttgctggtggaggttcttgcattgatattgatggtggccacctgatcagggtggtagttgccaaaggttggggtggctgtggcattttcttagaaaaagacaagtttgttgcagcagttggcttttcctttcagaagatattcctctgtagcatgcagtgctgtttgatagcattttacccacagcagaacgtctttaaaaattggagttgtcctctcaaatgctgctgccactttatcaacatgatgttctaaatctttagttgtcatttcaacaatgttcacagcatcttcatcaggaatagattccatctagaaaccactctctttgcttacctgtaagaagcaactcctcatctgttcaagtttgatcctgagattgcagcaattcagtcacatcttcaggctccacttttagttcccttgattttttcaccacacctacagtgacttcctcttgaacccctcaaagtcatccatgagggttggaatcaacttctttcaaactccttttgatgttgatattttgacctccttccatgaatcacgaatactcgtatctagaatggtgaatcctttccagaaggtttttaatttgctttgatcagatccatcagagaaatcaccctgtatggcagctattgccttattaaatgtattttttaaataataagacttggaagtcaaaattactccttggcacaagggctgcagaaatggatattgtcttagcatgcatgaaaacaacatttatctctttgtacatctccatcagacctcctgggtgaccaggtgcattgtcagtgagcagtaatattttgaaaggaacctttttttctgagcagtaggtctcaacagtgggcttaagatattcagtaaactgtgccgtaaacagatgtgctgttacccagattttgttgtttcagttatagagcacaggcagagaagatttagcataatttttaagggccctaggatttttagaatggtcagtaagcattggcttcaacttaaaagtcaccagctgttttggtcttgaccaagagagtcagcctattttttgaagctttaaagccaggcattgacttctcctctgtagctacgaaagtcctaggtggcatcttcttccactagaagacggtttcatctatgttaaaaatctgttgtttagccacatttctcaattttctgagctagatctcataataacatgttgcagcttctacatcagtacttgctgcttcgcctctcacttttatgttatggagacagcttctttccttaaacctcattagccaacctctgctagcttccagctgtgcctctgtagcctccttacctctctcagccttcatagaagtaaagggacttttagctttgctctggattgggctttgccttaaggggatattgtggctggtttgatcttccagatcactaaaactttctctgtagctcttttactttatttttgtgtgttcattggagtagcacttataatttccttctagaactttcccttggcattaacaacttggctgtttggtgcaagaggtttagcttttttttagcatgtctcagcttttgacatgccttcctcactatgcttaatcatttctagcttttttttttttttttttttttttttttgggagacagagtctcactccgttgcccaggctggagtgcagtgtggcgcaatctcagctcactgcaacgtccgcctcctgggtttaagtgattctcttgcctcagcttcccaggtagctgggattacaggcgtgcgccactatgcccagctaatgtttgtatttttaatagagacggggtttcaccatgttggccaggctggtcttgaacttctgacctcaagtgatccacccaccttggcctctcaaagtgctgggattacaaataggcatgagccaccgggcttggcctatttctagctctcgatttaaagtgagaaatgtgtgactcttcctttcacttggacactttgaggccgttgtaattggcctacattcagtattgttttgttgcaggaaataggcccaaagagagggagagagatggaggaatggccagttggtgaatcggtcagaacacatactacatttatctattaaggtcgccatcttatataggtacagtttgtggtgccccaaaacaattacaatagtaacatcaaagaccactgatcacagatcaccacaacagatataataataatgaaaaagtttgaaatattgtgagaattaccaaaatgtgacagagacacgaagtgagcacatggtgttggaaaaatggtattgattcctttgctcaatgcggggttgccacaactttcaatttttttttcttttgtaatcactaaacacatagtactcaacatttcaaaaaagatcacttaatttcagtggacattttttcctgacgtaacattctggtttataaggaatcttgttattactgaggaattgagttatttattaaatgccttttttttttccagggggttaggctgtcaaattaatttcccatggctaatcagcctgggcttgactctacgcacgtaatggtcctacactcccccagctctctaggacttgcagtctctctgatcctaacagcctgcaggtcttttcttaccagccaggactctttcccagtcccttcagtggtgctcaccagcccctcagtttctctgaccttaaccttttgatccttattctgccagtcccttggcttagatgggttcttaatttcttttctccccaaatttgtatttttctgtcctgaccagaggcgtcagattgttccacactgtttaaatgtgccagtcaacctctcttctccgactctctgcacagctgggcctcagggtcaccactcttctcaagccccatagtctaacccttctcgggtcacagaggacttcctgccagctatctagaccctagagctcccctgccccccgtcgcctggtcctttcgcttttcactgctgcagctttgctcaaccttccctcctcattcctgcccctgggggagagctgcccctcctttccagtgccaacctcttcatcagtgctttagagttctgcctcagcactaaacaaaaacaaaaaccaactaaagattttagtatttttatattaatatttaaaattgtctaattttaataaatgttaaataacatttggttttaagaaatattaaatattcaatgttaaataatattgtttattaacattaaataaaggtgggaggatcacctgaacccaggaggttgaggctgcagtaagctgtaattgtgccattgcactccagcctaggtgacagagcgagactgtcaccaacaacaacaaaaaaaacactgattgcagcaacaaaagttagaaagcactaccctttaacagagagctgattaaattatggtgtatttattatcggtggcaattaaataattttaattttaataaatattaatttttaatattaaatatttaaaaatcttattttaataaatattgaataattattaagtaacacatgcacatggatttaaaagttaaagtagtataaaataatctacagaggctactatttgatgtcagttgtgtgtatttgcattctgccagagatattcttccatagatgatacatgcataaacaagtatgtacatccatgcatttcttcttcttcctgtctcctccttccactctttttgaacacaaatactatctatacacagtctagatattgctttttaaatatattgctatgttttggaaaacaatttgtgtcagtactatagacctgcctcattcttttaatggatgcaaaatatcccttttttttgtttttgaagactctgtcacccaggttggagtgcagtggtgtgatcataactagttgcagcctcaacctcctgagttcaggtgatcctcccactttagcttcccaagtagctggaattacaggtgcactccaccatgcctggctaatttttaagtttttttgtggagacaaggtctcactatgttgcccaggttggtcctgaactcctaagctcaagcagtcctcctgccttggccacccaaaatgctaggattacaggcatgagccatcgtgcctggcccaaacagtgtttcagtaagcatccttacaacataagtctttgtgcccatgtacagctttatcattatgaagtcttaaaagtggaattgctggattaaagggtgcctgcattttcatcttctgaaaagaaaaaaaatctatttcttgtataattactgttctggtctgtttatgcattgttgatttcttagatatgtcttcaatgtctgctatctttttaaagcattcatctctttatttcttgtgagttcccagagaatttctgaggcattctggttcagcgttctacgtttcacagtccctgtgatcactgaattcctaaatgtgatactcattgtttctaagaactctttactgttctcctagtctcctctcaagtgtataggccttttatttcttaactttctatgtaaggataacatatatccaaaaaaaacacataagtcttctgttcaacttaatgaattctcaagaagtacaccttatgtaaccaatgcttagataaataaattattgccagcaccttggaatgtcccttgtgccccttacagtctctctgtgggtagccactatcttttctcctaacaccacagattcatgttgcctatttcattttaattttatataaatgtaattgtacagtacatactgcttctttcttttgtgtaacattatgtttgaaggtagtttgttctcactgatatatagtattccattgcatgactataccacaatccatttgttcattctactgttgatggtcacctcaatggtttctagttttgggctatcatgaatagcgctgctgtggacacttttgtttgtgtcttctggtgcacatatgtacacatttttgttgggtgtatatacacatagagtagaattgctgcatcatagggcatagagtcctggttgttccacatccttgccagcacttggtattttctttgtcattttagtctttttgataggtgcaaagtagtgtttcattgtggtttcagttttcatatcaactactcatgccatggagcccattttcatgtttattggctctttggatatcctcttttgtgaagtacctattgaaatttatttttccattttaaaattatttttaaaaatatatttggctagctcgtatgtcacacttttttgacaaaatcctttttctcctcccttctcatttatccttttaaatttattttcttggcttttctctcacctgttcttttctaaccactgaactttagagccactaactactcctaacttttctagaatttttagtgaatttgcatgaaacttactttgagaaaacattggtactcaaactggaagataatgttattgttattctaagaagggaaaagatgataaatactaagccgtactagttttttggccactagattgcattattatccccatgtttaattctcattttaattttatttttgacaagagcttgttagaagtgaaagtcttttaatttgcattttaagtctggagactcctttttaaaaaatgtaaatgttttacaggttcttgatcaatatgaacgagaaggatttaacttcctagccaaggtgtttaattcttcacattccttcttagaagacttgactggtcttacattgctgcatcaagaaacccaagctgctgaggtaagaacaaaacaagctttctgtagtgaagactgacatgcttaaaactatttgatattcgccatatggaaaaggaagaaagcaattaattttaatttttgtaacttagagcaaatatcactaaataagtctgctagttaccagagaacgaataaccctcagcaagtgctggatactgatgtgtgtaggttgctgtccagtaggtgcctaatacacaaaatcagtgtgataaaggaagtataggttgtagatttccaggcacctcttgtccttactgaagatctgcatgtgtatgaccattggagagagttggctttaatgtccatatatcaaaatgtaagttggtaaagacattggactccagctatgttctttagaaagaaggtattggactctggccatgttcttcagaaagaacatgcctggctttttcacgatttgatcagtcttcttagaccctgaaccccaccatgaaatggcttccccagacacaacccgagagagttatgctttgtttctcagctaaaatattttgcagatcttaatttcctgggtcattgcatcatttttttttttttttttaaagactgagtttaagaaataaattatcggccgggcgaggtggctcatgcctataatccaagcactttgagaggccaaggtgggtgggtcacaaggtcaggagtttgagaccagcctggccaacatagtgaaaccgtgtcttcactaaaataaaaaaattaggtgggcatggtggcaggcacgtgtaatcccagccactcgggaggctgaggcaggagaattgcttgaatcctggaggcagaggttgcaatgagccgagattgtgccactgcactccagtccgggcgacggtgcgagactccgtctcaaaaaaaaaaaaaaaattattgtgtttttccaaatgctcgctgttcttagaaaagggaatgctgtgtatggtggtagagctatttggatcacttggcaaaatgtgcaattcctcagaattgatgagtgagattaaatcaatcttttccccttagttacctggataaagaagccatgaggagaaatgtagcttatgttgtgtttccacaaactacataaggaaaaccttgacttcctgtgtcctgcaggggtagtgcacttgccattagtccttttaagttgcaattcttcccaccagctaaagagaaatatataaattatttctagctaggtggcaaaactcccccagccatcttgtcaaatgattgcatgggtgcaaagatctataaattcctccataggttgcatatcctcaccattcagggaggccccaagttgtcaatgaatagatggccaggcccaatactggaccagccagtggtgaaagggctgctgtttggagaggtggagctagtgctgagtataggaagaccatgtagaaataccaaagtcagacccattggaggtttgagcagattgtgagattttcaggtacaccagggaggcaagatagtacatctctagtgctggacttaaactgaaggcagtccttctttaaattgttttggtgccctctgggcattaaacagatgcagtcttccacttatggccaatagttagagccacaaagagtctatttcaagtttcaggagatgaatggcatctctgctgctctttgagagactttaaggtatttttcccctgaattgtgattgggttcccaggcagggttcagaacattgtgtttattgtctgccgtattatcttttaagcaatgctgtactgcctgatggtatggaagaggtaacatagatgtttgtaaacatacagtcatttgatggctaaggaagttttgccacccagctagaagtaatttacgtattgttagctagaagaatttcaacctgaaattgacccaatttttcactctttaaaacagagcagttgctagaatagtgggtaggtttctagatttaacctggtttatcttacattttagttggtcaaaccttaatggctttttcaaagacttagagaaagtttaaaagcaatagtgactaaatagatggtggagcagaagggagcatggtttcatccacgagcctgagttttctttttgaattttcctctactaaattatatctttagttttggaatcatacgtcacatcaaattttagattagagatggtaaactgtttggcctgtgagccagatacggcttgcaggtatgtattttttggcctgccctgtatgttaaattctgaataaagccatcatttaaaaaccacaagttttaggcggggcgtggtggctcacagctgtaatcctagcactttgggaggccgaggggggcagatcacctgaggtcaggagtttgagaccagcctggccaacatggtgaaaccccgtctctactaaaaatgcaaaaattagtcgggcatggtggcacatgcctgtaatcccagttactcgggaggctgaggcaggagagtgacttgaacccgggaagcaaaggttgcagtgaaccaagatggcgccactgcactccagcctgggcgacagagcgagactccatctcaaaaaaaaaatcacaagagggtctgaattttcccatttccaactttgaaaaatcagatctgggaactccagacatgcatctcttaatagtgatggttagctagagccaagaagcaaagtttatagataatgcacttgatataaaatttaaaggtattacgaaatactctgggctgggcatggtggctcatgcctctaatcctagcactttgggaggccaaggctggtggagtgcctgagctcaggagtttgagaccagcctgggcaacacggcgaaacctcatctctactaaaaatacaaaatctagcccggtgtggcaatgtgcgcctgtagtcccagctactctgggatgaggcaggaaaattgcttgaaccagggaggcagaggttgcagtgagctgaaatcgcgcgactgaattccagcctgggcgacagagcgagactctgtctcaggaaaaaaaaaaaaaaaaaaaattctgtgaaaaggatatcttccttctatacaggtcccttagctcctcagttcctttcctggagacaaacactgttgttactttcctgcccagagatattctttaggttatattctttatttagatgatgccctttagtaggtgacccttaataggtatttgagcttataacccgtcttcaaaaaggatcattatttttcttaactctgaataggactgtgttttaagataaggtttgaaatatagtacttagtagaggacctcctagcaacaaaaattactgttctaactacatcattttctattactttgaaaaatgtgtgtatgcgcatataagcaaaatatataaatatatgttaaaatatatatatacctttacgtatatctgtgtaaaagtagtgttttgatttacatacttgattctcaatgcgtttacaggtggtcagtaataaaaacacagaattctgcattctacgtagaaaggtctccacttatttattttagcaacacaatcaagatgctaaattaattctcattttgggttaactatttacatcaatcaacattggaattgcaaacgattcaactagataattatatgtgacattaccattatatactttgtttataaaatacgtgtttaaaaaatatactgaacatcttttgaaaatctgataccaagcactgtgctagtaactgaatacagaagttaatgagacactgaccctcaagggctcatagtctagtgtgagaagctgacatggaaatagtgagctctaatgcaataaaaaatgttttagtcatttgtatattaagtgctgagagagcagttacttctgcctaggggaataggatgtcaagaaaagcttcacaggaagagaacaaatatttcacttagttttaaaggatgagtagactatttttaaaaataaaagttggattttggcagagaaagagtagagaagggaagggcaagaagcctagggcgttctagactgaataaaggtctccgaggccaagtctttagtatattactcaaaatcatgagtagtgtgatgtacttggagccacagttacctgaagtcaacataatgttttttaataatagctttattgagttataattcacataccataaaacacaccattttggctgggcgcagtggctcacgcctgtaatcccagcacttttgggaggccgaggtgggtggatcacttgaggtcaggagtttgagaccagcctagccaacatggcgaaaccttgtctctactaaaaatacaaaattagctgggtgtggtggcatgtgcctgtaatcccagctactcgggaggctgaggcaggagaatcacttgaacccgggaggtggaggctgcagtgagctgagattgtgctgttgcactccagcctgcaagggcggggggaaaaaaacaaccacacacaacacacacacacctttttaaagtgtgcagttcagtggtttttagtatattcacagagttgtgcaaccattaccactctctgtttagaaaattttcatcccccacacccaaaacaaactctgaacctattaaaaggtcactccctgttccctcctccttccagcccctggcaaccactaatcttctttctgtctgtaaggatttttctattctggacacatcacataaatgatcctttgtgtctggcatcttctatttagcacaatgtttttaaggtttattcatgttgtagcaaggtacgcaattgtttttcatttaaagaaaaagtctcaatgctattacaattttccatattctttgcacctgtggtctgtctccctaaatatagcccctttatgaaggaggaatgcaaagctgatccaactagagactacaaattcctttatatttatatagaaaggggcacatagtaatgaattggaagccatatccaagctagaatcatctagatttagtgagattgactagtgcaacccaattttttgcactcatcccctgtccatcaggtacctggaaatgattgcaatgattttgaactaggttactggtataatcatactgctgttgagattagcaggcaaattaccaagttagttttttattggagggggagaggtcaatgtgtgagggtgcatagtggagactggggaccaggctgacaaagatgaattgttttaggtagtgatgactttgaggtaatgggataagtgagtgaaaatgactggttggcgttggagatgggatggagatggagcttggagaaaaagaatagcactagtaaatggatttagctagacaaaggagatttaccctattccatttagcacagtgaggagaggctagacagctaggatgcaataaaaaaaattttaatgagaaatgtgtgtggtagattaattttattaatctcaagttatagattaaaaaatttaagtaccacataaatgccatttgcctttgctaatgttacatttttatgaagaaggagccttgcataaagaatgatataatggacttttgggacttgagggagaagcttgggagggggggtaaaggataaaagacatattgggtgctgtgtgtacactgcttgggtgacaagtggactaaaatctcagaaatcaccactaaagaacttatctacataaccaaaaatcacctgtaccccagaaactattgaaataaaaaaaaagaaggggacttggacagatagccgtattctttgccaaattatagttacattctgctcatgggggattaggaggttcaatggaagaaaggccccactcagctttctcccctcttaaaatgttgccttgtaaattagggaattttgcataaagctctgacctttacttccaaggcctttactgagaatgggtttggatacttggagatagatcctgactccctatccctcctagatctttatttatcctatttggaacccagggaaatggccttaaagctgatgaaccacagggtgtccaagtcatggagctattgaggttctccccaagtatcttttaaattgctgcatttgggatgggcgcagtggcttacacctgaaatcccagcactttgggaggctaagttgggaggattgcttgggtctgggagtttaaggccagcctgggctagatggtgagcctctgtctctatttaagaaaattagaaattagccaggcatggtgacacaccagctacttataatgctgaggcaggaggatcacttgagcccaggagtttgcggcagacagtgagctatgattgtgccactgtactccagcctgggtgacagagcaagaccctgtctcttatttaaaaaaaaaaaaaaaaaaaaaaaagctgcgtttgttgaagaaatgctcagtctaaattaaacatatgaacaccttagccatgttccacaaaaatttgctgtgacttaccttcttagagttatttctcatcctatgagtagaataagtatcagttcacatgtatttatttgttccaactgtgggttcaacatcatactatgagaaatgccaaaatattttctaactgaatgtaactagagataagactaatttataagagagttaatagaacaagctatattggtatatccctgagaaattcaaattcctaagtccctttacccaatttccctgaaatacttcattcctattcatgaaagtttgcacgttccatgattccaggattaattttaggctgttttacttccttgccttgaccatattgtcagtatttgatgttgtaccatgcagttatgatttcagggttgcaattacagtgcaccattaatataatttgcattttgtcaaggttgtgctaaatagaacttcctttcctgcagatttggggattaatgaatgatcatctaaaaagaaagcaacaaccataacataggctataaaatcataaacagaccagcagaaatgaacagggctgagctgattaattggttatgaattaaaatgtagattgtgattcattcactatagaactcagaattctagaaaatgcccatttctctcatagccaaaaagtcatatgaaaaacattacggtcatgtgatatgacttcattggcacagcaatttactattcagcaaagtaaataacacaattaacaagtgtttctgctgggccttttgcacttacactgagattttggcctctcccccacacagctggttttgatttggttcctgtggaatatttttgttttgttttgttttgcatttaacaacagtcagatatttatgtacagcttcatcaagagcctctgatgacaaatatgcctttggaggccagcagaagctgtgggaaacccccgtgtcagcactcagacctgtttccaatggagagaaatcgctctggggactgaactagcctgctcatgaatccagttcccttttcccagagccttctgctagctcacttccaacccatgctggccatcctgggactgtgccctgccttgatttttccttatgaagcaatccctcaagacacagccttggccctctctcctgagtgagggaggaaaggcagaaacaggcagaaagccatttacttcttagattggaaactagagcctggtttttgaaataaagcttggcagtatctcacttataacttactttataaaatgtgtaccttttatttgctgtcagagttatctacatgaatttgagatgtttggataaatcgttattggggaaagttgcaattggaaaatagacaatgaagtctgggcagagttccccacccttcggaaaagagtctcggatggtataatccgcttggagaagtctaagggagaaagaaggggggaaatcataaatgctgaaagcaaagcaaagacagctaatattaggaaacagaacatgggaatccagtccttcttacattgtactcctggttccgccagtgttctcatgagtgaccttggatgaatccttcagtgtcctgtgcatgcttccccacttaaaatgagaggattgaatcatgtgaaattctttttttaagcctcctttctagaaaaaaatgaaatgcttttcaactctaatttagtgattttgattcaaatataccatgtataaccaaaaaggaaaaagatggataatttttacataaaagtgtttaaaaatatatcaaagtacttactttttatacattttataaatattctttggtatctattatatctagctaccattgccagaaacaactttttgcagattttgagatttacatctactttgagccttaatagaacattgcttatactttgtattgatgtgtgtcactgtacgtataaatctaaaatggtgtaattcagcctaataacttacctccttcaccagactcggtgccacttttgacttctttataaactcaaatccaccctggccataactgggtatgttcacgaaacatgctactcactacccctcagtacagcttccgaagatgagttccaaagccctcttactttaatagcagcatccttagaatgctgaatgtgtaataacaggagagttactttaataatcagccatattacattagaatactcataaagtgtatgagtaacccgaatcctggcctggtcagaaggtctgagttcatacctcagctcccacacatagccaagactgccatgttcctctgtgtgggccgtgtcaggcaggaccgtgtgcagcagtcatgtgagaccttgggttatttacttcattgaccttcgtttccatcattttgtaggatgtgattaataattcctactcctcacaattaccatattaagtaagaaggcaccttacaaaagaaaaatactggactccatcaaaattttaaattttgtgcttcaaaggacataagaatacgaaaaagtgggccacagtataagagagaacagcattttgcaaatcatacctgataagggtgtggtatctagaatatagagggaactctaagctgggtgtggtggcatgtgcctacagtcccagctgcttgggaggctggggtgagtgtatcgtttgagcccaggagctggagaccagcctgggcagcacagtgagaacccatctctaaaaacaacaacaaaacccagaatatatagggaactcttacaacttaataatataaagatacagaactcaattaaaaatgggcattagatttaaaacaacatttctccaaagaagatatacagataatcacatgatagcataatcaaataagatgcccaacatcaatagccattgggacaatacaaattgaaactactgtgagatggcattcatacccagtaagatggctataatcaaaatgacaacatccaatgtttatgaagatgtagggaaattagaagcctcctacctactagtgggagtgtcaaattctgcagccactttggaaaactgtttaacagttccttgaaaaattaaacatagaattaccatgtgacccagggattgtacccctagatatatacccaaggctactctggacaccctgcctatagggtagccctgttccacaaggagcagtaccaaaaattgtatatgtgtgtgtgtgtataaatatagcccagagaaatgaaaatgtgcacacaaaaaatgtacacagtgttcctaacactattatttattcataattgtcaaaaagtggaaacaatgcagatgttcattagctgatgaatggatggataaaatgtcagctattacgctggaataatggagtattcagcaataataaggaagtactaatacatgttatagtatggatgaacattgaaaatgttacactaattgaagaagccagtcacaaaaggacacatattgtaggatctcatttatgtgaaatgtccagagttttaaagtccatatagtcaagaaagtagattaatggttgtcagcaggtggggatgggggattaagggaaaatcagtggctacttaaaatgtttcctttcgaggtgatgaaatgttctaatcttagatagtgatgatggttgcacaacggtgattatactaaaaccattgaattctatactctgaatggatgaatcatatggtgtgtgaattatcaatacagatgtttaaaaagcaagacaaaaagtgcccatagttggggcattttgtttctccttccctctctcctttctctggttctctctgcatgcaatgttgattttctctctgtgacaggctgtcgtaggatgttagctcattgtttttaggaatgcgttttctgtagattatgacaaggatctcttccatttttattgtgcctcagttttcaaagccttagtctctgtgcacctcctttagccttttcttatgctatggatagcctgtaaacactgagggaagagatggaggggcctaccaaccaaatgcctcccctctgtgcttgctgtggggagagaaagccacagttggctccatccatagaagacatcgcagataaaggggttaggggaagatgagagcacgttgctatctatttgtgtaagtttaagcaggtgtttagaggatctaaatcccaacctggatctgaatttttaaaatttccctgtttaccacaggatttttcccccaagattttttagcttgaaaattcccaaatataccagaaagttgaatgaaaagtacagtgaatacccacatactcctacctggatccaacaattaacattttgccacatgtggtttatctctctgtgtacgtgcatgcactcccccgacgtcttatcacagttcgcatatatacttgctcgttttctcttttaaaccatttgaaagcaagttttatatacagcggcacctcacccctaaattttagcatgaatctgctaagaatatagacattctctgatgtaaacagagtaccatcatcacagaacaacaaagaataattccataataccacctaaaatccagtacatgtccgaattttcccagaaatgtacaggattttaaactattgtttgctttttcctcaagctggtaatattatacttagagttttttccaataatacttaagcactggtcatacataccaagtgatatccacttaagcatatctttttaattcccttgacaccctcacgctcctctctaaatggggagacacaattaccctattaggcaacatgcccctgaggtcctgctgctccagcaggcctcttctaggtgagcgtcttctctgggtgtcaccagggcatcctggtctgattgaagcagccctgagagccaaccagccctgagcagtggttcccacccatcctccatccagggtccccaatggtggaggcttttaaggaggtaggaatgggactatgaaggctattttcaatattttgaaaagtcaaacaggagtaaaacatttaggacttgaaaagattacattgaccaactgaactatcaagattttagccaggcgtggtggcttgtacctgtagtcctagctacttgggaggctgaggtgggaggatcgcttgaacccgggaggtggaggttgcagtgagccaagattgtaccactgtactccagcctgggagacagagggagaccttgtcttaactaaaacaaaacaaaaataaagatttttttttctttttaaactaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatatgtgagagagaaagtgaaaactaaaggaattcttggagatcaggaagtggagaatctctggcctgtggcgctgctgagcctaacttcctggcttcacatcagcagtggaggcttccctgggaggtgttcttgcagtttgccctgtgaccgctattctaggggctgtatttttacagctgacccttctcacttgcaaacataacagctgctatgtgttgaatttggggagtttccatattttgagactgtaaaattaaattgatttttagttctgagctcttagtcttattttctttttcttttctttctttcttttttttttttttttttgagacagagtctcaccctgttgcacaggctggaatgcagtggcgtgatcttggctcactgcaacctccgtctcccaggttcaagcgattctcctgcctcagcctcccgagtagcagggactacaggcgcccaccaccacgcccggctattttttgtagttttagtagggatggggtttcgccatgttggccaggctggtctcgaactccttacctcaaatgatctgcccgtctcagcctcagaaagtgctgggattacaggtgtgagccactgcaccgggcctgagctcttagtcttgatccatcttgcttctcagctgtaggggagcagggagggaagggaatgtgaaatatcctaaggtgtgtgttttttaaaattaaatattgttgatcttttatcatggcttctatcagtcaacagatatttattgaccctttgctgagttcatggtgtgggagtcaaagaggtacaagccaggcttttaggaggcagacgcagtatagttggggagataggacaggaaagtcactaggactgcaaggcagtgggtgtgcacgtggtgcagtaagttctgcagggtttcaggaacatcaggagcaagagagagctccagggaagagttaggttttgaggtgcgtcttgaaggttggagctccaagtgcaggagagaaaaggctttccagaagggcctgtggcatgaccacatccaagtctctgatgaagagtaccaagagaggtatagcaactaatgttaattgcgttatctgtgattttcagggcgcttttgtacctgcccttttgatgcccataacaatcttaggaggtgactattatcccattttatggatgaagttgtcaagactgtagctatgctcaggatttatctacatcttgaggtttacagtacacttcataaggctggaatcagagaggaagaagtgcatagggtgatgcagaggcattctgctttatagaacatatctctactttcatattgagcagtttccaaaagcggttttgctttttgtctgtgtccttacaactacttctcagatagcatagtttctttcactgtaccatcctggggccttactgtactttcttactcttaaactggcttctaataaaatccgtgggaatgagattttacttgtagatgaacttgcgactccaatcccaacttaccattgggaaaagagcaggtaagagataagtcctttctttctggcctttactcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctttactcttaatttccctttacaatttagggaagagttggtccccatttgcttttttttttttttttttttttttttttttttttgagacggactttcgctcttgtcgcccaggctggagtgcaatggtgcaatcttggctcactgcaacctttgcctcccgggtttaagctattctcctgcctcagcctcccaagcagctgggattacaggcatctgctaccatgcctggctagtttttgtatttttagtagagatggggttttgccatgctggttaggctggtctcaaactcctgacctcaggtgatccacctgcctcggcctcccaaagtgctgagatataggcatgagccactgtgcctggcccccatttgcttttattcagctatctggtgaaaaaaattcagtattaaactagaaatatttatatcttattgttgcaggacaaagttgttgagtttctaataacaaatatgtaaactgctgtgggatatttttgttttgttataatttgctgctagctttcaagcatctgtgtttatcctaccttaatcctctttgaaagaggccatacttaattttacccaatgctttattaaaaggaaagaaagttggatttttaaattttttatttattaattttttgagatggagtctcactctgttgcccaggctggagcgcagtgacatgatctcagcttactgaaacctctgcctccaggtctaagaaattctctacctcaacctcccgaatagctgggattacaggtgcatgccaccacacccagttaatttttttgtatttttagtagagacaaggtttcagcatcttggccaggctggtcttgcactcgtgacctcatgatccacccacctcggcctccgaaagtgctgggattacaggcgtgagtcactgcaaccagcctgcattatgttttaaagcaccagtttggaaccaatcttttagaggtaactgttacaagtttctgtacccaaatattggtttatctgtactctgtttcttccttcccctttctcctttttttttttttaattttttttttttttgagacagagtcttgctctgttgcccaggctggagtgcaatggcgtgatctcagctcactgcaacctctgcctcccgggttcaagcaattctcctgcctcagcctcccaagaatctgggactacaggcgcctgccaccacacctggctaattttcatatttttagtagacacaggtttcaccatgttggccaagctggtcttgaactcttgacctcaggtgatccacccaccttggcctcccaaagtgctgggattacaggcgtgagccaccgcgcctggcccaatttttgtatttttttataaagatgaggtttcactatgttgcccaggctggtcttgaactcctggcctcaagccattcacctgcttcgacttcacaaagttctgagattacaggtgtgggccatcacacccagactcttctctttctttcaacggtaacctgtggaaatacaatgttatcatccagtaccatgatcgctaggctgaagtaatagtaagccaagctctcttcagcccttagcagtgtgggcccagaaacagggtggtcttatggaagggagcataggatgtgggtcctgaagagaaggtgttcactcctggccccatcactagttgcatcacttcatcttgcctggatttcatctgtaaaatgggataatgcctactccacaaagttgatgtgctttgaaatctttaatacaaacatttgttattggaaactaaatacaaacgaaccaaatggaaaactagatttttttcataaaaatgtttcgggatatatatcataggcctttgaacgtaaatatcttgaactttaaacaatcattagccattaaaattttaatgtgtattaaatggatattattagactgtcaaagtgattagcaataggtggtttcattgtagaataacctattttaaagtattttagggccaggtgcgtgggattacatgcctgtaatctcagcactttgggagtctgaggtgggaggattgtgtgagactagaagttgaagaccagcttgggcagcatagtgagactccatctctacaaaaaaaaaaaaaaaaaaaaaaaaaaattagccaggtttggtggcacatgcctgtagtcccagctacttgggaggctgagatgggaagattgctagagcccaggagttcgaggctgcattgagctaagattgtgccacttcactccagcctgggccacaaagcaagaccttggctgtacaacaaacaaaacaaaaggaaaaacaactatttgattttagtcagggtgtaagaatatgtattattgttcccaaaaaaatctgtgtaaaaacttcatagtgtgaaacagtggcaactgcttgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctggcactcctactagtcttaaaccattatctcccttgaaaaatgagttctggctcactccttactactaaggctgaggggcaaaggagattatataaatgaaagcaccatgcatgtttgaggtggtttccttttcttcgttgttgttttttgagacagggtctcaccttgtcacccaggctggagtgcagtggcacaatcttggctcactgcagcctcaaccttccaagctcaagtgatcctcccaacctcatcctcctgagtagctggggccacaggcatgtgtcactatgtctggctaattttttgtatcttagtagagacagggttttgccatgttgcccaggctggtcttgaactcctgggctcaaatgatccacctgcctcagcctcccaaagtgttgggattacaggcctgagtgggattacaggtctgagtcactgcacctggccgaggaggtttgtattattacttgtgaatggaggaataacttgagctttagaaaagttaaagtgacaaagatcaagaaaatttccccccctgcttttttctcttatattttaatatttccaaatgagctataacatatgcagaaaaaagcttaaaacattttatatagagaacaagtatgaattaaacacccaggtcaaaaaatactctcgttgcccttcacccatctcatattttactttctgaccacaggcctagaagtaactagtaactagaaacagtaaacttttcctgtacaacttcagtctggtatatgggtcttaaacaatataattctatttgcctgactttgaatttttcaaacagaattatgctataatatgtagattctttcgtgtcttgttttgcccaatattgtaaaggttacccatttgctgtgcggctaaagttcattttcgttgctatgtagtgtttcataattggatatattgaaatttctcctctacggtagcatttctagtctcagattataatgaagtgtgctgtttggagcattctggtatatatctcctggggttcatgtgcagcatttctctgggtgtttctcaaccttcttttcattatcactcctcctagggggataatttaatgccaacagtttagaatttaattaatactaaagaatagggtttgtcagatagggctgagctttggagagccactaaacactgtcatatctaagatttcttttgcctgccaaagaccaatttttgctcctttgggggtgatatcaccctctttgtgaaggcatactgtaagttatttatctcatactagaattgttgggtcgtagaaaatatgcctcttctggaccatggacttaaatgtaaaacccaaaactattaaaaccctggaagacatccagacatcctggcccttacttctggacataggaacaggcaaaaatttcatgatgatgccaaaaacaattgcaacaaaagcaaaaattgacaaatgggatctaattaaactaaagagcttctgcacagcaaaagaaactatcagtaaatagataatctacagaatgggagaaaattttctcaaactatgcatctgacaaaggtctaatatccagcactacaaggaatttagacaaatttacaaggaaaaaaccccattaaaaagtgggcaaaggacataaacacacacttctaaaagaagacatacatgtggcgaaaaagcatatgttaaaaagctcatcatcactagtcattagagaaatacaaatcaaaaccacagtgaaatacatctcacaccagtcagaacggctattatgaaaaagtcaaacaatagatgctggcgaggttgtggtgaaaaaggaacgcttatacactattggtggaagtgtaaattagttaaatcgttgtagaaagcagtgtggagattcttcaaagacctataaacagaaataccatttgacccagcaatcccattactgggtatatacccaaaggaatataaatcattctgccataaagacacgtgcacacagatgttcactgcagcactattcacaatagcgaagacatagaatcaacttaaatgcccatcagtggtagactggataaagaaaatgtagtacatatacaccatggaatactatgcagccataaaaaagaagatcatggatggagctggaggcctttatccttacaaactcatcgaggagcagaaaacctaataccatatgttatcacttataagtgggagctgaatcatgagaacacatggacacatgggaacaacacacactagggtctggtggaggatggagggtgggaggaggaagaggatcaggaaaaataactaatgggcaccaggcctaatacctgggtgatgaaataatctgtacgacaagtccccatgtcatgggtttacctatataataagcctgcacatatacccctgaacttacaagtttcaaaaaaagaaaatatgcatcttcaattttattaaatcatgactgttttccaaagcagttcactgacttacatgaataccagtagtatatggtagtttctgtggtcccttatccttgccagaatcttggtactgtcacattttaaaatttttgccaatctgtataacagtatcatattaggcttttactttgcattttcctgatcactgatgatgttaaacgtcttatgtatattacttatttggattcttcttttctgatagtttctctacttcaactccaaaaattttcatatgttatgcttgtgtagcccctgtgaaaagaaagcacagtaggatgacctagttactcacttgaaaagtatgatggagcccagcgacctttgttctaatcccagatgtttgacttggtcagagtcccacacctctggccctcagcatcctcatttgctaaataaaagtattggctgggttagagcagcagttctgaaccttggctgcccatcagaattatctaggatgctttaaaaaaatgtttagaccacatctgcaccagaaagcctgattaaattggattaaaggttactatatccatttcaacattctgtgataacgatagaataagtctttaacacctagatttcatggtttcaatcatcttccttgtctgcaccctgaattaagtatgccagagactctttatttgtaagactataatctacttttgtaaatgcgttatataaaggaggagactccttaatttagtccgtaggggaaacttggcgtcatcattcaaaatactttattgtatctggtttacttttagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaatttactgcctgacatcaagtcagtggtgttttttagtgtccgtctgtcacatgtaaccatatcacatgtgatcagtatctgacacttgggtggcaccttgtctttttcagagggcatttacttgcatttactcacttgatcatcatagcagtcattttcagtgaaaaaccttttgtagccatccataccctggttacaagtgatagaaaccaaaagcttgaactctttttagcgtaaaagagtaatttattggctggacacagtggcttacgcctgtaatcccagcactttgggaggctgaggcgggtggatcatgaggtcaggaattcgagaccagcctggccaacatggtgaaaccccatctctactaaaaatatagaaaaaattagcctggtgtggtggcaggcatctgtaatcccaactactcaggaggctgcaacaggagaatcacttgaacctgggaggtggaggttgcagtgagccgagatcacaccattgcactccagcccgggcaacagtgcaagactccgtctcagggaaaaaaaaaaaaaaagtaatttattgcttaatgaaaccaggtcatgaaatctgggcttcaaggactctagatgggggcatttagtgtcaagaccatcttagtgttcatcagctctgttctttgttggctttattctctctcactaccaacaagttcttttcttccccatatagcaagaaacatggacttgggcagttccaaaatctcattcttacattaagaaatctttcctagtggctccaaaaagaaaatcccagataaggactgtgattggccaggcctgggtcacatgccatctctggacagctggcagtagaaagggaagggctgccatgattggccagcctgggccaggggcaggtcatactgattggcagcctccctcagaactacatggttggagtgatgggggatggtcctcctcaacaaactgatgcagatggatgggtgttgggcatatatgatagaagtccattgtaagttcagtctcctcttagttctattcctgtgtctgttcctgtcccttccaaacaatgctgcttttctatcagcaattcattattaaggagttgagtgaaagtcatgaaattccagtccccagatttgtccccaagcttgactcactctgctttctggatttacccccatcttctcacctaaccacagataccagaaaagaagtctttattcactgaggctttgaaaaaactagctgcacagtcttccttaccaccacctccaaacaaagaactttctctgagattggagcacagtgcctcctcctttctccttgctacacagaagcctcattctaggcttttcctccttccaggctcctccatgctctcctgaggccacctcttggggcggggaaggggagtgctctctctggctgcttctgctcacccagggtggactcaggagctggagcccctgaggtcagcatgaggcttcatctctcagcccagatggccaggctcagtgacagcatctctgcttcaggacatgtgcctttagtctcctccatagtctaaaaacttacttgccgtgctgaaacttgttgataaaaccaaatctgtaatcaggaacataaaccaacacaatacaggccttgcacaaatgagcagttgtggggtatcatgggcccctgtggattatttgactgaagagaatgatggaggcaaagctggttgttgttgaacaaattgctgccagatgtagatttcaataaacaccacactgttgttcccctgcccgaaggtgctatgaatttcttgaggcaa

SEQ ID NO: 101 - DNA, 2351 bp, Homo sapiens
aagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgaggtggaggttgcagtgagccaagattgtaccactgtactccagcctgggagacagagggagaccttgtcttaactaaaacaaaacaaaaataaagatttttttttctttttaaactaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatat

SEQ ID NO: 102 - protein, 718 aa, Homo sapiens
EIMAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEVEVAVSQDCTTVLQPGRQRETLS

SEQ ID NO: 103 - DNA, 35456 bp, Mus musculus
  misc_feature (1)...(35456): n = A,T,C or G
ggtgagagcagatgtggtctctgggctgctggttgctaggaaagacatgggtatgaactttctgtgacaccgctctggggacagggtccaggaaccttccctaggacaaggtcaggagtcactggggaggactaagagccctgggttatacattgagagtgtccttggaggaggaggggtgtcgctccctgagagatttgggaacttttctgttagcagcgatctcccccctcctcagtacaagtgagaccccctccctgcacacacccttcctcctccctacacacacccttccccctccctgcacacacccttgcaaggagcttccagcaggcctgtccaacagtcttgtttaggaactttacaagatgggcagctgggtgtatggggctcctcactctctgggtttagctcctgggtgtggatggggtgtaagtaggtggcctactgctctgagttgctgctgctgaccacaccttccttttctgggctgacttacttgcatgtctagcaagggtaaccttcaaatgcccaccccatgctctctaggcctgaaccctagccccttgttgaggcttactggccccatgctagcccaaagtcttctagttttgcttctcccatgtttaaatggtaactacccagcttagctctgggcagagtggctccctagaggtaggggtgtggatgaataaatagggtcattgacttcgagggcctctgcttcctagaataggtaggtgcccagaagttaggcggtctgggtgtaatgacacgtgcctttaattccagcactcaagcagcagaagcaggagggtctctctgagttcggggatagccagagacatcaagagatgttctctcagaaaacaaaaacaagttggccaggttgaagcctggagacctgtcttttcccagtcccatggtgccttggggcaagtggcccacaagtaacacttgcctctaagtctcagggctctgttctacgatctcaggatacacatcccccttgctggagcctgtctcctaggaggagccccccaggctcagcaactaggaaaggatgtggtagttacagcctgggccccagggcacttactctgccagctgggtcccccggctggtgacccagaggtgtggctgctaagtaggcaggtgtgaaaccagcagagtgaggggcaaagaggctgcggctctgtgaccaggcagtgtgggtggaacgtgggcgaggtgaggagaggcagggccagtacccattgtgtttccacccgggattgcagaggtgatgacaagccaaagccaggccaaggtggagacttaggcaagagaacagggtgaggctgagggatccatgggccaggaggaagatggttacagaggcctgccaggacggcagctcctgagatgaaagcttcccttcagctttgggtaatcgtgccccagagtgatgcctggccagatgtgacacattacccaggcccctcaggtcggaggtggcaagcttgcatacttactcgctggttgctgaagaacatttactgctgtaggtacagaccactctccctgtgttctgtttgaaggtattgtgtaggggagttgagagaaatgtttacaggagaagcagagtgatagcaagtgctatgtccatggctgaagccagctcagcttctcaggaccgtgaccctggcttcctcttagaagcctgccttgggttttgccaggcagagagcatccctgtccctcagctccagcctgactctcagccttgagcttggctatcaatggctggccctgatcacccccagccaacatcctgaagagaagggccagctgtacccagcagcttttgtgggactgggctggaagcctatatctatagggccaaggatcctcaacagggcagcagatgcagaatgggaacttagcttaggatccgagccctaggctgggtgagccctaggcttatccctggccaggcagggcatcatgaatgtgtcaggtcagaaacatatacaggcatgtttctgtctttcaacagtgttagaatttattaactcgaattatacatactaaatacgttttatttactgtaatttgccaaggagtcccaaatttatttgatagccaaccgttggcattactgattcttttattctgatttttttttaaatgtgtgtctgcgtgggagtatgttcgtctgaatgcagttgccagtggaggccaggaagagggtgttggattcctaggagctgggaagtgaactcagtcctctctaagaacagcaagctcttttagccactgagccatctctcttgccagttttcaaatcttaattaaaaatactaagagctcacatgttacccttcacccaatactgtctatatgttcaggttccagactagctaagaaagggctgcagagcctggagacgctgtatagaagttggaagtagagagctgatataaacacagggaagagtagggaactgcataagaagtggtcacaggcacagaaatgtcagttgcaggttttggtgacagacctttttcagggtcactttggaagtgtactgagttcaaaggcaggagaatctgtttgagcctacaccctggggacagaaccaagggttctttgccaatgacagaattcctggaccaggcttgtcggtaggcttgctgcatttcagtcttaggttgtccctttgtaaatcccaggtgaggggggctgtcatttctggtgtgactgataagctggagtctgtacgagctaggatccgatagtttcagttgtggttttatcagttcgtttctcctggtgcgctaagaggtgggaatttgcttgtgtaaataagataatagagtcattctttttgctacttacactcagaatggaatagctgaggctaaggacgttcctttcagagcaggtccaccttgtcctcaacagttccccaggtctctccgcaggggagccctccttggttgccccacttaatcaccttccttctgatgtctgatcctttgctgacacttctgaactagtgggtagaagctgatcacttacttcctcctagggacccagaagggcaacccggaggagaactaatgcttggtggcactgactccaagtactaccacggggagctgtcctacctgaacgtcactcgaaaggcctactggcaggtgcacatggaccagtgagtcgtgggtgtcgctgggggctgggagtattatgtaggggtgatgtgcgggaagcctgggcaaaaaaagcaggtgtcttccaaggcagggtctagacaagctatgccctatactcacctgtgacagggtaaagtgactgatacatatttgcctcataggttggaggtgggcaatgagctgaccctgtgcaagggaggctgtgaggctattgtggacacagggacatctcttctggtggggcctgtggaagaggtgaaggagctgcagaaggccatcggggcagtgcctcttatccagggtgaggtaagctactggcctgtgtgggctggccagcaggcagagagggttcccgagaccataccttcaataccacattcttctctcttgtgtatcttagtatatgattccttgtgagaaggtgtccagcctgcccacggtctacctgaagctaggaggcaaaaactatgaactacacccagacaagtatatactcaaggtgagtcggtgtgggcggtggcagtgtgaagccgggacaccttgagtgaagtgtgggtaccgtgtgatcacatgtgcccattctggccttacaggtatcgcagggtggaaagacaatctgcctgagtggcttcatgggaatggacataccccctcccagtgggccgctctggatcctgggcgatgtcttcattggttcctactacactgtgtttgacagagacaacaatagggtcggctttgccaatgctgtcgtactctaacttgctccttctccactgtcagggaactggatcagagtccagtagaggaagccagccagccccatccctccacctgccccactcacacatagtcacactcgcttagtgttgctggacccttgggggagacctggctggagcttgtccagctgttctgttctgtggttcctcaccctgggttcagattgctgccctctgcctgtctgaaggaggccaaggcccacccagtacacgaggctgccttcaaaggcccctactggtttaatagctgctgagatggattgtgctggtgcctgccgccctttgctgtgtgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactatgaacctggggggttacctagggcttgaccccgccctcctgggaaggcatgcctcagcctggggtagaggtaggatgactgactggttttggctggcctctgctgccctcatcctgggctaggcagctgggagccaaagttgaaatacaaataaagttgttttgggccttgatctctattggtgtgctctgtactgtttctgaattgggaccttggcgacggagctagctagaccagtagaacccagtactactgagggctaattcggggacacgctggctgtggagaatattgggggggggggggggtagggagtgtgctagagcccagacttggctttcagcaccaggccagtgaacagaggggactcctgaggctctggcttgctatctggccttgtgggcaagatgagtctgaactagaactggcaggttctgggacctcaggcagtagtcaggccggatgtggccttggctggaggccatggagcgggcctagaattctgtgttaggtcctgtgttgaatcattttcagaggtggccaggccagcacctgctgtgctttgccagggaagcagcctattcccagaagaaacggaataagccttgatgggaatcttgggctgcatacattcccttttcaacagtcagtcctttaagcctgggtcagaaaagccatctgctcgtcctgggtgccctgggcagtctccctgcctgggcctctgccaggctcaagaagcagtcttcagctttttgagtctagccagtgttggagcctgcccggctgcctggggtcttggagatgagaggtcagaactctctgccacggactacagttgttctacaagcatctgtgagaaggttcggtttcagggggcgggagaagtgggtgaacacaggtttcaaatacaacagtggaggcaaccagcaggcttttaaatagagtaggagttatcgagtgcttactggtagggtagagcttccttttggaatcagctctggaatcttagagccccttcccccacactaacaggtacaggatatagggaagtgtgacctctgtcactttctggggttgtcctggcaccctttgcctgctggtcagtggctgtcattgttttggtaggagggtttggggcaggggaatatgtcccatacctgagccctgttaggttacttctggagaatgttcaccaagggttgtcagaaggccagtaaacatgtacccagtgttctctgtctgaaatctgagcagggagtcccgcagggcctggcagggcttctggagactagtgttatcaaaggcttgtgcaccaaagctggagacagatctcctccctgccctgcaggcctgaggctgagctgtgctgccaggcctgcatactggggccgctgcttctgcagatgccgctgatgccaccatcaccacccagggatgccccggggagcaccccggactctagctcagggttcacatcagtctcttagctgagtgaccttcacatcagccttcatgccctgggaagaagaaagacccttgctgcaggcagggatagggaagctagctttactctagttttctcatggtgggtgtttctcccctcaaacccctgaccagggtattagtgaggctggaccatacccaagtcttgccctgaccagcttaaagtgtaaggttgggacgctgactccagagccataaagctgactcttgggaagaggattccaactcacccttcaccttgccaatgaccttgagtggaccctgccccgagggccaaagggccaacccttctgcttcctgaagtctgagactcccaggccagacatgccaaggacagcacctgacttaggttgtgtggtaagcagactgtcaggagtgcgaatggatgtaattagttgggtggtacacagccgcacacaggctggggagggagtgtcagcatgtttggttgtcaggcccttgggatccaaagcagtggtggggttggatgaaggaaaactgacttcctggcacagcccacttgcccccaggcttattggaccaacaaggctaggctccatgagggagtgcccagaagaaagccaagaaacggtgggaggggtccttgccagtgtggaaattaattccacccactcaaggagagtctctttctttttttttttttttcctctacacttaagatccacttcacactgaaaattcctgacacgcagaaatgagctgtgctgggggtcagaggtggggtttgggctggaaagggaggaacttggcatggggcggggcttaatcaggagacagggctttgaagaaagactcagggttcagagagccaaggttccaggagaccagaaagtctaggggccaggcagccctggaactctctggaaagggtcccagagaagagctagggagaatgggatccagggaggcagaaaacgaggcttttacacacagttgggggaacttcagggtagggtgaagaggacctactgagaactccacccccacatggtgaggtaggggttctgagggagggagggagggcagttgggggctctccatggtgaaggaagcccattggggcttctctggaggtggggatcagttgaggacaaatgtccaagagagactgaggatgggaaggagatgaggcggggagagaagaaactgcttggccttgagtcttagaggacagtattgcttagagcaagtcatgtgtaaggaccgagcactgtcagggcccaggatgggggtcagaaaggtcatgagcggggtacacagaccgagctttaaggaaatcaatgtaggggtgtctgagaggacccaggcttctgagtagcacatctgtccctgagggcagagcaaaacttgtgaagcagggacaggcaagcctgttacaggtcagatccttcaagtccctgttatgatgaacatattagaacatatgtcagacttgggtgacagggacttcaaaaaggaggcccagggcagggttctgaagattgttggtgaagggcctggacttggactcgggagaaaaaaaaaaaaaaaaacaaccctgaacattgaccttggggacttgggagacaggattgaacagagatgagtgtccctctggggtttgatgtgttgcatcccagtcaggtgggaactatgatctgcagtgtgtagacttcaagggaccagagactcccaaaataagcctgattagagatggagacttgagcagctcagacagggcttagcaagtagcgaggttggagcccagctgggcaagatcaaggaagaggtgggtgagggcttaaaaagctgataccaggacagggcctcatgagaaaaggctaggaccgccacgggactgaggatggcaggtgggactcaacagggcagggagaagagatgctaggtaagggggttctgaaggcacaggtcttggagctaacaaggttcaggtggaagaaatgtagggagaaggggggtcagccgtgggaataaagtggaatgctcagcagacagacttgccgggacttgaggacccgcgagagaatttgagcacaggtggactggggtagcagcggcttggtggtcggtggatatgagagccatgcagctcatgggatagaggggtgccagccttgcgactccccggggtcctggcttccgggctagcgggccccctccctccctagggaggaggcggaggtgtctgcgacgccgccgtgagtcaggctctggctgcagccgcggccggcctggcgctgcggagcgcgcgcgggcagcgggggaggcagcggcgccagccccgctcgctccccgcccccaaggttgggccgctgggacgcgatcagcggacagacagcgggagagcggaaggacgcgcgctcctaggttcaggggtctgacccactcgtcgagtcgccagtaggtgagcggtactggtgactgctgcagcccggggtcagattggggaccacccagttcagccacagccccttgctatcacctcaccggcgccgggtgcgcctggtggcgcagagctccggcgccaagctgtctcttggaagtgtccatttcgcagagtgtcattgtgggtctcttggtggcacggttgggggtggggacaagaggggaggtgagtggttctgtgtgacagtgtgcgctcttagggtctcccagtgccgctttctgttggctttggagtttgtagtcctgcacctgcgcggatcctccggagatgtgcctgagcctgtggggcggtgtgtagcgctgcgtgtctgggtgggcaattgtttacctggcgcgtctgggcgcaggagtatgctgggactggagagctgggctggtgattgtgtgtgtggtgcgtcttggtgtgtatgtgcttcagtgagcgcttttcattctgccagtcaatgactagggcagtgtcactgtagctctgaatgccctgagtgcgtggagatgcggggcgctctgcttatcgcaacagggtgtcactcggggtgctgagggggagctgttgtgtgtgtggttgtcagtaggcgcagatggcaaagcgatgaaaagccctgatgtgcttgccaagactactgcgaatggctttggtattggctgtggccggctgggtgggggaggcaaactggcagctggcaacctcacagggatttccatctcccaaagaccatttatgggactgtaggggaaatgctgcaaggctccaggttgggtgctactgggcgcacaaggcccagcaactcctcactctgtccctccctccaggctcagggccccagccagtgcccagccctgctgggagccccggctagcaccacggacggcacccaggaagcccgagtccccttggacggggccttctggattcccaggccaccagcaggttcacccaagggctgcttcgcctgtgtgtccaagcctcctgccctgcaggctgcagcggctccagctcctgagccttcggcctcaccccccatggcacccactctgtttcctatggagtctaaaagcagcaagactgacagcgttcgggcatcgggtgtcccgcaagcctgcaagcacttagctgagaagaagacgatgacgaaccccaccacagtcatcgaggtctacccggacactacggaggtgaacgactactatctgtggtccatcttcaacttcgtctacctcaacttctgttgcctgggcttcattgctctggcctactccctcaaagtgagcctgggcagggggtgggcagggttatgggatctagcaggatgtaatgtcacttagtggagcccaaggtagaacatgcaagcccaaccaggagacctcttatggattcaaagaggcaaggctctgggctgggagcaaagggccaccccttcccttccttaaactgagaaagcttgaccccatttggggagtgggggtaaaggttgtctgctctgtacagctagcttagttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaaatgtcctaaccccacctaccctgtacccacagtggctacaacttccaggcctgtctcccttttgtataaggagtcagtggctggaaacagagcagggtgacaagcctttgggaccccttatctgctcctacccctactccttcccacgacaaagtgggagaaacaaagacaacttggggccaggggcagggggaagctgtgatagatggcctccgtgtctcagcccttgtgtcccaggtaaggactgagcattcttggactgttggagccccaccagcagggtgcaggaacggtgcctgggtgccctcctcccatcctgcatctccggaaggaagggcttggctcacaattacacagatcatcacttcctgagcccagacttgaatggcccaagacagatgcagtccagaaatcgcagctgcccagcaaggaggggtgccaggggctgggagagcagaaagaagggtgctacagggatttacaagtgagggcgagactgacctgggaggaagggtccccaggcagctcagctcatgattcatctgcaggcatgagtcccaccttgctctgcatcacatgcctggccacaaggctctcctcttttcttcctgactcatgctcagcatatcataccatcttcatgcctttttctccaggcctgggctcctcacctttacatgtaccacatggaagttgtgtacatgagtgggcatgtctgtgagagcatggcattgcatgcatgtactcatgtgcccacattgtataattcattgtgtgtgtggagagcatgagtgtgcatttgagtgtgttgcatgaatgggaatgcttatatggagtgtggatgcttgagtgttatattatgcatgtaatcatgtgcatgcacatgtgcatgtgtgtgagcaaatgcatatgttagtgcaactgtgtgtgagtgtgcatgaatgtatatagagatgtatatctaattgcatgtgaggagtgccagcctaatcacatgcctacatccacataggtgtgtattgtgaatggatacatgtttgagtataatgtgtgtgcgtgcaatgtgtgagtcaacatgtgtttgcatataagtgtaccacagatgtgtgtgtgtggtgtgtgtgtgtgtggcttgtgtgtgtgtgtgactgcttctgctgagaggcagcacaagaagacctagggacttgggatgtcctaaggccagctcagctctgttctctggggccgtgccaggcagtgggcaccattgccaggttgctagtggaacataacctccccctggtgccctctttccctgtgctgtctacagcctgagggtttgggcatggctgcctgggctctggtccgggagctgtcccttcctcccctggctcaggctgtctctggctggctgggcagggtagcccatctggtgtgggttgtaggtaggtcaggcatttctggatggttatgagtttgtactgggatgtgaggttgacactttggaggggagagagggctcgctttctctctcatgttttgctccaggaggtcttccccgggaacagtggacaggccttggggcttcttggaaggatgtgcagggttggagactctgaccctgatgcctggaagcagtccacctgtgtatctagctgcagccttctaactagctgcacctgccactcatgtagctcatcacaagcatggtcaaggacagtagatggaacaggggtcaggaggacttggggctggctttccggcctcctttccttgctgagcccttcccttatctggtcacaaatagagacgaggctgttcaagccatcctgtgatcaggtggcacaggtgggctggcgtgagatgcggctgtctgctgtgtgcatacactggctcacagttatcccctcttttgtatgaaacccgtgtctctcctgcagagcttctaaggccttctttccttcacatctgcctacccaatcctcaggaccagtatttcagtgttcaaagcatggtaaccatcatggggggaggtctaaggatattatttggctggacagaggatatcaccagagaaggtatatagtccattgtctcagaagatgaaaacatcacactgaacttggggccaagtaaggttccaggcaagggcttctgggaggaggtagtatttcctttgggtcttgaaggatggatgaaagcaaagttctacctggagaaaggaacagacaccaagcatggacatcctctgtggggagcatagtgcagtgcagtccgcatgtggcagctgcttgatctgagcttcggaggcatagaggcttcccgagacaggaacacctgaaagaatgggttaggagggtagactttgattgggctttgtatgtgtatatctgttcatctcatccttcctgaatatcagtgttaccagcccatccattcaactacccattgtaggcatcagttttttgtaacctacttttaataagggttcaacctttccaccagcagaggtagtgtaagagaaaagttattagaatttgaaggaagtggacctgttcagcaatagttcttcgggggtgagcttgatcttcttgggcagcagatcagtctcgtagcaaacgccaaatactattcagcagctgcagaccagtcctctaggcaagcagacagcagacatgaactagcagctatagtcaagtcctttcagcaagcagacaccagacagctgcagttcaatcctgaagaaactgccaggctcaccaaccagcctaaggtgaggtctcagaggccgcaagctgccacagggacctcatgagcagttcttgaaggagtttctctcaatggtggagttatcacaagttgagctcaacaatgctatgtaaggccaaccaatacatgtgtgtcattagtgaagaatacccgaggtgcagcaaaccaaaccaaggtccgtctcccactgtctgtggggccatgtttataccccttcctcatgagtcctttcacatgtttgctatatcaaaacatactttcaccatgtctgcttcagggaaaagtctttcatgagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctccacccatctattcacaccacacctacctctttatgcttttgtctacccttgtacccatctatccatccacatcacacttatgcacacctagctatttatctccttacacaatcatctgcccatgaagtcacccatctatctactcacccaccacccatccatgtatgcatttgtcacagccatttactcagtaatatatgtcatataatatcatatatatcatatatgacatttcaggcaacagcaggtctcatacacaagacttcatcaccgagtagtgtcatagttgattttgtgtagatactctgtgatgttaacagatgatgaggtcactggagtttctcagatactcctcattaagtgatgcagggctatgtcaatccatcctccacgctgctcactacattcagacagcaccagccttccctcacctgttgacacagtcatcgtcctgctgactctctcctactgtcccatcccatccttaccaacctggacactgatgcgctagactgcttctctaatgtcatttacacccccacttcatgccagatcagaatgctcactgcccttcctcgatgcatgctctgccacatcccccttcttcccgtcatgcatccacaccaagtagctgtgcatgcctcttgtcactcggcttccctcgtttgcagtcttcccctctcatccatccatccttctatctccgctttctattttccacccatgtatccgtttgtccacattaatttcctctcctcccttcaacgtcacagactgagctcctcatccatctatctatctatccatcctcactggatctatgaattaaatttgtttatccatgtacttacatactccctcctcatgttttcatgaatttatccatactctcatctctcatgcatttacacacacacacacacacacacacacacacacacacacacacctgtgttccttcctaactagactcccccctcctctcccttgcttctcccaatcatccctgagtgctatccatccacatatcaagcattcatctcttctcagatgtgatcatcctctgacactctgctcatccttttttcttcttcctgctcacaccttcttcccactcctactggtctccaggcagccactacaatcagctcatacattttcctatctctcatccctccctctttccatctctttcattctctgtgtacagccacatacccacatgttcatggttcagagcatgccaacactttctatgagacttttttttttttttttggacagggtttctctgtgtagccctggctttcccggaactcactctgtagaccaggctggccttgaactcagaaattcgcctgcctctgcctcccaagtgctgggattaaaggcgtgagccaccacacccagccttctatgagactcttcttatgtaagtaactacactcgtgcttatttctcttcctgaagctacctgcctaccctctccagtccaccagcttcacccctttctgtcggtatcacacagtaatttctgggtctgtgtgtggatgtgaacacacttgcgcatgttcacttcccgcttgccttgttgggcacctcctatctcagccttgtgctcatcagccatctctggtgcacctccattgtctcttatttttagaaactgacacaccctagatgagccagatgtggtggtgcatccctgaaacgctaacatttgggcagtcagaggcaggaggatttagagttccaggacagcctcagttacatagtaagaccctgtctaagaaagagagagagagagagagagagagagagagagagagagagagagagagagaaagagagaaagggagaaagggaggaaatgaaggaagaaagaggaggggaaagaaaaagcccacaagcgccgacagattctactggggttcatccaccaatctgtctgcttgccttcccacttttccttattttgtctttcatccatgaaccgccacatgcattcttccaacctccctcctcacactattatcctgctactccacagactctcttagggttttactgctgtgaacagacaccatgaccatggcaactcttataaggacaacatttaattgggtctggcttacaggctcagaggttcagtccattgttgtcaaggtgggaacatggcatcatccaggcaggcatggtgcaggaggagctgagagttctacatcttcatctaaaatgtgctatgagaagactggcttccaggcagctaggaggagggtcttaaagcccatgcccacagtgacacatccactccaactaggccacacctcctagtagtgccattctctaggccaagcatataccaaccatcacaccgaccatctacctcttccatcctttggtcacccacactcctactatgtactttcttccctatcttatcccttcctcatcctcttctttctgtggacttgccctatgtccacatgcttctccatcttgcttcatttctgtgtttgtgttggatgtgtatgttcatgtacagtgtgtgtgtgtggtgtgtgtgtgcatatttgtatgcatgccaatccacatgtgtgttagcaagcacaaatatgaaggtcagaagtcaacctcaagggtcatgccttagaattcatccaatttatagaaaatatatacacatttggggggggggttcgagacagggtttctctgtataactctggctgtcctgggacacactttgtagaccaggctggcctcaaactcagaaatctgcctgcctctgcctctcgagtgctgggattaaaggcgtgcaccaccaagcctggcaaatatatacacttttgtgtgtgcttgaagatacactcattgccatgtattgtgtggaggtcagaggacaaccttcaggagtttattctctctgttcaccacgtgggtcacagggactgaactcaggttgttcagcttgacaacagatgccatcatccattgagccatctcctcagaactccactttgtcttgtgagataagttctcactctggtaccaggggttcaacagttaagtttgactgggtagccatcaaactccacagatctgcctatctctgtctccctagagctgaaattataggtgtgcactgctaggcctgaattttgaaaagcatattttaaaatttattgattttgttttatgtgcgtgcatattttgctcacgtgtatggttgtgcaccatgcatatgcctggagcccaaggaggtccaaaagaggctgtctgtcaggtaccctggaactgaagttacagatggttgtgaaccaccctttacatgctgggaactgagccagagtcctctgagacttttctccagaccctgctgactttttgttgttgacattaaatacgggttcctcagatcaaatgcaggtcttcatgattgcttggcatggacagtttacatgaaaagagcaatctcccaagtccccatctttctttacctggaagcttatgactgccctcctccttctcgtcatctcttttgttccctcctatgatgtcaccattatggccactcattaaactgtctagctcaccacatagttagtcatcgactcatcagaatgccccagcactttcccactggacttcccacttcacatgcagcaaataactgcccagtggatgatgaggcataggccacgcagtccctgcccataggatccttccctctggcagggaactcagaccatcacaacactcattgaaatgtcggtggtaatgtcagctgtgaaaactgaggagagttgcagggattgctgttccatacaaagtgggctcagtcagaagttcatgtaagtgcattgactgtaagcccaaggtggtccaggccagagatatgtgtgtctgaagaagtgtgtgtcacaggatggggaaagtccttgcagaagcccagggacaaagttccatagcctgtgtggttgaaacaggagaagggaccagacatgcctgcctgagacatagctttgttttccacagtgagggttttgtcatctactgtgagtgggttcatgtgatgaagtttcccatgtgggggacagactaaggatgcagagagatggggctgggaacccaggtgggaaaagattccaagtgatcctgaaaggtgggtgaggatggcttctagttatacattcctttggaatgcacagggcattggttctacagacacccaagctcacagatgcccaggtccttatttaaaacagcctagtgtttgtttagatcccacacacttgctcacatgctctccagatgacataaaacctcattaaaaggaagggcagttattgttctactgtaccgtatcacttagggaagcggggaacccacacttgttcagtacagagtctactttgtcagatataattttctctgaagctcaattgaatctacagacaaggagctcccaggcctgagacccagacaacactctatcctgatggagcttcagggcaaaaggaactagaggaggctggcgatgcttgcatggactgttctcacccaatcagtctaaaatgcacaggtgctgttcacacaggagtgaggcatcatgggaggagcggtcttcatctctgctatgaatctgccagttcgtgccctgagcttccaccattcatgtcctacccagctgcctgcttcctcaaaaatgtcagtcacacctagatctactcacatattcccatttccggtcatggagcatacattgtcttttctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccctccctctctctcttcctcttaatcctaggctggcctcaaattcaagttcaaggatgaccttgaactcccggtcagtcagttggtcagttgtctggcctctgccttctaagtgctggcttttctggtgtgtacccctacgctcacccgttcatttgtggtgctgggcatcaaacccagggcaatgtgcatgctaaagcactctgccaactgaactccatccccagcctttctgggctgctatctagcacttcttccccatccctgctggtccgttcttctgtaagtgagccagctcctttctgccctgcctagcctaactccccagcccaccattctacctgtatgtttcaccatacactctaaaacccctgcccatgtgccctccagcctccctcctcctcccctcactcctgtatatactgcttctgccatccctctggttacccaccctgtcttccctcctttccattcctctggctacccaccatgtcatctctccttcccatccttcatgtgttcatgcctgctggatcacctccacagcctctcattccccaatctgagtcttctgctttggtctcatgagtgaaaagtatccacactgtgtgacttcccacagtgtcagtttggctgactggaattttacaagacctcagcacagtcaggctctggtcaggtctgccctcttctggactgtaggctattcacatttctgtgaatccccacatggtggaagggttaaaggtcttttggagccttttgttttttcttttaaaggacaacatttaattggggctggattacaagttcatagattcagtccattatcatcaactgggctacatcatggtagcatccaggcaggcatggtgcaggcagagcggagagttctacatcttcatctgaaggctattagtagaagactcacttccaggcagctaggacaagggtcttaaagcccacacccatggtgacacacctcctaatactgccactcccctggcctgagtgtatacaaaccatcacagacagctagagccccaagctgctttttcaatctatagtcccccaattatggcttcttgtgtccattctcgtttgggaattttagtaagaaacttctaagttctaagtctatgctaaagccaagattgatctgctaggatcaagcccacctacagatttgagaaatatcccatgactctcgtgcacatagtgaccctcctctctaagggtgtgtggggaacagactaatagctagctgtcaatgaccatcttcctctttctcttgcactaatgatctccccgcccacttttttcttttcttggatattttctttatttacatttcaaatgttttcccctttccaggtctcccctttggaaaccacctatcccatcctcccactccctgcctctatgagggtgctcccccacccacccactcccatcctcccaacctggctttcctctacactggggcactgagcatcctcaggccctttgaggcctcaccctcaaaggccccacatccgaccagtctccgggggtcagaaccttcattgtgtacgttgatggggtatctacccatagcacttcctgaccacttggtcaccatcaaccttcctctcctctcctctttcctgtcctttcagcacccactggtctgcccaccgaggacctgcactgccttccttccctttatggagttatctgtcagactaccatgccctcgccttcctgactgactcacccagcttcccactggtctcctcactacaatcctttttcctacagcagacatcatctgtcacttcttgggccccactggaccttgtgtgtcttcccagctctggtggattctctagtgttctgctccggccctacccacccactttgttcctctttgctttcaggttgttcctctgtctactctcccaagtcctcttactggtctttgaatgtggactgtgcatcacagtggaccagctcctccagtggcccatgtgatctcatcgccatcacacgagtggtggtacctttcacgtgttcatctctctacctcacctctgaacttctgactctgcagcattgcatctccaggcgtctagccgtgtccagaaagcagctctcaccagtgccggggcctgcaccgccaagcgccttagcctgagcctcccgggtttccttctgcagcttaactcttcctttaccctcaaggccacctcacctcaaggccgcctcatcatcatctcccacactgacctcagcctggtcagttctgccttgaacacagctccagagatccaccctccagtccactttcattgccacagctcttggccatgtgataaattagccttctctcgccaggccagactctggctcctccctgtctgttcttaatccccagccaactgctctgctagaatctgtccagcctttccctttcttctggctctatgtcattctgagatgtcttcacaaagcccccacttcttcttgacagcttcctttgttccctacctatctgtgctctgccctcccatagtaggccccggttgactccagccaccccctcatggatctctgttccctacacacacctggtgggcccccccttggagcataccccatcagaaccaaacttgtcactgatctcctgacaaacatccacttgatgaagtctgtctgggagatgcttgccttgtgtcttgtgagtccttgtctggcctgtgaaccctgaggacagaggcttttctttgtttcttgttgtgtaccagggccagctgcagttacacacccaggatgccagggtaggcactaagtatagattgactggctgattgatgagtttaagaatctgcacttatctcccattcattagtcagtggtatattctttcaacatctttcccctctctcttcacccatcccacatgcaatcctaaatctgtttacccattccacccatccaacatacatgccaggaatccatcccaaagatatagaacaccagttccatgcaaacaccaattcaaccacctgacacaccttcataaacccatctgcccacatggcacacttctaactgtgtgtccatccttagtacatgaaacacagtacaatagcccagtgtgccagtccaaacatccactgtatcccacacatgcaatatatgtactgtctcctcacacctcccgttcctctcatctagaacacacttacatattcatatactcatccatctgccaacccccacagcaaacatctactcatacctgtctaccctgttattcccatttgacaaatgtccttctgtgtacctaacccactcagccagcataggaaaaaattcacctacctgtctctcctgtccatataatgcacatcaacacatcagtggtctcatttgccttagctactcggcacacacacacacacacacacacacacacacacacacctatccactgttcacttgatattcatttctgtatgtatagctatcgtctacccttgtagaattgtaacatatatattttctttaaaaaaataaaataaaaagaccaatggtgagccaaggctcttctgcatactccttgctagtcagtattgttctagaatcatctttgtcttcctcataggagcctacaggcaagatgatgtgctggaaacatgaggccttttccagccctgtgaagtggacactttcttgtgtccacaccacaagccagcacctggagcagcaagagggcccactgactgtgtgaagttacccgtgggtaccccagaggcaaaactccggctcagagtgtttacagcacatctgcagccttggaggaaaggcttgcaagaggaagtagaacagctggcttgttaaagagaacacctggctaatgattgcagtggaataggtgaactagatacagaatctcacttgctagagatccacctgtccacacagctgcaagcgtcagtcagaggaaggatgttacactagagttaacaaacaagtggggctgccactaaatccaaggggaagagagaatttaatttcctggagaaaattataaaaccttatcaatgacttcactcaaattgtgggagctcagtaaatggggatatgcctccttcttggtgacagagatgttgagtccctcccatatcagagtctcactcccacctttactctcctgaccctcagcccttcacttcatacatgctctctgtccaacccatcttcctggtcacccctctgccctttactggctctcttcccttcctctcactctatcccacccctatccttccttctccctgctccctctgcccactgtacccatcccacacctccctcccccttctccttgttcctgccttacaactccttcctcctcaggactatccctccttctggcagccttcagttgtcctctgtctagtcgtactcccattcccaccaatccatcccccctcctaccacacttcctcctcaggtatccactttctgcattctggcatcagccagtccaaatgtcttctgtccacccttcttcttttaagcaaacccagtctgtgaatagagcaaccccatctcctgtgctcacccgacacccccatctgcttctaggctccgatttcagcttgcatcaggctcagctggcactcacagaatgatgtagctcaagggggctgtcctgaggcatgcctgctctgaccaggtagcctcttagaaatggatagctctgtctccatcttccaaggatgtcctgtccactcagcttcctgtttaaggtctagctaggtaggactggtcacaacatacaccacatacatgccattacaccccacatcgactgtctcttgtgtcgttatcctattaactatgcatccagtgtctcagggtcacctctcccttttacagtagatcacttcagagttactgagccattgtacaaaacaaaacaaaaaaccaaaaacagaccgaaaaccaaaaacaccaaaacaaaacaaaataaaacttctgttttgagcattcttcatagagtccctgtattcctcgtgtcccccccccccccactttttttttctctgactagacaccctttgctttacaaactgtgaaagatgagtctttcattgactatgttcaccagactggaggcaggtgcctacagaacagaggtctgtgactactcgactctcacccccctgctccccaccatcccaacctccctcttctactgccctctttccacctccaccagtggcctctgtcctgcttcctctcctgacttctgcctctcttcctccttctctgatagccactgtctccttccctgttggcctccctcctctgctggcttctgacgtctccctcttttcttcctccttcctccttcctcaggccaacctctctctctctctctctctctgctggcatccactccagtgcctcctctgacctctccctctcttcctcctccttttgtctccaggttcgggacaagaagctcttgaatgacctgaatggagctgtggaggatgccaagacagcacggctgtttaacatcaccagttctgctctggcagcctcctgcatcatccttatcttcattttcctgcggtacccactcactgactactgagctagcaggcagtgggtcttggcgacacagcactgagactgatggtcactgagattcaggatgctgagattgtggggcagaatgggcttccaccaaggcccagagccatgcatggcagcaaggtcaccagaagctgagtgcccgaccgagtggcgcactcttcccagccaccctatctgccgcctgcccctgtcctgctggcaccgggtctatgggcttccttccatgatgctgcccagtgaccagtggctgccctccctggcccatgcaccctgcccaggatcctggacccctcagacctgacacccagcaagaagggcttacacgggagctcccgaaataggggctgccagcacctggggttccctcactcctgaccccccacttcctccaagctgtgacccctgctccaagctcttgtatctgtgaactttcattaaaacatgtgctcagctcagcttcagcctctgtccatgtgccaggcagggcctaggtgtcccttggaggtttggagtgctgctttgcagcctatgcccccagggcctgcacacagctaattccgtaggaggtgtgttcagaaaccaagtggtcttatgagggccagctgtgtaggatggcaaagtgaggggtgttaggtggaggggctccccacagggttcacagagccatgcaccctgtgcagaatccaggagaagcttccttcagtagtgttggggacaggctgccagtccctgggaaacccacagggtgctgatgggttctcatccacttagcccctgaaatggggaaagaggctcccctgtctgtcaactgaaggtggctgctcaaaggtcaagattagctgtgctgcactaggaagtagtgctgcccacagaaggatgctgccccatgtgctgagggtggagcaagcaggaaggcaggaacaggacagtgcacagagtggaccgagtcctgaccctgtgaggtcctggttggccttggaaaaaagagatactgtggggctctagtaggggccaatggtgtgctcagtggtgtggacgcttggcaccctttgcggtttctgatcatacccttggaggtatcgggagtgtcaggagaagacaggcaagagcagataccgttgccggctgtgggcagagagtgtaggtggggttagtggagggctggccagatgcagaagcttgagctggttctgaccagatggggttaaccaagaatgagagatgggggcagcgcagggtcaccgggaattcagtgcaactggtacactgaaatataagcaagcagctcctgtccctctgtcatgccctctccactctgaaatcacgagtcaaaatacactcctgcatcacgatgcttctcttcaggtatttgagcacagagataagaaaactattgcacgctgtacagcagtacaggaacgttaaccactgagcaaaactttcaagcagccagagcgagggtcggtgggggaccaacacattatttcaaagctgcagggagaggtggcttttcaaaaaaaaaaaaaaaaagatggcatagctagcatctgtgggaaatgatgtatttcttgggactggttcttgggaggcaggccatagggttcccagaacacctttttttttttttttttttggtaggagatgccagttatgaagcgtttacactcttgtttttatcagaggctctgcccctgtggctgcatgcctccctccccctgctgcctggtgtttgtcgctgccaagctcatggtgagattcaatggcagcttcagcttgtaccaccctggatatttgtcacctctagtagagtcctcaccacttcctatggggctgttgttcttttagccacttccttgtcagccagtgcttggtgggtgtggcaggtagcgctctccacatcttcctgacacccctcatgtgactacagcttctcctctgtaacttatcaacagaaggcatctgcacactggagaggtggctccgcagtgacacgtgcactgcccttccagaagactcaggtgcagttttcaacacacatgtggcatctttcaaacatctgtaactccagttccaggggttctgaagttccggcttgcacacagtgcacatatagtcgtacaagcaaataagacaataaatattattttgaaataattcttccttttttttttcaagaaaggggggcatggggatgaaaatccaccttatatgactatcaaagtacccactcgtggggtgctggtggggatcaaatgagcatttattttccagatttttaaatcacagatttttttctatgtagcttccatccaatgtgcatatttatagcatgttattcacaaatgctacaaatatgagacaaccaaaacacccatctatatatgttttcttatgcatgaaaaacatgtacccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagcctgagtcttttcagggtcttcctgggctgtcctccaggcccgcaccagccacagtctctcagagctgccttgtgctgcctgtcttcagaactctccccgaccactccccttctgctttttgttcggtttttaggatccatctgtcaaataaaaacaaaaacaaaagcctagtgaggatttggttaaagtcataaatatactggggaagaatttacattcttagaaaaaccttgaatttcccaaatccccgagagtgcagtaggctgcccttacctaggcctcttttaatttttgcccagaatgcttcctagttttctgtactaactcaaagagtttgtcaggttgatttctaaacataggacttttatgtagttgtaaatgtcacaccctgaaatattttcttctctgagtgtatattactgttgtcatgaaatataactactgctcaaagcacaagtagccagtcaacaccactctgtgtggttttttgttttgattttttcggagatatggatccttatctgtgtacgctctggaatcttcaatctcatcagcacacagtttttcttgactgtttgtctctccgcaggcttcatttacagtgtcccatgacagttggggaaagcaggctttctttgtagagtcctcagaagaaagataagcccttcaaggccacgtgacttcctatgatatttatcctagctacttgtagtcctcttgaatttgcataaggaagctcactattattcatgatatgctaatgagggctttcttgctaggctgcaaagatgatagggcagatttttgcattgcctaaaagtgtgcattaaaaagtaataagcttggggctggggaggcagctcggtgggtaagctgtccatcttgtaagcattgggaacctcagtttggatccacataaagccaggtgctggcacacatttgtaacccaagaactagggcgggaaagaaagagaaactccagtggctcactggccagccagccaagcagactcagggagcttcagcttcatcaaaaaccttctgagggtaaagtggagaacaactgaacagaacacccaatatcaacctctggcctccaggtgcacacttacacatgtgcgcacacatctgtacatgtaaacaaacctatgcccccaggcaaataagataaacaaaataaaataacaaagctcatacttcccctgggcacatatcacagaggtaactgtacaccagtacacactgcaatattgctcataatagctaagctgcaggacccgccaaggtgcccatcagtggggaatggcatatccacaacagcgttcttttcagccaggttggaaggctgaagacgctggagtctgaagtcagcagaggacagcagcagcaagggacatgtaatgaccaatcttggttgtcagtttgacttgtgtctaggatcaactgaaacccaagttgatagatgctcctttgagaaggcccatgctaaatctgagacacattctgatggccgaccgtataaagaacatggaagaaggaagcttttgcttttatgcctgcttgtcccactcttgctgacaagttcatccatgctgctgctgcaacatgtctttgctgacgttagaacctatgtctttaggcttccaacatagactgaagactaacagctagctcttcgggaatcccgcaggccttcagtgccagatggtgactgctgagacatctagcccagtgggctgagcaactagccattcttggcctctccactgtgagacagccattgttggattatacaaactaaaagtcaatctaataagccccctttatataagtatatatgtgtatgtgagcatgtgtatatgtgtatgtgagtatgtgtatgtgtgtatgcatatattcatatatatatatatatatatatatatatattcattctattggttctgtttctttagagaactctgactaatacgaatagaggaaagaaaggctgtctggcgacacaggacacttcagctctctgctgcctgctacaaggtgcccaccctgagggtaagtcctttttacttagcaattaatgcacacaagtaaatctaaaaatgtatctccaaggtgattattttaaagatttattttaaatttaattttaactgatttgtgcttatgtgtttacgttaatttgactacatggtttctttcccctcccttattaagttaaagcagaagctggagagatggcttagtggttaggagcgccagctgcttttgcagaggaccccaattttgatttgcagcacccacaattggaaagctcacaatcacctgtaactccatatccagggggaatcttataccctcttctgtcctctgtaagcagtacaagtattcaagtatacacacataacacacaaatatttttattttataaaaataaatcttaaaaaaataagattgttttcaaaaacaacaaacatactttttgttgttttttttcacattgaaacaaccttgtgtgtctgggtcaagtttaaggtatttttgttgtattaggatttttaaaacactgctatatttgctgttcttcagaagccgaggcatgtgacagacttgcagcgttcttcccactccctcgggtgcacgtcactgggaatggggtgtctttgtgctctttggagcagcagatgatgggaccacgtgctctggagtgtctaagtgggtaggagtcatgctttgcatttgaaatgtcctcctcaggcttaaacgtataaacactgggtcctcagaggctgctgctgtcctgggaagtgctggagctgttaggacacaggcttagtctagacagcagacacagtaggtctacagaggtgaagcttgagggggtcccaggctggttccccgggcagaatgacccctctgctttctgattcactgagatgttgcaaaccatgctgtaagccccagctgcctggcctccccgccaaccccgccttccccattgcaccatgaggcaaagtaaatcctccctcctctcaagtttcttcttctgcagcatttggtcccagtagtggggaaggtaatggatacagaaggtgttagttttggttccaatttctttgagagttgctgttctttttgctgtcctttttgctatcctgcctcaagtatttcacactgaatatttagctcattaatctctctctgtttcactgactgtcagtctgtctgcctgtctcctatctatctatctatctatctatctatctatctatctatctatctatctatctcacatagcccaggctgaccttgcactctatgtaaccagatttacctttgactttttttttttttctgaaacaagggttcactaggtagcccaggctagcctagaacatacaattctcctgcctcagcctcccaagtcctgggataaagtgttgctcacttttttcttatttcaaacacagacaaacatgctatcttctgtgatgcttcattgttgaaaagtctgggctgtcccccagtaggatttctttctattcagcacacagatctacatgcccatgcgtgtagatggatcctaaaggggaatttataggctagcttacatcataggcagctggatggtccggtgatcgttgtctacatgccggtgaagctgaaaacccagtagccactcagccaagaagtggggatcctcagaccgggtggagcagtgattcagccccagcctgaggctgatgtctagaggctccctgggggcggcggcgggggtggggtggnnnnnnnnnnnnnnnnnnnnctcaggtagagaagaagtataggaatcaggattctgatgtctatcaatggaatcagctaggcgagccatgcttgtgtgtactgcctggcttcctcctctgtttcttttattacaactgcgcccaaaccgttgagtagtactttccacaccaagggcaggtctttcctcttcatgagtttctctctgctctttgggttagtgcttctggaaacatcctcgcagatgaaccagaggggagcttccctgacgcccccaggcagctctccacacagccaagttgaccatcaagatgaactaccaaggggctggggtggcagcccagtctaaagtgcttcttgccacacaaggatgccgagttcagatgcccgtgtaaaaaggtggacatagtgacaggcactggtggtcccactcttggggatggagagacaggaagctagttagccagccaggctggttgagtgggcaaactccaggtacactgagaggcactgtctcaaaaagcaaggtggggagtgattaaggaaggcacccagtgttgacctctgaccttcaaaagcatacacacacacacacacacacacacacacacacactccaaagaaatgttaggcataatgggtttcaaacaaaaaaacattggttttgctttttgtttttttgcaacaaagaatttttcactaggagaggctatttatacagtttgggctatgtaccccatttcactgaccccaggacagtcttctgggcttacatacactaagggagaaggccagggttcccgccactttgctgtcgaccacagatgggtgaggccttgctctcagctgtagctcctgttctccctttgggtggctcccgtgttatcagtttattgactgagtagcagacaacagagacagtgacaaattgatggaaacttggtaaagagaaaggtgacacttttcagtgaccttggttcacccctaactttccatctccctccgcagcactggcatgtgacctacattttcacttgttaaaatcaccctgatgtccagggtgttaagatggagcacaccgtatctattcatcagagacacatacacatataatccacacagcaaactgaggggcctattttgcctcctggtgttcccctcagttgggcttctgaggacaaataaagtcactgtgggggcagaacacttgtctctaagccactttccttcttgattcttctttgaacatttctccagttttgacacatagaattttcatcatatttggttgaaatattttggtttgttgctttcgtatgtaaaaaggaaaaaatatatgtacttgagagatgtctcagtgggtaaaggaccttccaagcaagtggcagatactgatttttgagtcccagaacccatgtggaaagaactctgggaatgatagtgcttgtaatctcaggacaggaagactgaggtggacatttccttggggctatgcctacttggtgagttccaggccaggccagtgagagagctaagaaagaaagaagagagaaaggaaggaagaaagaaagagagagagagagagagagagagaggaaggaaggaaggaaggaaggaaggaaggaaggaaggaagggagaaagagagaaagaaagaaagaaagagagagagaaagagagagagaaagaaagagagcaagaagaaaaaatgatgacctgtgccgaaggaaggacattcaagtttgaccttcggcgtccatagcacatccacacacatacatgtgtacccatgcatatacacaaacacatgaatacatgcatgtttgcccaccctcacacgagcatacacacaaacacatacatatgtgcccacctatctagacacctaaacacaagcacatgtatgtgcccacccatacatgaatatacgtaccacacacggacacatgtatgtgtacctgtacacacagaaacacatacacaaaatgccactgtttcacatgttcagcctgagatttcagttaaaacagttcctagcagcggtgccatccacacaagattaagccagccaaaatttcaacatttaagaataattttgccgggtagtggtggcccacgcctttaatcccagcactggggaggcagaggcaggcggatttctgagttcaaggccaacctggtctacagagtgagttccaggacatccagggctatacagagaaaccctgtctcaaaaaacaaaaaacaaacaaagaataatttcatatcccattgtttttcctgtagcatctgtgatattttcttatatgaagccaacatacattctctaattattttttcaaggagttgtagcataattgcattgtggatgggaattgcctgtcgtttgcctttaatcttttaaattgttacgttgcatattttattgcccgtctttagttc

SEQ ID NO: 104 - DNA, 774 bp, Mus musculus
gctcagggccccagccagtgcccagccctgctgggagccccggctagcaccacggacggcacccaggaagcccgagtccccttggacggggccttctggattcccaggccaccagcaggttcacccaagggctgcttcgcctgtgtgtccaagcctcctgccctgcaggctgcagcggctccagctcctgagccttcggcctcaccccccatggcacccactctgtttcctatggagtctaaaagcagcaagactgacagcgttcgggcatcgggtgtcccgcaagcctgcaagcacttagctgagaagaagacgatgacgaaccccaccacagtcatcgaggtctacccggacactacggaggtgaacgactactatctgtggtccatcttcaacttcgtctacctcaacttctgttgcctgggcttcattgctctggcctactccctcaaaatcagtctcgtagcaaacgccaaatactattcagcagctgcagaccagtcctctaggcaagcagacagcagacatgaactagcagctatagtcaagtcctttcagcaagcagacaccagacagctgcagttcaatcctgaagaaactgccaggctcaccaaccagcctaaggttcgggacaagaagctcttgaatgacctgaatggagctgtggaggatgccaagacagcacggctgtttaacatcaccagttctgctctggcagcctcctgcatcatccttatcttcattttcctgcggtacccactcactgactactga

SEQ ID NO: 105 - protein, 257 aa, Mus musculus
AQGPSQCPALLGAPASTTDGTQEARVPLDGAFWIPRPPAGSPKGCFACVSKPPALQAAAAPAPEPSASPPMAPTLFPMESKSSKTDSVRASGVPQACKHLAEKKTMTNPTTVIEVYPDTTEVNDYYLWSIFNFVYLNFCCLGFIALAYSLKISLVANAKYYSAAADQSSRQADSRHELAAIVKSFQQADTRQLQFNPEETARLTNQPKVRDKKLLNDLNGAVEDAKTARLFNITSSALAASCIILIFIFLRYPLTDY

SEQ ID NO: 106 - DNA, 32607 bp, Homo sapiens
ccaggctatgtcttgttcccagcgctgagggcaggagcaggacctgcctgtcattggtggtgggagtaagaggtcggagcagggagcggagcaaggggcctgcccgtctgtgctcctgcctggttcccatctcgtgtaaaccgagccctgatgacttccacgaagagggccccgccataccccgtgtccccatccccagcggtgttcagctcagggtttccagccctttcttctgggccctctgggccccatcgtgtgtgggatgggcatccattgaactgggttttgtagcctcatgctcagggagtggtgtagggctcagcctgtctgctgcccactgactctgccctggcctgcaggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcaggtgggcgtgtgggttccctctcgctccgcgttgctgggaggcagggcggggctggacggggagccttctaggcaccccctctcagtgctgccccctccctgctgctgtgccagagctcctgacctctgacctcagggcatccgggaggcgggggttggccgcccttctgcagaggagtaagcggcagcacagagaaagctgtttggccggggtctcccagtgggaggggctcgggccaggctgtgggtcctgggaccttggcagctgggcctccctcctatgagaatggacccaggtcaggggtcgtggcagttcctcttggttcagtcggcccgtcggtccccagacctggtgatgggcacatgtggtcctggtcccggggttgctgatggtggagagggtcatggtgcccaggggaccggggatccccggggaggtgaccttgggtgcgtatgggtccccggcaccacgctgcgagcagctctgtgggcgtccccagcaggtgccggctgccctcgaggaggaacatagggggcccttccttctgggaaaagggttctcccccagggcccccacctgcagccgctgctccagcttgggtgacccatggtcaggtgaccttgggaaggggacgtcggactcagttagtttcctcttctcggggcagacctgagtggagggttccacataagaggggtgactgggggttgggggcttttgttttgggggtgggcagcgtgtcagccggcggcctcctgccctgagctgcgcctggtcactgccccacactctccagggctgacaggggcaggtttacctcacgtggctcacttggcacttggagtctctgggcctgacccctaaccttggatcgcttccggcagaattccggctgtagggctggctgggcctctttgctctgccccttgcctgggcagtgaatactccttagcaacacccagggctaagctgctcactagaggccaggacacaggtgaaccggctgggccatttccccaggagccttggggcacaggggaggcagccaggtgaaaaggggtcccctgagggcaagagggcatgcaggcatgagtgcccacatggggagggggcacacagcctgagtacccaggtcagggagggggacacaggcatgaatgcccatgtgggggaggggcacacagcatgagtgcccatgtgggggaggggcacacggtatgagtacccaggtcgggggaggcatacacaggcatgagtgccaggtggaaggaggggcacacagagtgagtgcccaggtgggggaggtgcacatggttgtgagtgcccaggtgtagtctcaaggcagcagcttgggcaggaagtggagccaggcaggagggagggtctgagggcttctgaaagcatgtttggtgaggagaggaggggtgggaggcgctgatcaggtttctacacttgggattgcagaggtgttgacaagaggcaaaggcggaggaggctggaggagggcggaggccccaatcggtgttgggaggactgggtcaggcctggcactgcctcgagtgacaggcagtgggatggtggccagcttagctgcagacgctctggcgggatggcagaaccgccccagacacagagagcttctctaccaggaccggcaggatttgctgcgttgaaagctgtacttgagcaatgtttagaaacaaacccgggcgacatgggttgcaggtcctaggaagtgcagtgcgctcctgcccaggagcaccttggctggccatcagtggtctggatgagggggagatgagcggacgtggctcggggatgcaggtggagggtgttcccaggagcagccagtgcagaggccctgcggccagaaccagccatcccaacttcccagattgtgccatcactccctcctggaagccttctttggttttttcttccagacagacagacagggtcctccccagtggagctcctggcactcacttccttgtctgccgctagccttgaccctgatgtctggctgaaccttggctcctgagcagaccaggagaacctgagggttgaggaaaacctcttctgggccaggctgggcccacgcagagcagccctaccccgggaagaagggagtctgtccctcctcctgccttctgggcctttccatccctgcagtttcagaaaggcccctccttcaggaagctctccctgattgccacattcaccctcttactcctgacctggcactcttgtgcttggggggtggcgtggcagctgactcctcccttttcctcctagggacccagatgcgcagcctgggggtgagctgatgctgggtggcacagactccaagtattacaagggttctctgtcctacctgaatgtcacccgcaaggcctactggcaggtccacctggaccagtgagtagtggctgcagtcggctcccctgggttctgtgggcgggggcggtgtgcggagaccctggaggaccccggttctgcaggtgggggttgcatgtggggagtagtggagctgggcaagaaagagatggggtcagaccagccctccatgcccctccttgcccctccatgctccccatcacctccatcccctctattccctctatccctccatccctccatttcctccatgcctctgtgactctccatgacccaccatcccttctgtccatccctccatgccctccatcccctccatcccctcatccctctgtgactcttcatgaccctccatctcctccatccctccatcccctccatccctccatccctccatcccctccatcccttcatcccctccatcccctccatccctctatgcccctccatcccctccatccctccatgcccctccatcccttcatcccctccatcccctccatccctctatgcccctccatcccctccatccctctatgcccctccatcccctccatccctccatgcccctcaccaccacctgagggtctcccaccccctctaccactctgtgtctcctctcccaccctcttccctggagggcttacagccggctgtgcttccaggagccctgaggggaggagagtgcagcccagccaggggaggggctcccagggaggggcactgggcccccagggcacactccagtcccggcaggggcttcacgccctgactccccgcagggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgaggtgagcgccgggggctggggctggggctggggctggcagggggagccccaaggccaccactaccaccctgacactgctgtgacccctcttagtacatgatcccctgtgagaaggtgtccaccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatggggaaggagggtgggtagtgcgaagccagcacggcagctgactcggcagcaccgggacaagcatttggggtgccccgggcctatggccccctgccctgccctgcccagcccatgggctccagcctggtcggccagcggggactgacttgttcccaggtctggagcagtagccggcaggatgtggccttggctggggtttcagggtgtctagtgtgagtgccagccttgaggagtgatttcagggaggtggcccagccaggcagccacggcactcgaacagaggctatttctgctctcggggaccctcagagcaggcctaccagtcaccctcctcagccctcttgtcccgggaaataaatggccccaggtggcgtgggggggctggcctagctgggccttcttgcctcccaggccctagaagcggttttgtgtgcagtgagctgagctggcaccaagcaagcctgcccagggtccctggttgcagggattggactcagaagtcccctccagccacagctgccacagtcacggatccccgggctgataacgcggtgcgcttgttccgctgggaggggaggggttgggagcgtgtgcccggatgcagtggtagcagcccctggggttctaataggtaagtaggagtttgtgggcatgtggtggtgggagcagagttccttttgggatcagtagctctggagtcacttagagccccctcgagccccaccccaacaggttagaagatgaggcagatgtgacatttgccattatcttgatgcctctgcctgagggtggtggctgccttggccttcctcccaaggggctgcagggctttcaccccagagccatgctacggcagacacctggagcaagaacatttacccagggtggcacggaggcttggaaacacatgcctggcgtttggcatgcctgaaatctgagcagagctgggcagaactctgcagggcctggcagggcttctggggagacaaatgtcctgtcatcagatgctttgtgcactgaggcctgggagggcagagaggtacaaggaggcagccataccctgttgtccctgccctgtcccactctccccatctccctccttctgcagcttgtcagctccgtccagctcccatcttcatggctgctgccctggggttgctccgagggctccctccagcccggcaggattctcggggccctggagtctgaccccgggttcctccgtggttttctagctggtgactggaccctgagcctggagtccccccctgtctagactgtgggttgtaaccagaaacccctagcaaaggggaagctggagcccaggcccttggggagcccaccaacagtcacatgaatgctggctgtgccaagtttggctcggccctggctctgccctgcgacccctggctccctctcagtggtgtttcctggcctcagaggcagccccaaggtggcctgaggccgggagcaggccctggctcccctgtcacctacccagtgaccctgggcaggccctggaccctcgggcccaggcaaccctctcctgctatggaggcctcctcactgcctgaggccttcagggcaaactggggtggggcagcactgggcagaggctgtgtggcaggccagggtctcccagaaggtggtggctggccgggtaagcccagctcagatgctggggagacatgggggcatggcacacaggccacactcagcctgggatcaggccccgtctgaggacaccgggtccagttttccctgggccaggcccttggaaaggaggagggagttggggagggagaacggaaccctggttctccgacaggccccatccacccacggcctgtgggctccagggagagcatggccagggtgcccaaggagacgaggaggaggctcctcatgcttcatgacccctcctgctcgttagggtttatcaacatcatttaagatcagccttgtgctgtgggttcctggcgtgctgtggataacactgtgcccgggtcagcccaggcatgaggggcggggactaggctggaaagaggaggggcttgcagagggctgggcttttccaggggattagggttcagaacagaggtttggggagagaaagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggttggtgaagaggacccagctcagggaacctgcgtggtgaagtgggggacttggagggagggagggaaggctggagttttctccatggggaggaactcatggggactgttatggggatggaagatcagctggcgtcaagcataccgtgagagtgaggatgtggtggggtagcggaggcggctgaggctgggaggacaggcattggtcaggaaaaatgattcacagggaacaaagtatcctcaggggaccaggctcagaagggctggtagggatcacagagaggctgtgggcaggtgagtaaaccagcctccagggagacaagtgtccttagcagccaggacctcagcacaggaccagagctcggaacgggacactttgccctgcgagcagatggagcatgacctggggtctgcgcaggagaggccacattctcccagactctgggagtgaactggagtggggccccggctgggtgaagtcagactccaggaaagggggcaggagctccgatgggcaggagtgggctcagccaggaaggaacagagtagggggtgctgaaacttaccggaaggcctggacttggtgggctaaggagggaagggactggagggtggtcttgggggccttgtggacttggttagggacaggatggggcagagacgggcagtcaggtagggggcctgctggggctcaggggactggagcttcgtcaggaggggactgagctgctggaactgagagtcaacaggccagaagggcaggacccaggggcgggggtccctggaggcagcagggcccaggcgctggggtggagcgccatggggagagtgggaagaggaagagggtctctcttggggaggcagatggggagggttccgggagcgtccagtcttccacggggctgggggctccgcgagagggatggggccgggtggggtggggaggaagacgcagtgggtccggggagatggaggtggcgcggacaccctggtcgggggctgtaggggtcccatccctgcgggaccttgcaactccccagggtcgcggcttccgaggcccccaccctcctggcaggaggaggcggaggcggggaggtggctgtgcccgctgccgccgtgagtcaggctctgggctgcagccgcgcggccggtctggcgctgcggagggagcgcaggcggcgggggaggcagcggcgccgccgccgagccccgcgcgctccccaccccctcaaggttgggccgctgggaggcggatcagtggacagacagcggcccgcgggacggcggaaggacgcgcgcaccgaggctcagggggtccggccgcgcgccgaggagtcgcttgtaggtgaggaggcgccgtccggggggctgcggcagacccggatggggctgggggctgcagagcctcggccgcagaccccccggcgagcgccgcacgggagctgggaacgcggggtggcgcagagcgcgagcgacttggtgcctcgttggagaagtgttcatttcacagcctgttattgtgcgtctatgtatggcccgggggtgcgtggctccgggcaagtgtgcgcgcttggggtccccaggttggaggtggggggcggtgcgcacgagttggagaccccgcacctgtgccggttcttggtgctcgtggctgagcctgcatcgccttgtgtggggagttgtttactcgtcaatggctctgagcgcgcccgcgggtgcgccccggggtctggagagcccgcggtgcagcccgcggtggagcccgtggcggtgcccgtggcggtatcgggtgtccgcgggcgccgtgggcaggtgctttggccgctctgctagctctgccggttggcggctgaggcagcgtcgctgtgggtccggcgccccgtgtgtgcggggttgtttggggtgctggggcactctgtgttttgcaacagtgtcagtctcagcgttggtgtgcttcggggcggggggtgctgttgtgtgtgtcagtgggtgagtgtttatgcgcagatggcgaagtgatgaaagccccaggtccctgccaaggctgctgcgaagggctttggcatcgtccgtggccgccgaggcccggggcgggtgggggaggcaggtggcaggctggcagctggcggcccccgcagggatttccgtctccactggggctgttctcggagctgctgggcgtgagggtgggtgctggccggtaggccgggcccagcttgctctcactttctcctctccaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgagcccgggcggtggcagggggcaagggcgggctagagaggtggtgccggcaggacagtccctggctgtgggcgctcggcccctctccctctcaggggagcacacgggtagaacaggtgcagttgaggggccaagggatcaaaggacagtgaggggtcctgatggtgggtcccagagaggtcggggtactggctaggtctgggcgggcaggggtctgcccttccctctcctgagccatcagggcctggctttctgctcagccagctcagcggaacctgcaggaggggctgggagcgggggttgaggggggcggggttgctcaggctcaggggacatgggacgtagacctgggcagcagccacttctccgtgtgcagggatggggccagcgtggggctgaagagggcttggaatcctacccctatggaaaggaagaggggccaccttcttatccagctcctcacccggagcccaagggcaggtgcttacacagctctgccaagccctgcgtggagaccagacctgggtggccagggcagcccagggaagaggggtgtaaacaggtcctgcacctccccagctcagggctgcgagaagagctggctggtagcagagcaggtgctgggcagacatgaccctgtccccctgagggcaaggtggagcagcagggactgagatggtgggagggaggctgtgatgggctcacagtgagaggggcagccgtgtgtcaatgtgtctggtgctggagcccttcctggggaagggagcgtgagggcgagggcaggccccggtgccctcctccccaccccgacgcaccggaaggaagggcttggctcacgtttagcctcatcatcacatttccccagcccagacttgagtggccaaggccagatgtactccaccaatgcagctgccctgccgggtgggggagaagacaggggatgcagggagagaagaggctgggcagaggctggctgggaggaaggacgcctggccagcttcgcctctgctccatccttgagctcgagccccaccccgcccggcatcgcaactgcggtcggcgttcccctcctgctcctgactcatcatgattgccaaccccggcgttgcccactggcacgggcaccttcaacctcgggcctgcggatccatccctgggctctgacacaggggcctgtgtgtgagccagcacgtgtcagtgtatgtgtgtactcacgtgtaattgcataagtgggcatgtactgtgagtgtaactatgtgtgcatgtgaatgcattgtgtgcatgagtgtgtacatatatttttgtgtgtgcatgtgtgtgcatgtgtatgactgtgtgtaggcaggagtgtatttgcatgtgtgtacatgtgaatgcatatgtgtgcatgtgtgtaattacgtgggtgggcatggtgtgtgtaaatgtgtgtgcacaagtgtgtgagggcgtgtgtgcatgtgtggtgtgtgtacctgtgtgcatgtgtgtgtaattgcatgtgtgcatggtgtgtgtaaatgtgtgtgcacaatgtgtgagggtatgtgcatgtgcgctgtatgtacctgtgtgcacgtgtgtaatcacacgtgagtgtgcatggcacatgtaaatgtgtgtgcacaagtgtgtggggtgtgcctgtgtactgtctgtatgtacctgagtgtgcacgtgtgtgtaatcacacatgagtgtgcatggcacgtataaatgtgtgtgcacaagtgtgtgtggggtgtgcctgtgtactgtctgtatgtacctgagtgtgcacgtgtgtgtaatcacacgtgagtgtgcatagcacgtataaatgtgtgtgcacgggtgtgtgagggtgtgtgcatgtgtgctgtgtgtatgtacctgagtgtgtgcatgtgtgtgtaatcgcacgagtgtgcatggcacgtgtaaatgtgtgtacacaagtgtgtgagggtgtgtgcctgtgtgttgtctgtacctgcatgtgcatgtgtgtaatcacacgtgtgtggttcatgtaaatgtgtgtgcacaagtgtgtgtgagtgtgtgcatgtgtgatgtatgtacctgactgtgcatgcgtgtgtaatcatacgtgagtgtgcatggtacgtgtaaatgtgtgtgcacaagtgtgtgagagcatgtgtgtgtggtggtgagtattcctgcgtgtgtgtgtgtgtgtagaagcaacaaaggaaaagggcccctggaattggaggtcatgcttccgaccagctccagctgtggctccccagaccaatcctgagcagaaagctccagtgttggggggctgaagctgcagctggtggagctctgcctcccctctctctgtgccctgccaacagcctgcggacatgggtctggctgcctgggctcccgtccggaagctgtccctcctcccgcttggctcaggctgtggctggccggctggcatggggcaggcccatctggctcgggttgtaggtaggtcagggatttctggatggtgccgggtttctgcaggggttgggggtggtgtgaggttgacccttctgagggtcagggacggctcattacacctcctcccaagcctgctcctcctgtgtccttcctgcggtgggcgggggcagccagggcagagaggctttggggcatacctgggagtgggtgcaaggtgacctgtctccatcctgggcagaagggaggacggaactggctggctgtggaccccacgcctgggaatgcatccatctggtcacccagctgcaggtctcctgacctgcaccctacaccaaggacgcggggtggccctaggttcagaaggtcttggctaaaatccgagctcttgggacagacaagccatcttgcctcactgagcccctgttccctcatctgttcacaaaacaaatagaaacaaaacaacattcaagccagcacacgtgagcagggcggaggcccgcatgcagtggtatgaactagacagtgtgtccttgcctgcccccacgtgtccatccacccgtccagccatccatccaccccccccacccacatgggccaattcggctcaacgcaggctggatctgcagcgcagagattgaagccttattttgcacagcctggtgtccggggaaggcagagatacaaaaagtcaattctccattcatgccgcctccacacactgtctcctgatgaccactggctcccgcggtcagctggatgatggccaaacgtctcatctcagcatccaagctgcctttttaacccttctggcctcagcggttccccgccccggtcactcggcaaatgtgatgtgagcgatgtgcacatcctcggcctggagagcttttgtgagatctgggtctctcttctgcaaagcctccagagacagtcctgccccagccacatctgctcaccccagccaatctgtgcccaaggcagagctggccaacagatgggtcaggacatgtgggtctaatgggtgggtggacagaggacacatggtgagacggaagaagcaccacagtgtttcagaaaaggaatacttcattcccagtttggggtgaggctggaaaacttctagaaggaggcagcaatttcactgggccttgaagcttggtgaggggaaaggtgtttcaggcggggaaaatggcataaactaagacacgtaggtggggcagtctagggggtcggcaaggcccctgtcctcaatgggagatggaagacattcctggaagagtgcctgaggcagtgcggtgaacgggtttgaaaacctcgtgaggggctgggctctcatctgtaggagccatggaaagagaaggatatgatcagggccatgaaatctgcaaccagtgtaggggaaggagacaagacaagcctcgaggcagaaggttcaagtcccagtgtggtggtccaggtgggagagcttgcgagctggggatgggggtgggagaggaggaacaggtgtggctaggacacagcagctgctagatgtgagcccaggaggctgtgagaccttccagtgacagggcggtcagaaagaacaggttaggtgggtgggttctgcgttgggttttggatgtacacactcacccactcactcctttctgaatatcagcatcacacatttatctttcccatcctccatccatctatcattcatccatcttccatccatccattctccatctgtccatccatccatatgcatccatccatccatcctccattcagccatcctccatctgtccttcatctatccatccaccctccatccatccgtctatccatcttccatccattcatccatccatcctccatctgtccatcctccatccatccatccatccatccatcttccgtttgtccattcttcatctgtccatccatccatcctccatctgtccatccatccatatccattcatctattcatcctccatccatccatcttccatttgtccattcttcatctgtccatccatccatcttccatttgtccattcttcatctgtccatccatccatcctccatctgtccatccatccatatccatccatctattcatcctccatccatctatccatccatcctccatccatcctccatccatccatccatccgccctccatccatccttcatccatccatccatccaccctcaatccatccatccatttatctttcatccatccatatgtccatccatccatccatcctccatctgtccatcctccatccatctatccatccatcctccatccatctatccatcctccatctgtccatccatccatccatcatctgttcatcctccctccgtccatccacccaaacttatattcaatccatcctcccacatttccttcaacccctccaaatagccacccaaccttccatccacctgtgttcacacatgatcattcaggctcccctccctgccctgctctcccatcctgtccccaccaaccttatgcatcaacccactaaactattcatctagtctcactttctcagtaattgcccactttccttccaagccctacctgtcaatagacccaatcatccctccatcctgtgacctcatgtggcaacacatctattcacccttcaagacatccacccgcccttcctcctgctgctcccctagctgagtcacactcacccattcactgagtgcctccttcatactcagcgtgcctcagctcaccccaactgtcagctcaatccagccactgtcactttctctattccctccttcctcatccaccttgtctctaaccgctcatgcataaatttctcacgttcttcttttccctctcatttttttcttttcctttcttttgccccacttttcggccatgcattctccccttctatccccttcattctttctaccatccgcctacgtgctttactaatatagctaatcattcagctgtaaaatgtccattctctcttgtttcctctcaggcatgtgtccacccaccccaccactcatctcgttgaccatctgaccttccaggcacatccatcccatctttccttccttggctttattcaggtatcccattcacctgcctccaagttgagtggcatgagcctgtccagcctgctctaatgaattatcatagattagttggtttataaacactgggtatttacttctcactgttccggaggctcgaagtctgagatcagggtgccagcatagtcaggttctgatcaggaccctcttctgggttgcaggctgtcaacttctgtgtcctcatttgccagtagggccgagggcctccctggggccccttttataagggtgccaatcccacgcatgacctaatcctctcaagagccccacctcctaccatcactttaggggttaggatttccatacaggaatttgggggacatgaacagtcaaaccataacattgccctttcatccacttatatgtcatcccttccttgtgtttcctctcccctgttcctccagtgacctgttccatccatctctatagccagagccagttcctctctgtacccacatctgcccacccctgctctttttccttcacacattcacccatctgtcatccatcaatattcacagtcatagaagaactgcctggccacctagccctcaattcatcatcagaatgtccttccattttccttccttgcttgcttcgatggactcacccaactcccagccatcagcctgttctctctcccgctctcctcctccctctcctctacccacccagcaccatccatctcccctgcccccacatggctgcctcatcctctatgtcccacctctgcttgtacttttcagcccattccgccacctagcaccctggtgcccctttgccttccctgcttcttggcccactcttctcgggcccgtttcctaattgcttttgactccctaaccttctgacactgcagggctccagggctcagctctccatcctctccttccttcatgttcactcccttggtgccccatccagtcccatggttttagtattaggccgttcttgcacagctgtaaagaaatacctgagagagagtaatttataagaaaagaggtttaattggctcatggttcggcaggctgtacaggcagcatggtgctggtatctgcttctggggaagcctcaggaggcttccagtcatggtggagggcaaagtgggagcaggcatctcacatggcaagagtgggagcaagggagagataaaggggaggcacctcacaagggagggataagggggaggcacctcacactttaaagcaaccagctctcaggaattcactcactatggtgaggacagcatcaagccatgagatctacacgcatgagccaaacacctcccaccaggccctctccaccactggggatcgctgcaacatagatttggcagggacatgtgttcaaactatatcagttttaaataccatctttttgccgatgcttctcaaatttatatctctgccctagacctcatctctgaactccagactcacacaaattgctatgccaaatatctgctatatatctaaagggcattcctaccttgacatgtcagaaattgaactgctaaacgagtcttccttttgcagccttctacaactccctgttcagttgatcaaaccccaaaaaccttgagatcatgtcaagttccatgctttttatcacattctacacctgatcccagcaaacaccatcagcttcaccttccacgcctgtccaggagctggtcaggtctcactaccttcaccactgctgccctggtccaagccaccctcaccctcccctggaccattcaatccacctctctctgcctgttcaactatctgttctttttttttttttttttttttttttgagatggagtcttgctctgttgcccaggctggagtgcagtggcacaatgttggctcactgcaacctacgcctcctgagttcaagcgattctcctgcctcagcctcttgagtagctgggattacaggtacacactaccacacctggataatttttgtatttttagtagagacagggtttcaccatgttggtcaggctgatctcaaacttctgacctcatgatctgcctgccttggcctcccaaagtgctgggattacaggcgtgagccaccatgcctggcccctgccatctgttcttacacagcggccagcactgcctcgttcacatatgtcatatcacgttcatctttccggctctaaatgactaaaaagcacccacagagcctgcaccgtgctcctggatggtctcctctgaccgtatgtcctccccttctctctctgtgatctgctgcccctactctgcacctagtcctcagaagcaccgggccctgcacagacagctctatgctcccaggacatgcctccctgcagatgaacacatggccgagtctgtcacattcttccgatctttcctcaaatacctcccaccccacaaggtcttccctggccaccgagctagacttgcacctcctacagcactctctgttcccctgagcctggccaccaagctagacttgcacctcccacagcactctctgttcccctgagcctcttcaggtttctttttagcacactgagcacattacatatttgacttatttatcgtgtttattttctgtatcttctccctacaatgtaagctgcgtgaggacagagactctgttttattccttgtgatatacgcaggacctagaacagcaactactcagagcagacactaagtaaatattgattgatgattgattgattaaggaatctgtctacccatctaccatccagtggtctacactacaccaacaaccctccttcctttctcttatccaccaatcttagccatccaaaacacatcataaattcattgatctacctgttccacccattcagcatatggatctgtcccagccatccagcatccgttactatatccagccatggacctgctccagccatccagcgtgcattcagaaacccatctgtgcacctgcccttccagtctggcatccgttcctatattcctgtaaccacctgtccattcattcaaaccacgtggagttccattctttttttttttttttttttttttttttgagacggagtctcactctgtcacccaggctggagtgcagtggcacgatctcagctcactgcaacctctgccctccgagttcaagcgattctcctgcctcagcctcccaagtagctggaattacaggtgcctgcccctgctaatttttttgtatttttagtagagacggggtttcaccatcttggccaggctggtcttgaactcctgacctcatgatccacccgcctcggcctcccaaagtgctgggattacaggcgtgagccaccatgcctggcctccattctttttatcacactgcaagcctgatcccagcaaacactgtcagctccaccttcaacacatgtccagaagttggctctgtctcatcaccttctctgccgctgccctggtccaagccatcatggacacatgagcacacattctcgtgtattcacctatttgcctgtcctgcccaccgaacatgctcttacatatccacacatcacctcccatccagcagccgttcacttacccgcttacccagatgccccacccatgtggcatacacttgcatatccatctgtccacttggacatatattcatatgttcgtctatgcacctgttaccccacccagcatatacagacggtccccatcttatgacggttcgacgtatgctttttcaacttcacaatggcaggaaagccataggcacccagtacactcctcagcttaccaggcttgtgaaaaacacatcatacgaaaatgcgtatgaaacttttaccttatgacactttaaacttatgatgggtttgttggactgtagccccattgtacatcaagaagcattgtattcataaattcagctctctccctgtcccactcatccaacgtacattttatatccgtccagccctcctccccacccagcacaagtttctacatccatttctctgtcccatacacccagtctccatccgtataacccctcagcttcatccacccaccttcccgatcattagatcactcccccaccctcctcttccctatcttctttagctgtggccgccattttctatgcacccaataccccagctgcctcagcctcctgccctccgctccatccgcttttgacacccagtgtttcatcctccctctgccacgttattcctcactccaagtatccaacaaagaaatcaagaccaaaagtttttttaggaattcagagttgtcttgatataagaaaatcaataaatataatctaccatattaatgaattagagaaggaaacaatagtttatcttgtggaaattctaacgcaatcatagacctctaatgataagatgagcattatccttcctggtaccttgaggtcaagaatgagactcagctgcttgtcctcattgctgctgtctggaaacgctctggaatcttctttgcctccatgagaggagcttactttggcccaggcactgtggtggagtttcacatccatcaattcattaagcctttcccacaaccctgggaggcagcgctgtcgtcatcttcatgttacagatgaggaaatgaggagcagaagagtaagttgttagctggcctaaggctgtacagtctacgacccgcagaatcaggattgaaatccagtcagtgtttctgcatctgtgctttaacctctatgctgtgctgtctaggagtagactgcaaggaggaaatagaaatactagtatttgctgtagatatgatttattattaagaacacgtggtcagttagtacaatatgatagtttagctggatacaaaatcagttagacatgcaattttaaaatatacttttacattataataaaaacaataaatagactaagactaagtctaacaaaagatgtaatagctctttctggagaaagttatacaactttattttagcaaaggcatcaaataagacctcaataagtgggtgacacattcagtccttataaaggaatacaaatttcattgcagatgtcagtttcctccaaaaccactagcataagaacccgataagagcatagactttcttcctgcctccttccttaccctgaatcctcaatacctgcttcttcccatcttcaatctctccattttgatagcacgttctgtacaatttatcttccaagtcacctacttgcccatttgcccttgttccctcccttcccttccctctccaacttttttccagctccactccattgactccactccatccattccatccatccactctatccgttccattcactccactccatccactctatccattccattgactccactccatccattccatccactccactccatccattccacccactccactccatccattccacccactgcactccatccattccacccacttcactccatccattccacccacttcactccatccattccatccacttcactgcattcactccatccattccatccactccactccatccactccactctatttcacttcactgcatttgctccacttcattccattccattccactccactgaattgcgttctagctttcccttccccactccctctatcttcttttttctctcctctccctttgttctttccagtattctgcctcctccatccatccacccacaggccaatccatttatgcttccattctcccactcaattacacatccatcaccctgaccacacatctatcctctgtccatccagtcttccgacctaggtctcctgtccatctgcctaacctgcacactgagggatccaggcattagtcagccccagtatctatctgcccaccttccttctttcagcccagctccaatctactaaggcaaagactttttgccccttcctgtcttcctctctttccattctccttcccttcctcatcctagaacttggtttcttcttacagcaaacacgcacatatttgtggatgtgatagaaggaaagagtgctgaggaggggagggccctataattcattctgaatgaaggttgcctcttggaaatgagtccagctcagtccactgcctccccaagacttcctgagtgccagcccactcctttcgccttaatattcctccccaaaggccctgtggactgctgtctctcctgccaatgcacaacgctcatcctcaaggcatcccagttaattttaaacgaggcagaaccaatcaaattaggagacagttgtgtcgccccatcctccaattatatcctctctgaggccaacttcttttattttaatcatttaaaacttgcaaaaagaaaaaacaaggaatttctttatatccttcacccagttgccccaattttttaacattttaccatatttgcttttctctatatatataaatacatctcacctactttataaaccagttgagggctgagaggtttcagacatgacgcccccgtgccccaaattcatccgtgtacagtgccccagggcagagacatgttcctctagaaccatcgttcattcgtcagctctcggaaacaaagcactggtactgtgctgagcactgtggcaccggctctgctgggctcctggatgctccaaggccctgctccctggctgactgcccatttcctgtcctcctcccggcttcaggtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaatcctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcatgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaggggactgtaaaggctgagcctcactgtgcatctgtgtgtgtgtgtgtgtgtgtgtgagactgtgtgcatatgtgttcgtgtgtgtgtgtagtgtgtgtgcctgtgtgcttttgtctgtgtatgtggtgcatgtgtgtgtgactgcttctgtgtgactgtgtgcatgtatgtgttgtgtgtgactgcatgtgtgtgtgactctatgcatgcatgtattatgtgcacatgtgtttgaatgtatgtaactgtgtgtgtgtttgcatgtgtgtgactgcacgtgatattcacgttatgtgtgcatgtgtgtgtgcctgtgtgcatgtgtgtgtgttgtgtgtacaagggtgtgcatgtatgactgtgtgcatgtgtgtaaatgtgctttgtgtgagtgtgtgtgactgcatgcatgtggatgtgttgtgtatacatgtgtatgcatgcatgtggatgtgttgtgtgtacatgtgtatgcatgcatgtggatgtgttgtatgtgcatgtttgtgactgtgtgcatgtgtgtgactatgtatgtgtgtgtgtgttgtgtgtacgtgtgtggccgtgcataagtgtatatgtgctgtgtgtggctgtgtgcatgtgtgtgtgactgtgtgcatgtgtgtattatgtatatgtgcatgtgtgtgactgcacatgtgtgtgttgtgtgtacatgtgtgcatgtatgtgactgttcatgtgtgtattgtgtatatgtgctgtgtgtggctgtgtgcatgtgtaagatgtgtgtgcgtgtgtattgtgtatatgtgctgcgtgtggctgtgtgcatgtgtgtgttgtgtatgtctgcatgtgtgtattgtgtgtgtgtgctgtgtgtggctgtgtgcatgtgtgtattgtgtatgtgtgctgtgtgtggctgtgtgcatgtgtaagatgtgtgtgcatgtgtgtattgtgtatatgctgtgtgtggctgtgtgcatgtgtgtgtgactgtgtgcatgtgtgtattatgtatatgtgcatgtgtgtgtcttcacatgtgtgtgttttgtgtacatgtgtgcatgtatgtgactgtgcatgtgtgtattgtgtatatgtgctgcgtgtggctgtgtgcatgtgtgtgttgtgtatgtctgcatgtgtgtattgtgtgtgtgtgcatgtgtaagatgtgtgtgcattggggaggaggtgctatagggtcatcccccagcctcccttcccctgaccacagtggtccagagctctccaggctcccctgcccttgccaagccactgcccattcctgcaggtggtggagcttgatgcctcttctccagacactggaaatccgcataacattctttcctaattgcatgtgctcagctgtcccacgggggctttagagaccagcaatatacgctccctggggtcctcctgctcccatagcatgcagctgactagctcagatggatgggggcacaaggggccagggaagtctctgaccccacaaaaccacagggcccactgaacctcaggatgagaggaactgtccttgacagggactgggcggagaggggaactgttctgagacagaaaagggacaggaatctcctccccaccccgacttcacatccacctgctgagctggaggctttgcaggggtggtcggggccgctcgcagccaggacgggagatgtgctcttgggagactggccagagaggctgtgatggtggaagaagcagaagtagtcactggaaacagcatctgaaaatggcccacagctgataagctccatcaacccaccaatttgagaccagtgaagcccacacgatagaacagtaaatccccggctgagtacatcacagtggaactgcacagcaccagagacacagaggaaaatgccttaaaagcagccagagaaaaccgattattttcaaagcagcaacgatgacttttagccaaaattaatgggctgttcatgacctatgggaaagaaaggatttctttaaacaaaaacttcttaaatgtgaaatataacgcacagaatagtgcccaaagtcaattaaaagtaaaatttttgaaaatgtacagcttgatgaatcttcacaaagcaatcacccatcaatttaaccatacaatatcaagaaagagcactttgtccagacccctggaagcccccgggggctccttctgaccaccccttcgttcccagctgggacccaccaccctgactgatcaacacccagcaatcaattccaagtccttgtgtacatttttacgacctaagagtgcatccctcagcgccgtcatctgttaaacaggctcctgacttttggaactttttatgaatggaaccgggccatgcactcttttgtgcttggtgttttgcgctgagtcacccccggcgattcactggggtgcctatgaattttcattgcagactgacatccattgcatcatgtaccacagcgtacatatccattttaccaccgacaaacgcttgggcggtttccgtcttggcatttaggggtaccactgctgcaagcatccttgtgtgtgctgctcggggcccccagaacccatgtctctcgggcagatccttagtagtgggattgccgaattatgaagtctgctgatcctccacctcagcaggcgacgcccgccctccaagatggctgcgcctcccccagcagtgtgtgttcccaccgtttcatttcctccccagtgcacctgctgtcagtcttttttttttttttttttttttaatttttgccactcaggggaacatgtggtagtatctcgtggtgggtttggtttgtgtttcccagatgggtgaggaagtcgagcgtcttttctgcgcacagactggccatttggttttcctgtttgtgaaatgactatttcagtgtcttgaccatttctttcctaccaggctgtcagtttctccgtgattctaggggttctctcaggacagcgtgtccacgtcctctgatggttctacgcagtgcagataatttcttccgctcggaggctttcctcttcgctctcctagtggcatctttttatagacagaagtttccaattttaatatagtcacaattaccaacatcttccatttggttactgcttttctcggcaagacacaaatagagtgatcataatgaaaaacgttgatgcatttgacaaatctgagcacaggtggggcaacttctgggttgctgggaaggttccgttttctgatgctggtggtggttgcatgactatttgctttataaaagtcattaagttgtacatttatgcttgatgtagttttctgtataatatttatgtcttttatatattgcagtgttatgtataaatgccatcaatgggaaataactcaaatgtctactgacatattttcatatgcatatgaaaataaaataaataactatgaacatctttgggttcaagtaatatctctgagagaaattagccttatatttattcataagtaattccaatgcatagaaagaatatctccagaagaaaagtggctctgggaatggaaagtgagcagtggtgattagtaatttttattgtgaactaagctgcacagagaggagaatgtgggggcatccctgtggggaaggcactcgaggaggggggcaggaggctgggcacggagaggaggggctgcaaggagggggccagagccatgcctgatgagaagggcatctgcggggagatgggcagtggcaatgggagggaggtgattacacccagggggtcggtagaagaagtaaagatattgaagtaaatgggagtctgctttctcactgtgggcaaagagagtgacaaatattgaaagggatgaaactagaacgcagcctgtggtgttggattggagttggaggaatccatttattctccagctccttcctctaagaggctctgaaagcagcaaccccccagtggcagaccctggcccctaaataccactcaccaccgacaggacccggggctccctggggaagcagctgattccaggctgagacaggtcaggggcaggatgagccagggcgaggacatgcagaaaacacgcaggagtcgcttcccaccggccacgccagagacaacttgagcatcaaagccaataatgttagtcaagattacagtttattgcataaaataggaacccgagtttaatacactgatgttaatacatcaataaactggtagttgaacaaccacagtgatctttagttccaaagaaatttcctaaagagtcatcgcaatcacaaagaaactttatgactttatgccttcagaggtaactttacaggtggggaagcccagcaggcatcaccttgatcaaatgatcaaagtgaatgtcatcaacaaccagataaattgaaactgttcaccacctgatgggatgcactgataagaacggagtcgtttctgtgatatttctgccggttaaggactgaatgtttgtgtcacctccactgtgatggtattgacggcagggcctctgggagctgatcagggttagatgaggtcgtgaggatgggacccccatgatgaggttagtgtccttatgagaaaagacaccagagggcttgttctctctctcccacagcctgtgaagacacagtgacaaggcggccgtttgcaagccaggaagagagccctcactaggacccaaatctgccagcaccttgatcttggtcttgtacttccagcctccagaaatgagaaagaataattttttttgtttcagccacccagtcatattagctgtggcagcctgaggtgactaatatcctgccaaaaacgcacagccaaacaccaggcagacccaaactgagggatcgtgagaatagatctggcctataatcagaagtgtcgaggtcatgaacgtcaaggaaagattgaggaaccattccagacaaatgtaattaggcacactctcactctgcagtttgtcttttcactgtcttaatgttatattctgataactaagttattttttattaaattccatttataatttttatcttgtatgactgatgtttttcatgtcctgttaatttttaatttcttttttctttattttttttttactcacttcagggtcatgaagcttttctcttaatagctttattgttctgccttttggatctaggtctgtgctccaccttggatgaatttttgtgtatgatgtgaggtgggaggtcgggggagctgaggacactgtaggtcctccacccaggtctgcttgggtcataccactgttcctctgtgccccacccccagcctcagtgtgcatctgtctccaagagtccacgactgagatggtacttgggaagaccctgtatctggacttcatatccctttcacagtctttagtcactgctgtttccggctggagccccaaagccaagctcccctgtctgcatcaagataaacttatgatctatgatcaagagttgccattgattaggcagaagctgggcctgcacagaaacccccactctcctgaaatcttacttcccttcccccattttcctaggagcatgtccccagtaaattacagacatggagatcttctcacttctggttctgctgccggagaacctgaaccaactccggggcaatgttagtatttttattcttcccatagagacgtcccagtgctgccatgtccctcatggagaagaccatctttcccccactaagttgcaggggccctcagtggtttgttgggtggccgtagagacgtggtgcatgtgtttctggacttcagtctgtcccactggtctatttatctgactttacagcagcatcagactgtctccattcctgtgggaatactatctgtattaagtcttcataactggtaatgtttttcaaggaatttttccatttcattgaagctgccagatgtattgacataaagttgttcatagtatatttttattccattttggatgtctgtacccacattttcatttctgatcatcctatttcatactcttgacaacttttgattctctttattcttggtcagtcttgtagataattatcaatatacttatttaaaaaagaaaagtttgcctgtgggtctttccattgtgtgtctgcttttcatttcattaatttttgttcctaactttattattccctttcttgtaatttctttgggtttaaattgctgtttttccctccagcctctttggtgaataattctttttaactttcttttttcataatataatgaattaatttaaatccataaatatcctacaagttttgatattatatatgttttattatcatttgtttcaatatagtttctgagttctatcctgatttcttttttgaatccttgattacatagacacttggttaatttgcagacattcagatttttttttttctgagacggagcctcgctctgtcacccaggctggagtgcagtggcaccaccatctcggctcactgcaagctccgcctcccgggttcacaccattctcctgcctcagcctcccgagtagctgggactacaggcgcctgtcacctcgcccggctaattgttttgtatttttagtagagacggggtttcaccgtgttagccaggatggtctcgatctcctgatctcgtgatctgcccacctcggcctcccaaagtgctgggattacagacgtgagccaccgtgcccggcagacattcagatttttatagtgattattattgtttttttctttgagacagagtttcgctctacactcgcccccactggagtgca

SEQ ID NO: 107 - DNA, 371 bp, Homo sapiens
atggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcg

SEQ ID NO: 108 - protein, 124 aa, Homo sapiens
  VARIANT (1)...(124): Xaa = Any Amino Acid
MAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLX

SEQ ID NO: 109 - DNA, 20543 bp, Mus musculus
  misc_feature (1)...(20543): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgagtgctcaccctcctcctcttcctcctcctcctcctcttcctcctcccctcgccttcctcgccgcttccccaggcactctcccggcggcggcagctgcgccgccaaagccccgggccccagcggccccccacccctcactcgcgcgctcccacactgcctccccccccttccccggggggaaggccttttaatttatttattctgctgggactgaggtggggggcttggctgacgggggagaggggggtctccacggcttctatctccccccgcggctggggctacccttccagctacggaagactccacggtgtgcgcccccagggcctcccaaactgtttccaaactgcccaggccggtggtggacgcgtggagtctcggcgaaaagggctgggtttcgagtggggggtgatcgtgtgtatgactactagaagcctggaggggaggcagacgtcgaccccaaacgagtttgcaatcgaggtatctccgatcccgcttcctctttggcccgcacgccccctccctcccaggagctgtgctggggaagggaaaccaaggtttggaaccacactagccttcacattcctgggaggatacaaccctcgcctggacggggaagatagctctttctctttattttttcgtttttattttttgcctttctgtttttatttttggaggggagcgcccagtaattgtcttgaacacatgcttctccctccctccttcctccagccaccagcgacagagagtccccttttttgcatttatcattttccttcccctttctttattaaaggtccgggagtggcggcggccaatcagcgctcggcttccattttgtgagttcaactcgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggaatgcttttcctttgactcccccatccagttcaggacgcctgaatgtgtttaacatttgccaaaggactcacacttggaagaatgaagaccttttaaaaagatctggatttttccttatgacttggaatccatctttgtcttgtataactaggtcatagcacactattaatgtcagcagttaacagttttgaattcaaaaaaacctaagtaaatgacatatttaatttttttccttttttttttttctcgggtgggtgggtgggagagcttggagctgtcttaatctgtattctcttgactgaacaataaatttttaaatatagtttcctctattaaacacttaagcctgaccatcttattaattctattttttaacaaggtaatgttttaaatgtatagttgtagcgaaacggcaacaataacaaaaaaactgtgagctgttgttactgttaaattttctaaaaaccttttacattgtaagtacccaatccattctgtccttaactgcactgccgttctcgtgttactgtcgcctgagatgtcctgaattttcggaagcttcatctgcatgtatgtctttgtctttgtctgatgtaagtcagttaaaatgcttttagacgtttttgcttctataaagctacgattttttagcttcgagctttttggaaaaaaaaaaatgtttacagccatagttgctattcagatttcttcccagtagctcgtacactctttgaaaatcgatctatttgaagaaaaacagctgtttttctcgaactgggtgtggggtggtggagggtaagagaaaggaagaccttttgtataaaaaaagactgaaagccgcctctgaaaactagattaaaactggaaaacaagcccttagccggttcaagccaaacacctacgttgagtcggtggtattttctgtggcggttgggatggctggttttgccttttgttttgatttgacttgtgttttcgccttttgtttcttaatgacgatcacaccattggtaaatccagagcactaaacagccctcagcgaagccgcctttttgccagcccaaccctggaaagtttgcagtcgtggaaggagcagaaataccacgagtgtaacttacaaagaaggtaacaaagggacaccagaaccccaggtttccccccaactaaacaaccaaacatcccccacctcccaaaaaaagacctgttatttttataatatctccaaaagcgccggccagctttttcttctagacgccatggcgccgggctgagtgggtaagtaaaaaactagactaaaaaaatttgttttcaagtgtctttttcccccttcgaggaactctcgattgagcaggccatgggctgcagatgattgggagctgggatttcttgagcttgagcttggcagccgattgcagtgggtgggtgaggggactagggctctccagacccctctgcctcttttgcacccaaaggcgaagagagcctgtccccagtaccctggggcatccatggagccgcctgcgctagtccctttggctcgcctcaggtttgcaccttagtggcagagaagaaatcgaagtgttttggagatggaggggctgaaaaaagcgaggaaaccttcccacccatcttaaagtctcgttcctgattgattgtgggggtttctgtcccccggaagccagcttttcggggctccggggctcgcctgctcttccaaagagaaaaaggacaaaaggccggcgtccatgttggcatcatgacgcagcatctctctcccgcctgcagcctggcgctgcttgtcctccgggccgcgctcgctcctccctctcaaacacgagttttattttcaggtttttgagccgagccgagggctgggtcgggttggagccaaggctgaagccgccgggccattcaatactgctctctggctaatggcggccggctttcctccttccttccgccatcctgcttttccctggttgtcgctgggagccgagaggcagccccgggccctaacagcctgccaggcacggcgcccgcgatcctggtgacgggtctcggggggccttaggccccggggggcgtcgcgcaccctaattctccgcactcgatccccccgagcccctccccccaggcgcggttcgggcagtggcggccgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttggaaatgcagatgagtcgtctcccgctgctggtctcctgggttgaactttagtgactcagccaccctcaccccacccccacccattccacagtgagggccgccttgtcagctgggaaaggggggggggacacagcatttctgtgactccctttctatctagtagaccctgttggtattgcatttggccaatccattctctctgaacctacaaactgtggaattgccctaacagaacgtccgaatttacaggtcttggccggagaccggagccatgtctgtgttatccccactgtagacaatccttgcttcctctggacatctggagcaggcccaatttgactgagagccttcccccactaaggtaggtaagagccctttccccaagttcagagaactgttgccgggctttgacctgcagccttcgaagggcggcttgggatccccaaacctgctgggctggttctgcagcccctcccccacgctgatgtagcggttgtgtgtgtgaaatgggcggcctgctgggtccatccagccccgcctgtcagcttctgctgtggggcgtttagggcgggcgattctcatgccgaatttagcagcttactagagcaaggactaccaagtatttcccagtggtgtggtttatggtggctgggagggccctggaaacttctgaagacggtgactgctgccaggtttcccagtggtgcttcagacattgttcctgaaccccattagggggaccagctgagcccccttctgatgtctgccttgctggatagacaaagaagcaaaagatgtgaagtggtagccagcttcccgagagaaaagatttccttggcttctccttttcctggatccgagctctcaacaaggccaggtgtcggtagcctggcttctagaacgtgacacaaacggaggctggcccttcacctgtctgtagtgatcttacagagtcaatgaggtctgtgcttagtctctgagcagggtctccccagctgcaccggcatcagaagtcagtggttggacccattaaacccgactgtgcccatttctcgagtttccctcttaggcagttacatctaagaacttgctcttcttacaaggttccaggtagcaccaagtttctagactctctctagtaggtggcacctgggatgtcacccagcttggtggctagcagttggcttgccctcctcctaggcaggaagctttgctgctgaaactggtgtggcccttgatccctgacccctggccccctagtgtgtttctcgttttgttactttgataagccatttggcctcaggtgccgcggctcctgctggcttcccctatttgggcctcagcttccagcctctagtcttctcttttctcctcacccctacagtgagtgctgacgtgtgagtcggggagcctggaaggcttccctgagttgttgctggaggcagattggtgcctaatcagggtgcttctagtctggcagctgtaggttagatgtggacctagctagtgaccttggaccattgcctctcttccccctccccgggttaaaaagaccacaatacctgctggaaaaggttggtgggaggattaagtgagattaagagggccagactcctgctctgacctcacaaccagttggcctccattgtgataaggattgttgctgggagtggttgctgcctgcgccggtgggggctgggctgtctccagggctcctcccctccagcccacttcctgaagcacgtgctggagcctccaggcaaaggagaaagaaaactggctttgcttgggaaggcagccagccctgtttttcttctagtgtttgagtccaggctgttcccggggctccgtaggctgtcctgtggttgggtcgggatttaagggccacccaccaatagccccaagagaagaaatgtctcacccaaggttatgaggccaccacggagcagagcctggacagggttccaggtgtcttgattttcagcccagaacctgggcccgtgacacccccttgcccagctgtctgggttattttaggctccctcccgtgccagctgtctgcctttatcactgccagagagagctgtctggtatagcaaggctccacaatggtcccgtggctcccgctggtgcagagggccaggcatcaagtccgtcgatgagctggctttctgctgggaaggctgaactcctcacccctattgagaaggggggcggggagaagagcgctttgctaggttggtctcgttcatactttagatacctggtaagccttggaacacaactgatcaaccctaaaggctctggttagagtccttggatctggctggggtctttatctcctccagcctcccactaattgatttaagtcgcgctgtgtcagctgtaccctggagggctacaggctttagggagcaattaggcgctaagctgtgacgtggtgcttgaaaggggaagatggaagtgaccgggaccaacttgtggcttgctctctacttcaggtcttttccacctctctctctctctctcctttctttggccccttatcacctcctgggctgtagggtggggcagtttgtcctgctgttgttcctggccccgaggggtgccccgcctcctggtcacccacggagcgtggggcggagccgctctggcctgcagagagagggccacgccagcagaaggcttgcctgaactgggaggtggctgtactcgatttactacacgagattccagtgtccccgccccttccggctcctccacctggccccgagcccaagtttggaatatgacctttttagactctctgcaaccgaggtgggtcggaggacccgccatccccgctctccacggcccccagtgttttctcggattgttccgtgccaatgggaaccaggagggaaagttgaacaaaaaccttcagagctattaaattgtcgcgtgatggaggagggtcttgctgtgtccgggctagtcctagtgacaggttaggaccctaggtatatccctttgtaccaacgttcgctggttttccgcctggcttccagaaatcactaagcccatcctctgcttgttccctggagctgttaagtagctgagacttggagcggtcaggctgcctaaccaggtagataagatagcctggcttcacccctctgctagagtctttatctcccccctcttatccgttccatctgcatttggatagctcaataattgatttatggggcctctgaataggggagtggtggccttagcctcccccacccaaatttgtactttgtccttaaaggctgcagtctgttctcctctgcccccctggatctgagctttagtctctgcagtgaccacctgacagctccctgaggggggtttgaggcaagaacccacagaagcaatttcttgctttcctctgctctctaggaattcctggacaatggagagtgccccaggccccctgaacatcttgctgatgagggagtaaagccaccctgggtgggtgtgagtgcgcgcgcgcgcgcctatctcctcagctggcccggcccgacctctgaggaggctctcaccagcagctggctagattcctggttatttttagttacagatccagccccaccatcaccaccagagttgagtccaaatccaacactctaggccgggtagtgctgggactttgccagcctcctgctgaggtagggctgggtgagtaggcaggctggaacgggtggggtggccgtgtgctgtctgaaccctccccagagctggtcgcttttggtcatttcctgccctgcagacttgctcttcctccacacaggtctgggggagtttgtgggaagccaggagccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttccctttttatttatttttatttattttttattttttgccaccctcactggccactaagagatagccctagctcctcctctcctgcctggttttgacaggactcactccattgagtcctgtctcgtctctttgcagccctcctcctcccccccccccttcagccagcacttaggccctccctgatttagcccgttaccttgacaaccacttgggcctgtctccctcatcaccactgaaaacctgaaggtggttttccagctgcggtacatttgcccaagttgggcacccctccagcttctattggctcgccctctatacagctgtacccaatataacaaacacaaccttcctggcccctcagctgtagtctcgaaattgatctcactggtcccgggaactccgtcaatactgcctcctctagactgagctcctcacaggcaggaacatggttgtttctcaataaacaagttgcaaaaaaaggaatgagtgagttgctgaacatttgtctatgggcggttgatccagtgacaagaggggcttctccctaacagctggagattggttcaggtttccacccaccctgttgtctttgcgttttcacgggcggtcgctgctgtcctctggtggtggagccgtgtattgcgtctcctggcgcaatgggggaggaggcggggaaacaaggagtgaggttggtagttactccacagagtaaaattttcttgatgtttgctgagaacttgaaaatcaagactccccattgtgaggcccaggacaagagctttgccaacactgctttgaagaaatgaactcctctagtagaattatattcaccctcaggatctgcctactgctggcagtctcctggggtcctaccgcttgaccactggcctgattttggaggtggactcgcggcacacagtaacaggaaaagcatgggtcgcagtgatatgagccagctgtactgctagtagttctgggagtactagcaatttgaatggggatgagagtggagctcctggggtgaaagaccggacaccagaacacttattggtagcgacaaggattatccgtttccaaagtttacggaaggtccagatattctcaactagggctctcggcttgtcacatttgcgacttgtcatgtttggggtcgcccttccgagccgagtatcttgagtccgccctgaaaacaggctgctgacggaaggcattcgccggcagggggcgccatggctccacagtacgggccaacggtaatgggtgggcagggtaggtgggcagaattcctgcatttgcacaccggctaaggccagggtcagactatgtggacacacacaacccaccttttggcatcttctccgaacgaccgcggctacaacctgtgggaagataagctgtagcagcaagggctggatgcgaacccgggtgctaggatacagcccgccaatcaacgttttctctgtgggggtgggaccggccaatcaaagggtccttgctagaaggcggagcttgccaactaaaggctgtctctgtgaagaggcagaaaccacgaatctactaagcagggggtgggggtgcactgcgcttgcggttcagcatccatttcttcaggttcttcatttcccctgggactgcaagacaaatacccggggtccccggaccatagccgaggagaattaagacagggtggtgaacctgggaggctgcctggcagaggtggcgccagctgcccgtgggtggagcctcgtagccctgccctgtaaccccgcccctgccctgtcgctctactgggctctagccagcgcgcagcatccagcgctgcgggctccgggctatggacgccccgggtgctccggccccagccgccgcccccagctcggcgaggaaggagctgaagatagtgatcgtaggtgacggcggctgcggcaagacgtccctgctaatggtgtactgccaaggctcatttcccgaggtaaggcccgcttggtggcaggaggggtgaggatgggcttgggaccgcagggaacaagggctttaccccaacctggacccaggccccaagcctggaccatggagtctcagctgtctcctccaggcagccctttgagaattcctgagcccagtggtttgccaggttcgagctggttggagtgagggtgttagacagtcgtggggggagggatatgtctgggatggttagctcacctttgcaccccttaaaagatcaacccgacccccccccctctctcgcagcactacgccccgtcggtgtttgagaagtacacggctagtgtgacagtgggtaacaaggaggtgaccctgaacctctacgacacggctggtgagtgcaccagagcacacaggctccctgtggtcattcccaaggtttcccctgccttctggggcatttccttcatgacaccctaacaggccaggtccctgcaggatgctggctggctgggaggctctggaagccaaaaggaccctggccatctcagctttaagtggaggtgatagattgaggtgaactctggacccccttccccagcatcccccaccccccagcgctaagtaccattcgttccctagctatgttcctctcctgtggttctaggaaacgtgggctgtacttctacctcccagggctgcagaattcgttccttactgtgtgtggtctttgctttgagtcccctgggggcttggattccaattagctgtgttccccagccctataattttagtttagtgagatctggatcagggctgtgactcctggatgctgcgtatggctgggcaggtctatgtgttgggacccccgaggtcctgtgtgaatgtatctctcttcctgtgcccctggattctgggatcctagagctccagtctattctgtggtttcttggtcttgggctgtgaagaaacagacgatttgcgctaaggctctaaagtctggccaggcagtggtggcacgagcacgcctttagtcccagcacttgggaggcagaggcaggtggatttctgagtttgaggccagcctggtctacagagtgagttccaggacagccagggctgcacagagaaaccctgtttcaggggtgggggtggggggaagactctaaagtctggatcaaaataaggcactctctgctactgccagcacctccgagagggaacttctgctcatagtccacaaacgcagtggttccctttgggatgtcatcagcctttgcagggtaaaggttgggccaggtggagcctcacccatctctgtgactcagtgtttagtgacgggtggaaccacgtcattgagtgccccttccctgctagtccacccctgcatgtgtgacagtcgctgatcttagttggaccccaaacccaggcactctctccacccttctggagaagatcaggagggggaggtcaccacctcaggtctttatctcattctagtaatgggcaggttctattggagagacacccaacacctctgagtgaccagtggaggctccccgcccatctcttccaaccccaggtatatgaggaaggaattcctgaggtgtggcttagatagcagtaagtctgtctggaaaacccactttcacatgcctcttattaggaaccaaggaggggcagaaccattgaccgcactttgaggcacgttctggctgaacagtcattgcataccgccccacaggagaggccaggaagtctgtttttccctccctctgccatcagtctttcttctcacatcccagagttccctgttcaggaaagcccccaccccctgcaccccacctaccccccagcaccagaccagagcagagaccattttgggcatttcttggaacaaaaaaagatgctcagtagacatgttgggcagcggtgtcctgtgagggtgagggctcagagagctgctaccaggtggaaggatgagtttgtcccaggaggctgtggagagatggagggagagcccagtggccgtcatcaggaggttgtgaggattgcttggtgtaatgatcttgtctatgactttctgcttcgtgtgtggaaacagaccgagagagactctgacttgagttcactggttgtgccactgaaggcttctgagcctcattttcatctttcctcagagctaagagtcaagggaattaaatcaaattccatacacacagcagcgcagggactggctcttgggctgctcagcatataccgttctttagacttctttgttttgtgctagggctggaaatcaggctcttatgcataactaaggtctaccctgagctacatccccaggccctccatctgagtgagtctgtctgtctgagacagggtctctgttcctcttcctagcctcaaaacatcctgagtagcccaccctgccctctgatgctacctcagcctcctgaggtatgcaccaccacacatggctctggccccatctctttctgcaggaaatctagacgggccacacacacttttctgatggagaatctagatgggccctcaagaatgtccctcggtgactagggaaattctaatggcaggaggaaattccctggccagagagcagtgtgcttgtgaggctgggtcattcctctcgtgtgtgcacagggtttgtccggaggaggctctagaagattctgtggaataaatgaattcatcattggcgagatgagtcagctctacctgtggctgcctcttgggctaatgtgggggaaaatgacggtcagtaactgtctagactagagaaaaggggaggcttaagggggtgagatcaatgactgagttagagatgaatctagaaagtgccatagaaagttctagaactggggagagcagcctgcctttccagtcagctgtgatcagaattacgggacaggaatgaccccccaaagttgaattttcttctaaacccaaaacggaacgctaggtccatgcccacagggcccatatggaaggcccctgtggctacttgtccccatcctgcggaagtagtcagagtcaccccagccctttactgagcactgggtgctcaagaggtagagggggtggggccacagcactcacagctccagtagcctcccctgagccctgacatcttcagacaggaagctgtggtgaggctggggaggttcctgggcagaggggtggtgtcatggtggggttgtttggacaccatccaaaggctctcatctagtaccggagggacacagaggtttggggagctatgtgcaagagaatcagtaggagaaaagtgtgtgtggcaggttgggaggggggcgtcaggagctgctaagacaagggatcaggacaagacaggggctgtggatcctggagtaagtcaagtcagggaccatgggctaaggtcaggctgggacttccccgactcttcctgtccccagggagaaaagggggtgggagtgggctagctgagcgactcaactcagcagcttccccttctcatgctgccaccacccttctctaagcaatgctttagtcaaaacagctcacctcccgcagtgtaaatgcccctcctacagatctggggagcactgctcgccagtcttcaactcagctctgggacttaggagccctgtcccggaaaaggaacccagctgtcaaggggacgcccccacttcacagaggaaatgtgtcgggtggagtgacagcctcacttccacctgccccacagacttcgagacttgagagctcaggcccacagcctccttccttactagaaccaagggcatgctggcagccttctgtgacttttcatctttaatagaccaacctagtgggttagaatcgcacccaagtcattaacctgtgcccagccccaaagtctttttggtttacaaatcaacatatacctcaaatccacactctcccagatgaagaaatggaggcttaggaagaaaagactcaggcccctggttgtgcacctcagtagggcagcagtaactaactaaattccttgtcttttgtttgtttttttaattatttattttatgtacgtgactacactccacctgtcccattacagaaggttgtgagccaccatgtgattgctgggatttgaactcaggacctctggatgagttgtcagttctcttaactgctgagccatctctctagtccttgttttgttgtttgtttgtttgtttgtttgtttgagacagggtttctctgtgtgtagctctggctgtcctggaactcaatctgtagatcagactggccttgaattcaaagattggctgcctctgcctcctctgcctctctgcctctgcccagctcaaattccttatcttattccttattcagtgtaggacccacactgaatcctacgaaaaatcaggccaggcagaatcaagcccgagaagcaaatagtgtctaagccagttccccgtttcctccccggtgctcccaatttcatgagacagctgtttgtgcctctgttttccccagcaaccttgttaggactggggtgttgtcctaatttagtatactgttgctgtaacaaaaacagttatcaaaagcaactttgtggggagaaagggcttctttgatttatagcccatctttgagaagccaatgcaggcactccagacagaaactagctcggtgtggcgacccccaccagaacattgtttcattactacttcataactatgattttgctactgttaggaatcgtatgtaactgttaggaatcgtaacgtagatatccgacacgcaggatatctgatctttgtgaaaaggttggttagccctcaggggggtcgcaacacaggttgtgaaacactgaccgagaggcaggcactgaagcagagagctcagaggagagctacttacaggtttccttagctacctttcttacctaacccaggaccaccgctcaggggtggcaccacccaaagtgtgtttatcccacctccacagttagcaatcaagataacgcaccgcaccccagacatgcctgcgggcccatctgatgcagacaagtgacaattgaggttctttcttctcagatgtgtcaagttgacaacctagattagctgttgttactggtgcttagaatgaagctttctccctgccttctgggggtaggctgaacaaaacaaaacaaaataaaacaaaacaaaacaccttttatgacagagtctgtctagctgtgagggataaggcatttccattgtctgcgtcttggtttctcgggctaggcgacagtgagggcctaacttgtatggttgttgtgcagagtggtaaatttgcctgataaattgtgtgtgtggagacagctcagtggtgtggagtgtatacttcatttgcagatgacctgagcctgttcacagcacacatgccaaatgtaagtccggatttgggagagctagtactcccatgggcacccactttctcaagttcatagatcactttattgatgcacgaatttatataaaattaaaaatttttattttttatttttttctgaggcagggtttctctgtgtagccctggccgacctggaacttactttgtagaccaggctggccaggaactcagaaatccgactgcttctgcctgcctctgcctgcctctgcctccctagtgctgagattaaaggcgtgcgccaccacacccggcttaaattttattttaaaaagcattttgaacaagttaggcattcacagatgaatattactatctgtccacatctctgtaattgccaagtctcccctgctcttacagctccatttcacagataagaaaactgaatgtggggttcagtcctagtggggaggcctttgtggacacgctgggtgctttttagaacagctggggcaggcagccgacattggcaggggggacgaagctatttggtactgcagttttacagagtgcccaactgtgaccttgacagacttgctctcctgagtcacctcgtgggtgctgcttgaattagcacagatcaggaagcggaaaaccaacgccaaagggctctgtgggcaccgggctggacttagctttttccatttggtcgctgaatttctactgtgctcacctcacttccaagacatgcgcaacgaccccctccctgggaaggaaacaaaagtcgtcaggacactgtgccatcagataataagatgtatcctaaggcaaagcaaaggagaacctttgtaatgggacagacggacacaccaagaggccattggttcagggtggtcaagaaaggtttcctggaggtggtgacatttatgcttaggtaaggagggagagagaaccagccagctgcaacctgtcgggagaaccttctggaagagagaccagcaacagcagagtgtgtgaacgaacactcttcagcccactgtgggtcaacttcctcctacctacagcaacctgactccgcccacttccacccagctcgctcgctctctctctctctctctctctctttaatgcagtagtggagttgtatgtagttactctgtcccacacacatctcagccctcatctctgctgctgccacttgaaccaaagcaagccatcgattagccactacttcctgactgggcggggggtggggctggggtggggggcgtggggtagggattcttaaaggatacaagtggtaaacagtgtgccctgtttacctgcgagactatggaacctgtgtggaacaagcaggaggagacacacttggaagagcagggacgacctatcagtagcatgcagagaaagcaccagccaatacctggacctcattttacaactggagatggtagtctctagacgagtggttctcagcctgggtcgtgaccccttttgggtcctgaagtgttccttttataacaggggtcacaccagatatcctgcatatcagatatttacactgtgactcataacagtatcaaaattacagttatgaagttgcagtggaaatatatttagagttgggggttaccacagtatgaggaactgtgttgaagggccgcagcattagggaggttgagaaccactgcgctaggtaaatttttggaagagagtgtgtttgttacaccggacatcactcctacctgcacctacaactttagacggctagagcctatttttacccaatatagaataagagctgttaatttgtattaattccacttagaatgggggtggtttggagttggctcctcgatctgtggctgtgggtaacttgcttatcttctgtaaactgagcccttagtgtaggaaatctgagcacagttattccttggtacccgcacccccattgatagtaaaatcccttggagactcaaatttaatccttacaccatcctcagtagctcaacatctttttttttttttttttttttttttggtttttcaagacagggtttctctatgtagccctagctgtcctagaactcactctgtagaccaggctggcctcaaactcagaaatctacctgcctctgcttcccaagtgctgggattaaaggcgtgcgccaccatgcctggtccacatctttacctcatatctttaccctgggctacttgtgatacagtatcagtgctgtgcaaacccttgccatctggactatttagggaaaggtgacaagaagtctgcatttgttcagtggccgtaagtttctttctgaatgctggtacctgaccttgtttctgtgcttacaggatccaaagacactagggggactgtgtttatattttccctttcatattgagttgtttgtttgttttttgtttgtttgtttttcgagacagtgtttctttgtgtagccctggctgtcctggaactcactttgaagaccaggctggcctcgaactcagaaatccacctgcctctgcctcctgagtgctgggattaaaggcgtcatattgagttgtaattaagtgcatatattggggggggggggtttagggttgagacagggtttctctgtgtagccctggctttcctggaactcactttgaagaccaggctggcctcgaactcagaaatccacctgcctctgcctctgcctcctgagggcatctttttttaaagacttatttttatgtatatgtttacctgtgtgtatgtatgtgcagtacatgtgtgacaggtgcttatcggaggtcagaagagggaatcaggttctctggagctacagatgactgagccacgtgaggcctgggtacagaacttgggttctctttgcgagtggggaatactttttaagtaagtacactgtagctgtcttcagacactttttcttctcgatccagccccagaagactccagaagagggcatcagatctcattacagatctcatcatgtggttgctgggatttgaactcacgaccttccgaagagcagtcagcgcttttgaccgctgaaccacctcttctgtccctggcacacacctttaatcccagcactcaggaggcagaggcaggcagatctctatgagttggaggccagtttaatctaaatagttagacctaggacaaccaagactatatgagatcttgtctttaaaaaaaaaaaaaaaaaagaaatcaatcaatcaatcaatcaatcaatcactggtagtttggagaggatggcatgggagcagggccactaacaagcaatacacagatccaagctgtccatgaggctctctgcaatgacagccaccagcctggagtgacaattatttgaaaggtagccagctagtacactcaaggacctcaaggttttcttgttaactggtgacattcagatagtcacatagggctggaagctgcccctgtgggatacacaggcttagaaggacattgacagaggtctgaagagaagactttttgggtcctatatgggataacatcctgagtcagggcctcactgtcccacaaagggtctcctggttgtagtgaggagggagactgcagtggaggccacttctcctgtcttgaagggtcttgggcaaaagtacagcatatgtcattttcctggctcagctgtcacgtgacgacatgatggcccatgtatacttagataaattacacattagagggattctggctggtggcaccccacagggcagcttttattgtccatgtcccacattgggtgggctggtatgtgccagcacttggaagttggaggcagatgggtctggagttctagaccagcctggaatatgtgaaacatatctcaaaaaaccaaacaaacagggctggcaagatggctcagtgggtaagagcactgactgctcttccaaaggtcctgagttcaaatcccagcaaccacttggtggctcacaactacccacaatgagacctgataccctcttctggtgtgtgtgaagtcagctacagtgtacttatgtataataataaataaatctttaaaaaaccaaccaaccaaacaaacaaacaaaaaaacaaagctaggcagtggtggcccacacccagcgctcaggaggcagaggtagatagatctgtgtgtttgaggccagccagagcaagcgagtttgaggagagccaggactacacaaaagaaacctgcatgaaatccctaaaatacacacatgtgtgcacgcatgcacgcatgcacgggtggcacatgcctttaatcccagcacttcagggacagagggaagagttagaggccagccaaagcgtacatagtgagaccattttaaaaaacaacaataaaaacaaacaaaaaacccacaaagggctggagaagatgggctcagtggttaagagcacttgctgctcctccagagaacctgggttcaattcccagcacccacacgacagctcgcacctgtcactccaatccaggggatctgatgccctcttctggcctctgctggcactgcatgtacgtgatgcatagacatacatttaagcaaaacactcattcacacacaaaagcagccagtgtttttaacagctgagccattttaccagtcctataaaaaattttttaaattagttaattaaaaattattttttgtcatctgaagacagggtttctttgtgtagtcctggctgttttggaactagctctgtagaccaggctgccctccaactcacagagatccacctgtctctgcttcctgagtgctgggactaaagtcttgcaccaactaccacctgctttcatacatacgaaataaatcaactttaaaagttaggtgctagccggccgtgatggcgcaggcctttaatcccagcacttgggaggaagaggcaggcaaattttctgagttcaaggccagcctggtctacaaagtgagttcctttctgagttcaattcccagcaaccacatggtggctcacaaccacctgtaatggg

SEQ ID NO: 110 - DNA, 262 bp, Mus musculus
ccagcgcgcagcatccagcgctgcgggctccgggctatggacgccccgggtgctccggccccagccgccgcccccagctcggcgaggaaggagctgaagatagtgatcgtaggtgacggcggctgcggcaagacgtccctgctaatggtgtactgccaaggctcatttcccgagcactacgccccgtcggtgtttgagaagtacacggctagtgtgacagtgggtaacaaggaggtgaccctgaacctctacgacacggctg

SEQ ID NO: 111 - protein, 88 aa, Mus musculus
  VARIANT (1)...(88): Xaa = Any Amino Acid
PARSIQRCGLRAMDAPGAPAPAAAPSSARKELKIVIVGDGGCGKTSLLMVYCQGSFPEHYAPSVFEKYTASVTVGNKEVTLNLYDTAX

SEQ ID NO: 112 - DNA, 45864 bp, Homo sapiens
  misc_feature (1)...(45864): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatctatttcatgttatatctgaaatagacatgatatgctttctcttagttttctaaaaaatatgtttaaacccttttctggtttagaatttactgtagtttggagtataagatttgtccaggtaaattcccaacatccttatcaaggagtcatcagatagtttccgtctttgaagcctgggttgtctttgaatttagagcaaagaatggttggagtttttccaaagttgccagcaaaaagcatgcgtttaagaggtcagacttggcttctggtcccatctttgcctgtagctagatgtgtgatcctgagcacacttaactcttctgggaggcactttgtcaatgtaaattgagaaagtacataaagtgaccttgaagggcccttctagctcaaaaactttatagcaaatgatggactcttttttttttttttttgagacgaggtgtcactctgttgcctaggctgaagtgcagtggcaggacctctgctcactgcaacctccacctcccaggttcaagcaattctgcctcagcctccagagttgctggtattacaggtgcctgccaccaagccttgctaattttttgtatttttagtagagacagggtttcaccatgttggtcaggctggtctcaaactcctgacctcaggtgatccgcctgcctgggcctcgcaaagtgcagggattacaggcatgaggtactgtgctctgccgggactcattattaagttcagaatttctagatcttagtgagactccgttcaagcaaaaccatactatgatacaacggttaacaagatgagaacctggcaaacttttaaatttttatttatttacttattattttttagagccggtgtctctctctcttgtccaggatggcctgcagttcctgaggtcaagtgatcctctggcctcagcctcccaagtagtgagaactatgggtatgtgccatcacgcttggctaaccaaccccctgcttaacctgagtttgcaaatgtcaaagttggagataggtcataaaatcgactcactggtagattttacagactgaatcttgctgtgttgcccaggctggtctataaaacttgggctcaagtgatcctcccatttgagcctcccaaagtgctggtattacaggtgtgagccatttcccccagccctgcaaataaacctattttctttttaaattactcagtctcaagtgttcctttatagcaacaccaatggactaagacgtatatgaatgtagatttactgtataagaatgaacttgttttggaaggtctgtctttttattggaagaatcgtaattctggtgagcatcatgctggactggggataggagagttggcagctcttctttcatcactgcctcactgagcctcaggcaagacagctcaccttcccaagccatgaaaagaagaaaaccctttctcctttctgcctgctaaggagggttattggagaaaaagcctgtaaagtgctccaacttcagagaaatatcaattggccctgtgttatttgtctcactctctggaaaccactttatttatttatttatttattttattttgtttttcgagacagtcttgctctgtggcccaggctggagtgcagtggtatgatctcagctcactacaacctctgcctcccgggttcaagcaattctgcctcagcctcccgagtagctgggattacatgtgcccaccaccgcacccagctaatttttgtatttttagtagagatggggtttcaccatcttggccaggctggtctcgaactcctgacctcgtgatctgcccgccttggcctctcaaagtgctgggattacaggcatgagccaccatgcctggccttttttttttttaatttatttatttgacacagagtctcgttctgtcacccaggctggagtgcagtggcatgatctcggctcactgcaaccttcgcctcctggattcaagtgattgtcatgcctcaacctcctgggtagctgggattacaggcacgcaccaccatgccagcctaatttttgtatttgtagtagagacagggtttcaccatgttggccaggctggtctcaaactcctgaactcaagtgatctgcccgcctcagcctccaaagtgttgggacataggcatgagctaccgtgcctggcctgggaaccacagaaagttctgtttctgtttcactttcaggattcttcagctatttggcaaagttgaagacataagttcccggttcacaaccattttctccattttacagagggagagacgtaaggcagaagaagattacatgtacgagttgacagcataattcactggcagaattccaaaaagatgctatcagtccaaaagaaaatgattctggggagccatctgttctccagctgcagagatgtttctctaaagtgcaataagtattgttgaaaccatctttactgtagcggaagtcaatcacagtctggattcagatgggagctggtttaagcattcagatgaagagatacttcgtcatttctaccagtgagtcaactttatgacctatctacaactttggcatttgcaaactcaggttaagcagggatggttagagagtttatttgatcttttaaattataaaacttatgcaatgagtccaaaaaagatggattaccttgagtaggtaaaatagttatatttgttaaattgaccaaggataaataaaaacatagcaaaccagatccaattctcaaatattttgatctggctcatatctaggcaaccagagttgggcactcgtctaatgatgatgcagttgagcttagatgggagagtggtggggcatgggtagagaggtacacgtgctggagatgagacacgaatggcagaatgtagagaactgttaaaactgggtgatgggtatgtgagggttcattgtattattctatttactttaaatatgtttgacattttccagaataagaaatggcttaatacagcaagttgctaaccaacttttaaaaaggcatattatctgccttctatgacttgttatcattgggtgattccattgttaggataataataaagccttctaccctattgtcttttttttttttttttttttttttgagacagagtcttgctctgtcacccaggctggagtgcagtggcaccatctcggctcactgcaagctccgcctcccgggttcacgccattctcctgcctcagcctcccaagtagctgggactacaggcgcccaccaccacaccctgctaatttttttgtatttttagtagagatggggtttcaccatgttagccaggatggtctcgatctcctgacctcatgatccaccagtctcggcctcccaaagtgctgggattacaggcgtgagccaccgcacccggccaaatactctttttttttttttttttttgaggagtcttgctctgtcgcccaggctggagtgcagtggcgtgatctcggcttactgcaagctccgcctcctgggttcacaccattctcctgcctcagcctcctgggtagctgggactacaggtgcctgccaccacacccagccaatttctttttcgatttttagtggagacagggtttcaccgtgttagccaggatggtctcgatctgacctcgtgatccactcgccttggcctcccaaagtgctaggattacaggcgtgagccactgcgcctggcctgttgtcttttaagtacacatcatgttgaaaaagattattcagtaacttacaaaaatttaattattattattttttgaaacagggtctcactttctcactcaagtaggaatgcagtggtgcaaacacggttaactgcagtctcaacctccagagctcaggtgatcctccaacctgagtctctggagtagctgggactacaggctcctgtcaccatgcccagttaattttttgtgttttttgtagagcccaggctgatctcgaactcctcggctcaagttacctgcctgccttggcctctcaagtcatgagttacagacatgagccactgcacctggacttattagttttttttgagacaaggtcttgttttatcgtccaggttggagtgcggtgacacaatcacggctcactgcagtctcacattcctgggctcaagtaatcctcctgtctcagcctcctgagtagctgggaccacagccgtgcaccaccacacctggctaattttttattttttgtagagacagggtttcactatgttgcccaggctggtgtccaactcctgggctcaagctgttaccgaatggaaagtcttgattgtgagttgtccaggttcttggcacgttgaacaaagaattgaacaaaatgcacaaagcaacaaaagaatgaagcaacaaaagcacagatttattgaaatgaaagtacactccacagagtgggagcggactcaagcaagcagctcaagagccccagctgcaatgttgtttagggtttttattaaactaaaagaattttgcaacatccctaggtaccctttagaggcttccaattgcttacatcctatgccaatgaaggatttgcccacaaccaatcaaaggctgaagtgaaggcttggccctctaccaattagaggcatttactgtttgtgacctaagggagaggggattttgtagagggaggagcctctggccccttatcacttgggcatggagaggtggggttttccttctggtccagttccaagaagtctgctgcaggttggccttaggctccctgtctccagaccctgttctcctgcctgaaagtggtggtcccacttcggcctcccaaagtgctgggattataggtgtgagagaccgtgcccaacctaattgtgtatttgagatagggtcttactctgtcacctaggctggagtgcagtgacacaatcatggctcactatagccgtgacctcccaggcccacatgatcctcccacctcagcctcccaagtagctgggaccacaggtgcgtgccaccatacccagctaatttttgtgtgtgtgttttgcagagatggggtctccctatgttgcctaggctggtctcagactcctgggctcggcgaaccccctactgggcctctcaaggtgctgggattacaggagtgagctaccatgccaggcctcaaaaatttagatagtggaacttttgcttcttcttgacattgagagaggtttgaaattatttgactttcagcacattgtgaattcaataaaataattttttgaggtgctaaaaagaaacaactcagaaaatggccccactacatcctaaggatccaatgcatcctcaattgcattgagttgcaataaattatcccatgtgtcttggcattcctactttttgtctctgaaatacaaagtattaggttgttatgatcataacttaacagacaaaaatttcctgaaccacaattgatacaattagtacacaattgaaagaggagggtcattggccgggcatgctggctcacgcctgtaatcccaggactctgggaggctgagactggcggatcacgaggtcaggagatcgagaccatcctggctaacacagtgaaaccctgtctctactaaaaatacaaaaaattagcctggcgtggtggtgggcgcctgtagtcccagctacccaggaggctgaggcaggagaatggcgtgaaccccggaggtggagcttgcagtgagctgagattgcatcactgcactccagcctgggcgacagagcaagactccatctcaaaaaaaaaaaaaaaaaaaaaaaaagagggtcattatataaaatttgaaacaaagaaaaaactatgatcacaaaatgcatctctttcattgaaaaaagagtgatatttaagcacaaatctctctcaacttcagaaggtcccaacttcaggtaggtaggcattgtaaactcatgtgtaacctatttactcccttatgttttttttttttaaatcattttccttctccaccttccagaaaaaaaagtattcactcaaacttttattgatgggtgggtgtggtggctcatgcctgtaatcccaacactttgggaggctgaggcagggggatctcttgaggctaggacttggagaccagcctgggcaaaatggtgaaacccctctactaaaaatacaaaaattagctgggcatggtggtgcacacctgtaaccccagctactactcgggaggctgagtcatgagaatcacttgaacctgggaggtagaggttgcaatgagccaagatcgcgtcactgcactctagcctaggcgacagagcgagactccgtctcaaaaaaaaaaaaaaaaatacaattcagctgggcacggtggctcacgcctgtaatcccaacactttgggaggccaaagtgggcagatcacttgaggtcaggagtttgagaccagcctggccaacatggtgaaacctcatctctcctaaaaataaaaaagttacccggatgtgtggcatgcacctgtcatcccagatactcgggaggctgaggtagaagaatcacttgaacctgagaggcagagcttgcagtgagcagagattgtaccaccgcactccagcctgggtgacagagggagactctctcaaaaacaacagcaacaacaaaaaaccaaacacaatttactgggagcttgcttatgctaggtacagatctgtgtgctggggacaaaataagacaagtcttcccaagtattgcactgttttaaattttcccctgatacttaagtttctccctagcctttgttgttttcattgtccttctgtggccactttccagctgcattaactcttctttttgtgttcctcaatattaacagctttattgagatataattcacataccatataatacacccgtttaaattatacaatttagtagtttttagtatactcacagagctgtacaaccattcacatagctaattttagaacgttttcttttcctttttttttttttttttttgagcagggtctcgctttgtcacccaggctggagtacagtggctcactgcagcctcgacctcctgggcacaagtgatcctcctacctcagcctcccgagtagctgggactacaggtgtgcaccacgatacccagttaatttttgtttttatgttttgtagagatgggatctccttatgttgcccaggctggtctcgaactcccgggttcaggtgatcctcccgtctcagcctcccaaagtgctcagattacagccatgagcaatcacacccggcctagaatgttttgttttgttttgttttgttttttgagacagagtcttggctctgtcacccaggctggagtgcagtggcgtgatctcggctcactacaagctctgcctcccgggttcacgccattctcctgcctcagcctcccaaatagctgggactacaggcgcccgccaccgcgcccggctaattttttgtattttttagtagagatggggcttcaccggtgtctggatctcctgacctcgtgatccgcctgccttggcctcccaaagtgctgnnnnnnnnnnnnnnnnnnnncaggcgtgagccaccggcgcccagccttcctagaatgttttcattaccccaaaagaaacctgtgtctagtagcagtcactccatttcccccctcctccttcagagaccttaatcactactctactttctatctctatggattggcttattttggacatttcctgtaaatggaatcatacaatatataatctttttgtatctagcttttttcacttagcattattattttctttttcttttcttttcttttttttttttttttttttttgagacagggccttgctctgtcgctcaggctggagtgcagtggcgcaattttggctcaccgcagcctcaacctcctgggttcaagagattctcccacctctggctcccgagtagctgggattacaggcgtgcgtcgccacatccggctattttttttttttttttttttttgtatttttagtagagatagggtttcaccacgttggccaggctggtctcgaacacctgacctcatgtgatccgcccgcctccgcctcctgaagccttaggactacaggagtgagtcactgtactcagccagccgcatgatgttttcaaggttcatccatgttgcagtatgtatcagtacttcattccttttttggtctaataatattccactgcatagagagaccacatttcctttaaccatttctcagataatggacatttgggttgtttttactttttgactattatgaataatgctgctaagaaccattagcatgtacgtttttctgtggacctaggttttcatttctctcgggtatacacctaggagtggaatttctgggtcttatggtaactctgtatgttttaacatttttgggccgggcgcggtggctcacgcctgtaatcccagcactttgggaggccgaggtgggcggatcacgaggtcaggagatcgagaccatcctggctaacacggtgaaacccgtctctactaaaaatacaaaaaactagccgggcgcggtggcgggcgcctgtagtcccagctacttgggaggctgaggcaggagaatggcgtgaacccaggagacggagcttgcagtgagcagaaatcgcgccattgcactccagcctgggcgacagagcgagactccgtctcaaaaaaaaaaaaatttttttttttaagaattgtcaggcattttcatagcagctgcatcattttacattcccaccattcatgtatgaagattccaaattctccacatcctcaccatctattttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattgagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgacttttttatgtttaaaatcttaaatactggttaagttagaggtgagattaaaaagtgtaggaaaatcggctgggcccggtggctaatctcagcactttggaaggccgaggtgggcggctcacctgaggccaggagttctagaccagcctggccaacacagtgaaaaccagtctctactaaaaatagaaaaaattagccgggtgtggggcgggcgcacgaagtcccagctactagggaggctgaggcaggagaatcctttgaacccgggagacggaggttgcagtgagccgagatcacactattgcactccagcctgggcaagagcaagaccttgtcaaaaataaaaaaaaggtgtaggaaaataaactgtcatccagtacagctgaagaaatcgataccttaatttacaacctcagtttctctgtccaaaggcaattccaagactcgagcaaattcttttattatgctacgattttggttattttgaatacagcttttcaaagagcccttgggatttgagagcccttggttttctaagtgttttcaataagtcttgtttttaaaggccgcgtcctagcgagtgcagctgccgctccttaccggacccacgagtgaggagccccgaggtcatcaccgagcatgaacgcgggaacgtctgggaaggaaatctgaggccctgctctgacggtcataacaaaggccttcgagccaaccggcgtgttcaaattcaccacggcccttcccgcgctcccctccccggaaacttgaccacctagcccagaaagccgcagcagcttcctcagggacgctatctcccatttcaaacacccaaccgagaaagcagcgccgcagcgcgccttccgccacgcccaggtccgcaggtcttcgctcggggcggaaaagaatcctccccgcgcactcccagccaggaggaacgccagaggccccgcccaatccctgtcgcttcattggctctggtgaccggcctcccgaaagtcggcttcctattggtcgtcgtggccgccgctctgcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtgaggggccggtggagccggacagaccctcctcgccaatcctatcctgccagggcacctgaagcgcctcctttctttccgccttagcggttacctagtcgtcatctcggagagctgcgctgaggggggtcgcttgcccggcttcaggtgccccaaccgagccagggcaggctgccggaccctctcgagctcctccagtgccacccccgtcagcgacccgagcggtggggagaagccgggcgtccctagcgttcgcgccgggtgggcccctctctgcgccgggccctgtgcgcctcctcgggggcctgaggcagagccgccagggctcgcctgagcctcggtcccttggcgcgcggcgtgccctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctggtcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttgtggcccattaaggaactagctatcgaaggaaagaattagagacaggtccagtgttgaaatttttaaacaagttctttgaaaacagacgtgtgttttgaattgaagtggaaggtactactttctaagatgaaattttagaaacaaagtttggtggcaattgaaattatagaaaagatacgtattttcagaagcaaaatatggacctgaatagacatcagcctgtgccagatgacagttataaatgatgcttttgtttttgtgaaactggatttacaccattgaggatttgggctgttaaatgtttattatttaacttaatgttgatttatattgaaattgtttaattgtgggtatgctcatctgtagatttctgggcagagactgattcctgatgtcatggaatgctaacatgtgaatgttcatgtaaggaaatacttctttctgtggaattaaaattacattaaaagctaagcaagtatacctggccgggtgcaatagctcacgcctataatcccagcactttgggaggccaaggcagatggatcacttgaggtcaggagttcgagaacagcttggccaacatagcaaaaccctgtctcgattaaaaattattttaaaaagaaaaaaaggaaaaaaaaagttaagcagttaaaaataaacaagaaaagctaagcaattatatggataagtacatgttcactcaaacctggagcagctggttttagtatatgtacggaatgggtatttactttctccctttggcgttttggtttggtttggtttggtttggtttagaaactgatgttttgaaataggtcttacctctcagactcaagtaactttttaaccttgcagtaacatccaatcaacttcctataagggattaaaaaaaaaaatccaaattggtgccctgtgttaatttgatttaatcctctttcccatttttccttatttatattgatctcaccattaattgtgctaatctgggttcttccaagctcaaaatgagatatcaaggagaaagtaatctactgaatgtaattccttttcctttttttttctctgaaaggtgggggagtggtactaaggatcaagtatactgttaaaagaaaacaaaaacccaagcatgaggaaggtaacatttgtatctatagcacatgttattgtaataatcgatcagtttggccaatgtcttgtctaaaagtattacattttagagttcatcatctgtttttgcaacctgcttaatgtccaaatggtatgagagaaataatttaggatgtagaattccttcctttgtggtatatggtcggatatttggtcactaagaaagagttaggtccctgcatattgtatttcagttgaagcagcagttttgataagaaatcctttcacattctaaggagcatatgtttctcaaatggctctaaataggataaagaggccgggcgcggtggctcacgcctgtagtcccagcactttgggaggccgaggcaggcagatcacaaggtcaggaggttgagaccatcctggctaacacagtgaaaccctgtctctactaaaaatacaaaaaattagctggatgtggtggcgggcgcctgtagtcccagctactctggaggctgaggcaggagaatggcgtgaacccgggaggcagagtttgcagtgagccaagattgcgccactgcactccagcctgggcaacagagcaagactctgtctccaaaaaaaaaaaccaaaacaaaaaaaaaaaaggataaagattttgcttttttatcaactgttttttctgctttgcttttagttatgtaggaaagtttaacctaaccaagattaaactgtaaaaccgattattttatatcaccgttgctaagatttaatacatctttttcctgtcgtttaacacaggacattgagttttagcaaactgaaggttgtccagagtttgaaacaaaccctggacatatagtgggtgagttctctgaggaagctttcattgatggaagaacagtatcgctccttggtccttgtagattcatgtagcatctgagacaattatttttgaatttaaaacttctaggttcatccttaaaataactgtgtaaataatatatttaacttagagttatggcaagcaaggtagacgcttatgagaagagtctatgggtttattattacattgctatttacctagtttaataaaaagtgaatgactgtgtagtaacatattagagttttggcaagcaagatagactcttacgagaagagtctatggcattattattaccttgctatttacctagtttaataaaaagtgaatgacttagatcatttagttttctgtttcttttttttttttttgagatggaatctcactctgtcgccaggctggagtgcagtggcacgatctcagctcactgcaacctctgcctctcgggttcaaacagttctcctgcctcagcttcccaagtagctgccatgcccggctaattttttttttttttcttcgtatttagtagagacggagtttcacaatgttgcccaggctggtcccaaactcctgagctcaggcagtccacttgccttggcctcccaaactgctaggattacaggcttgagccatggcacctggcctagttgtctgttttcatactcataaactttcttttcccactctccccctatacttctcttgtgtctggctgtcatttaatctttttttttttttttttttttttttgagatggagtctctctttgttgcccaggctggagtgcggtggcaccatctcagcttactgcagtctccgcctcaagtgattctcctgcctcagcctcctgtgtagctgggactacagttgtgcaccaccacacccagctaattttttttggtatttttagtagagaccgggtttcaccatcttggctaggctggtcttgaactcctgacctcaagtgattctggcctcctaaagtgctgggattagaggtgtgagctactgcgcccagcctgtcatttaatcttcatggaaactaccatagcttttctgattcttcgttctagtctggctggttgataatatatttaatggaatcattaaaagtttagggttgaaaatttgtggtaaatttgtgaattctttaaattgagcattttgaagtattttctccccacagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatgatgtttcatgggcttatattgtttgactctgactgaggaacctgagagagtccttataaccttattggctggaaactgtcattcctactcttacgcagattatttaggtttgtattctttcccctcccatttgcttcctctcctttgctcctacagaggggagggggcttctaattcatttttggggagggaacagtatgggagaaacactgtcagtctctgctatgggaggaaaaagagggacttgaatattgaggagtttcagtgaaggaactgacatgcttggctcagtactttctgggaccttctcacatttgtcttcctgtagtgaagatggagttctggtctccactcaactagctggtaagctgctcttggtcagctgtatattatccagacttggctacagagctaaggttctgttctccagttgatgctatcagtaaaaacaaacattttaatttccatttgtcttcttgctttttttttctttttgagacagggtcttgctctgtcacctaggctggagtgcagtggtgcaatctctgcttaccgcaacctccgtctcccaggttcaagcagttctcctgcctcacccttctgagtagctaggattacaggcatccaccaccatacctggctaatttttgtatttttagtagagacggggtttcaccatgttgaccaggctggtctggaactcctgacctcagatgatcctcctgcctcggcctcccaaagtgctgggatcacaggcgtgagccaccgtgtccggcctctgtcttatttcttttttttttttcttgagacggagtcttgctctgttgcccaggctggagtgcagtggtgcaatctcggctcactgcaagctctgcctcccaggttcacgccattctcctgcctcagcctcctgagtagctgggactacaagtgcctgctaccacgtccagctaattttttgtatttttagtagagacggggtttcaccatgttagccaggatggtctcgatctcctgaccttgtgatctgcctgcctcggcctcccaaagtgctgggattacatgagccaccgtgcccggcctgtcttatttcttaattagctccaaattggatgtggaaaaaaggtactgttactggctccctaaaatcttggtgcactgtctttgaagaaaagaggagaactggcattggataccagaatgacatgaggatatctaggtgtctgaggcagtccaggcaggttttagaatttgatttcttattatggaatgtgtaagttgttgttgttgttgttgtttgagacagactcttgctgtgtcgcccaggctggagtgcagtggcgtgatctcagctcactgcagcctccgcctcccatttcaagtgattcttgtgcctcaacctccccagtggctgggactacaggcacttgccaccacgcctgactaattttttgtatttcagtagagatggcgtttcaccacgttgcccacgctggtctcgaactcctgagctcaagcaatccgcccacttcagcctcccaaagtgctaggattacaggcgtgagccaccgcgccgggctggtgttaagtttttaaatacgatacctggtttttaactgatataagccaggcagaccatggtcctatggtggctctactgagagcagctttggcttaagagagtgggtaggaaagggattagactatcaagaacaagtcatttatttttagtaatcactgatgactagaaaataaactccaaacacaggtgaattctctgagcttggagttttgtgctaggcataggcagacagttgcctcattctcttattctctatgttgttttaaactacattcatggtcaagagaggaaatttagctatcttcacgattatcgttcttttttaaaaatataatttcaacttttagatttgggggtacacgtacagacttgttacatgggtatattgagtgacgctaaagtttggggtacagttggtcccgccagcaggtagtgaacacagtacccaacagttagtttttcaccccttgttcctttcctccctccttccccctccccccagattattgttctttctaaactgttagaaaaagggttatacttcttacataccacttggatgcatgtggtataacccatggagttttgctgccaactaaggtccccaagtaggtcatgaaagcccagatcatggcttgcattttgaaagttccagacttttcagagatctggctttgggctttattcacggaggagtaactgtagggtttttttcccccaatgaacaaataatggatggtgacccttccataaagaaggcaccactttggaattgaggccagtgaattgactgcaaattcagaagccaaaagggtatgcctagtatactgtcagaagccagaggtgggggtatgcctagtatacaacaactcagtgaattgactgcaaatgcagaagccaaaggcatatgcctagtatacaacaactcagtgaactgactgcaaattcggaagcccaagggctacgcctagtatgctgtctttccaggaattgagttttctcaaaatctaggaggaaatggagtggtttgtagaagatgcttcaatcttactatcagtatggaagcaatgaatgaataaaagaaaaataaaggaatacaggctaatttaactggaggaagatcttaaagtatagggaagacagaaatggaacaggaaagaacatgaacttaggtctctaaagcttttaaaaggagggtgcagaagagggatccttgttggttatgaccctaccggatatggtaactgggttccaaggaaatataacagaggcagagtgtgaagagctcagaaaatagattggcatatgttccccccatcccttgtccccctctccactgtaagagctcagattcaataaacccttggggaaattgtcttttaaatagttctccaattgcttttataggttctgtcaagtcataacagaaaatgtgggccaagcgtggtagctcatgcctgtaatcccagtgatttgggaggctgaagcagaaggatcccttgagccctggagtttgagatcagcctgggcagcatatcaagaccccgtctctaaaaaaataaaaataaatggccaggtgtggtggctcacgcctgtaatcccaacactttgggaggctgaggcaggcagatcacctgaggtcaggagttcgagaccagcctggccaacatggtgaaaccccgtctctactaaaaatacaaaaaattaccagggtgtgatggcaggcacttgtaatcccagctacttgggaggctgaggcacaagaatcacttgaactcaagaggcagaggttgcagtgagccaagatcataccaccgcactccagcctgggtaacaagagtgaaactctgtctaaaaaataaaaataaaaataaaaataaataaaaactagaaaatgtgtacagatttaagaggggaaagatcagtataggacacttcaagcactgttaggtgagtgtcaaggtgacagttgtaggtagagatgcctttgccctgaggaggcatgcagaataaatttctgaaatttatgagaaagtacaggaagatgaaacatactaaaggagagccaggtagatggagtccaggcttggaaggatttatcttctggatggattcttcatcctggaggtgaagaaggacaaaaacactttgaacaatggctgcttttgatagacccagaaatcactgactttctcctcatattgggagatttcacacaagaaaacgtgcagaggagttaaggtgggaaataaaagttggggcccaaaggcaaagagcaaataaaatcaaggagagcaccaaagtccagcaaaagttacaggccaatctgtggtaaaaaggaaagggattcattgaagaatcagattgttaaaaactcaggtgaccctttctttttttttttgagatggagtcttgctcggtcacccaggctggagtgcagtggtacagtggcgtgatatctgctcactgcaacctccacctcccaggttcaaacgattctcctgcctcagcctctcgagtagcttggaccacaggcgtgcaccaccatgcccggctaatttttgtatttttagtagagacggggttttaccatgttggccaggctggtctcaaactcctgtcctcaggtgacctgctggcctcggcctcccaaactgctgggattataggcatggaccacaacacttggccaaaacttagctgaccctttcttaaaggattgggtaaaaccaaagtgggatgcaaaatactacatatcccacaacagaaaaacatgtagacaggtcttggggagtatgttgccgaggcattagttccagaactctagggccacaggcttccaaagtaaccacagccctttccactcaggaatttgtggagggtgatgtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggtgagtccaacatgcagccaaggctgaaaaccattctcttaagggcagtttcacaaccctaggcaattccttagcaagaagtactgacagcagctacgaaggtacaggactaaaacacctgtttcactgaagggcagcgggggtgggtgttacctggcacttcagtgctaaaatgaatgtaaagaaattatgttcatggccaggcgtggtggctcatacctgtaatcccagcactttgggaagccgaggcgggcggatcatctgaggtcaggagttcgagaccagcctgaccaacatggagaaaccctgcctctactaaaaatacaaaattagccgggcatggtggcagatgcctgtaatcccagctactaggaggctgaggcagcagaatcggttgaacctgggaggtagaggttgcggtgagccaagatcgtgccatcgcactccaacctgggcaacaagagcgaaactccgtctcaaaaaaaaagaaaaggaattatgttcatttcagcactgggatgccaggaaatatggggcttaaaggggagatggaaattaaaattttcaaatatgctgcatggggctggcgtggtggctcatgcctgtaatcccagctctttgggaggctgaggcaggcggattacgaggtcaggagttcgagaccagcctggacaacatggtgaaaccccgtctctactaaaaatacaaaaattagccgggtgtggtggtgggtgcctgtaatcccggctacttgggaggctgaagcaggagaattgcttgaacccgggaggcagaggttgcagtgagccgagattgcgccactgcattccatcctgggcaacagagcaagattctgtctcaaaaccaccaaaaaaaaaaaaatgctggatgggaaaaaaaaaaatacttcaaatatactagtgacaggggcttcccctgcttcaaatttctgaactttccagaaggctggagtgttgcaaatgctcctctcagagatgataactataagtggatttgcccttcaatatgatgctaaggttattctctcactgggagatcatgttctcattggaagattttgcccaaatttaagttcagagattctaatgaggctgcaacctaaatttttcaggattgcttctttaccttctattcctgtagtatttggctgacagtagttaatatgtgtctgagttgtactgaatattgggttatagcaacatttttgcctgggacactttggaggttggcttgggcttttttgttgtttgtttttgagacagggtctcactccgtcacccaggctggagtgcggtggcgtaagcatagctcaccatagtctcaacctcccaggctcaagagatccttttgcctcagcctccgagtagctgggagcacaggcacatgccaccacacctggctaattttattttttgtagagatagagtctccctatgttgcccaggctggtcttgacctggcctcaaacaatcctcccaccttggccacctaaagtgctgggattacaggtgtgagccaccattcctggcctgtttttaattttttattttataatgagggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatactctaaagaactgtggatgaatcctttacttaaaagaacattaactttattattattaattttttttgagatggagtctcgctctgtcacccaggctggagtgcagtggcgcaatcttggctcactgcaaactccgcctcctgggttcaagcgattctcctgcctcagcctcccgactagctgggactacaggcacgtgccaccatgcccaactaatctttttttttttttttttttttttttttgagatggagtcccgctctgttgcccaggctggagtacagtggcgcaatctcggctcactgcaagctctgcctcccgggttcacgccattctcccaccttagcctcccgagtagctgggactacaggtgcccgccaccacgccaggctaattttgtttttgtttttttagtagagatggggtttcaccgtgtcagccaggatggtcttgatctcctgacctcatgatctgcctgccttgtcctcccaaactgctaggattacaggggtgagccaccacgcctggcctaatttttgtgtttttagtagagatggggttttgccatgttggtcagtccagtctcgaactcctgacttcatgtgatccacccgccttggcctcccaaagtgatgagattacagatgtgagccattgtgcctggctgaacactaactttaaattaactcttagtgaatctagatgttcatgcttttttttttttttttttgagatggagtctcgctgtgtcacccaggctggagtgcagtggcgtgatctcggctcactgcaacctctgcctcctgggttcaagtaattctcctgccttagcctcccaagtagctgggattacaggtgcctgggccagctatttttgtatttttagtagagacggggtttcaccatgttggccaggctggtctcgaactcttgacctcatgatctgctcccccacctctgcctcccaaagtgctgggattacaggcatgagccattgtgcccaggctattttttttttccttcctcttttcgaggcagagtctcactctgtcacccaagctggagtgcaatggtgcgatctaggctcactgcaacctccgcctccccggttcaagcgattctcctgcctcggccttccaagtagctgggattacaggcatctgccaatacgcccagctaattttttgtatttttagtagagacggcgtttcgccatgttgtccaggctgttcttgaactcctgacctcaggagatccaccttccttggcctcccaaagtgctgggattacaggcataagccactgagcctggccagattttcatgcttttaagcacaccatggctgtagagtttgaggtatataatcatttaaaggtatggactgttataattttacctgtccttttttttttttctgagacggagttttgctcttttgcccaagctggagtgcggtggcacaatcttggttcactgcaccctccgcctcctgggttcaagcgattctcctgcctcagcctcccgagtagctgggattacagaagcctgccaccatgcccagctttttttttttttttttttttgagatggagtctcgctttgttgcccaggctggagtgcagtggtgccatctgggctcactgcaagctccgcctcccgggttcacgccattctcctgcctcagcctcccgagtagctgggactacaggccccaccagcatgcccagctaattttttgtatttttagtagagacaggtttcaccgtgttggccaggctagtcttgaactcctgatctcgtgatccacccgcctcagcctcccaaagtgctggcattacaggtgtgagccaccgcgcccggcttcacctgacttttaaaggcatcactatttcttgagaattatagggtgtgaagacttataatattgaaatccttggctttgatacttcagactgtttgaaccttgtgttgtggtttcttctttaccttctcctttctttataatacaacattacttctgggtaatagcagaaacagccattatccttctgttgcattccaaagtgccttttgcattttaaggttgagggctttttatttgctttttgttttaagagcttgctggacaaacagtccagcattttacatgctattataaaatgtttgacagaatcagataataaaataaatggaactgtattattatatgctgccattttaactaatacctcagctatctcgacttccattacctatcacattatctagattctagaatatgcttaagaattaggacaaaggcaaaagcctattcgttctaaacactatagcttttattttaagcatgggaaaatgcctttggccctcgctgaaaatttattcttttatgtatacttgggacaagcatggttatcaggtttctgagactgcagtaaaaaggagacaggttactctgggcaggtatagtgatagccctggtggctcaaagagagggaagagacaaggaaaaaaccatagaaagcaatacattagttctgggccatttagtggagtagcaaatagcccttacgccttggaaggtcatgatggttatcaactcattaaaaattatgtttagtatcttcagtttgaaaaggtaaaataaaaaaatactttcctgttgttgttgttgttttttcgagatggactctcgctctgtcgcccagcctggagtgcagtggcttgatctcggatcacaacaatctccgcctcccgaattcaagcaattctcgtgcctttggccctcgctgaaagctgggaggctgggcacggtggctcatgcctgtaatcccagcacttcgggaggccgaggtgggtggatcacctgaggtcaggagttcgagaccagccatggtcaacatggtgaaaccctgtgtctaccaaaactacaaaaaattagctgggcatggtggcggatgcctgtaatcccagctgctggggaggctgaggcaggagaatcgcttgagcccgggaggcggacgttgcagtgagccgagatcacgccattacactccagcctgggcaacaagagtgaagttccatctcaagaaaaaaaagaatttggaaagtagagaaaatttcagagaaaataaattacacataatacattaaaatctattctggtttgtctacaacttcaggtacaaaaaaatctagagagagtttcagttggtgttttgatgttttccaagtcatttaaaaaattatttacatatgctatagtatattatacccaattacaaatgcgaaaacagaggtttaaggaaatgaagtaatttaaatttatgggcctggcatagtggctcacacttgtaatctgagcacttcaggaggccaaggtaggcagatcacttgaggccacgcatctgagaccagcctggacaacatggtgaaacccaatctctactaaaaataaattagccaagtgtgtggcgtgtgcctgtaatcctagttactcgggaggctgaggcaggagaatcgcttgaacccaggaggtggaggttgcagtgagccgagattgcgccactgtactccagcctggttgacaatgagaccctgtttttaaataaataaatttattttaaataaataaataaattgatgttatttctgttaaataatagctgagaaaatctgccttagactgtagaactgtggtgcaatggccaccagcctaatgttgccaggtaaaatacagggtgcctgaaaatttgaatttcagatgaaaaacaaagaatttttagtatatgcatatcccaaatataccacaggacagacttttgtccagtctttttttttttttttttttttacatgcctgtgtacatgtatctgttttgggtgggtagggaggttttttgttctgtaaaatttggatcatgttctctttttgttaaacaagagatcatgggtattggcaatgccagatattctttggaaatagcagaaaattctttccaaatggcttgaaatttcagtgcccagaggaatatagtaatctcaaagttattgagggcaaacttacctctccagaatagcattccctgaggatcccagagagcccagattccacttagctttaaactgtgggatttgtgttcctttttaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaaggtgagttggatgaaatgttacataacaacacacatgggtcagcattcttgattgtaggttattttgaatagctattgaattttcatttctgtttataaaaatatcaaaagcttagttccattagccattttccatctagaaaaatacttaattggagggattatattactgctcaagttttatagacattgtttctcatgttcaggcatcctttctcctgaactttgacctgtttgtatcattttattttctattatgtttatttccaaaagcaagaaatttgttagtctgtagttttgttcacaaatgatttactgtaactatgattcagattcaagtttcaaaaaagtatcccgtaccttaactttcaaatgaataaatgaatgcaataaattaactactctttagagattcaacatcaaatacttagctaacagttattttcactaagatggaaagtcattcagagacccatcatattggtaggcctccttgctctctttgatctttagtttagtcttctgaaatacttaaggaaaaaaaatgttagcttgcaggaacaatgcagcgagcagaaacgaccacatcttagtgccctctttaagcttctctagtggcaaggctttgattgtgattaggctgtgtagtttacagattactgtattagtgggtcctgtattttcttggattcaccttgagagatcagttgcctttctctttccctgtcagtctgttatgctttttgtctcctgctctttaaatggaggaaattgttcatgtaggaaaagaccaggaagtgtgattctgctttctgctctgtgtggttcaagctctgttttgttaattacatgtttataccaaggggtggaaaggttttaattcattaacacaagagtgtgtttttcttaaagtcctatattagaacttctgtgaatccagactgccttggcaatgaatattttgattttcatggcttttgaaacatgaaaatacctctggaaatagtctggtgccactggggacttcactaagaactaaaattaaattttagtagaaggcagaaagaaaactcatgctttcataatggtttatatcttgctgtcatcaaatgcttttctttcttcagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacgagggggtaactaattacacccagggcccggcacgcttattcttggccgtatatggtggggcctttagtgcttgatgacttctgataaacttcaagtcatgtgctggagtgaagcttccacacccagctgaactctgcacttaaaggctgtcctgatgtatagtgtctgctgaggtgctaggtggctccaaagtctgctgtctgaagggtcccaaaatagctcatcagtctcttggccttagttaatttctctgtcttacacagttagacactaactgttgaagaaatggctgtgaaaaagtagcacatacacatttgtagtgttatgtgttagtgcacgtgtttcagtgaccacagaaaacaatcagtagtgtaagttagcctaatgcccatttgtcttgctacagtgaaattgttctaatttagttaatgaaagagccatctgaattagtgaaaaaatgtagttatttactaattgtaattaataatattgtcccagtgaggtccttggacatcctgattgaataacatgtaaaggcttgtaattaatatttacttgtacgtgagtgattctaaactgctgaaagaaatgttttgaacaaattttttcacgcttaattttcttctctgaagaagggggttattaaaagtagaggaaagctggatgcggtggtgtgagcctgcagtctgatacttggcaggctgaggcaagaggattgctttagttcaggagtacgaggctgcaggtgtaccatgattgcaactgtgaatagccactgtacccccagcctgggcaacatagcaagacttttttttttgtttggaggcagagtctcactctgttgcccaggctagagtgaagtggcgagatcttagttcactgcaacctctgccccgctgggttcaagcaattctcctgcctcagccttccgagtagctaggattacaccccagttaatttttgtatttttagtaaagatggggtttcaccatgttggtcaggctggtctcgaatacctgacctcaggttatctacctgccttggcctaagtgctaagattacaggcatgagccaaccgcgcctggccaagagtgtcttttaattagtaaatgaataaatgcagagggaaatttggtctaattgccttctagatatagtcctgtgtcctctaataatgttttggtcagtgatagaccacatacacggcagtggttctgtaagattataataccatatttttattgtaccttttttgtgtttagatatgtttagatacacaaatacttattactgtgttatagctgcctacagtattcagtacactaacgtgatgtacggcttcgtagccggccatgccctatagcctaggtgtgtagcaggctgtgccatctaggtttgtggaagtacactgtgatgttcgcacaatgacaaaatcgcctaaggacacattactcagaacgtctcctagtcgtcaagcaacacatactgtagtcgtaaattagataagtccaagccaggagttttattattctcccaaatgagaattggcatatttatgctgcaaacataaggcacagctgacttacataccccttttgggtatacaccaccatttgggtgatgtggattgttggatgctacagtatggtgcctggcaatcagggtggaatatttgaaattgggaaccgacctagcttattggagagctattgtcaaatatagtcaaaagaaaatatgtgaaggaaggtacataacccaaactgaagagatttgtgttttctaaagtgttctgattgagaaattttaaaaactagaattagcctcagccatcagtgaagtctagaaagccttcgttggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgaggcaggaggatcacttgagcccaggagtttgagaccagcctgggcaacatagagagatcccatctctaaaaaaaaaaaaaaaaaaaaaaaaaaaccaaaaaaacctggtgtggtggcaccagcctgtggtcccagctacttgggaggctgaggggggaggattgcttgagcctgcagggagccgtggtcatgccactgcactccagcctaggtgacagagcaagactgtctcaaaacaaaacaaaacagaacaaaaacttctcaactatacattgatgaaatttggcacagaaattcttcctcagctggtaacacgatcaagccacggaacatttatggacaagaaaaaataattcagttgtatttatttttttctttttaattgtaaaaaaaatatatatgtacttaatatttttaaattgagacagggtctcactatgttgcccagactagtgctgaattaggcgtgggccaccatgcctgaccctcagtggtgttcagactaacaaatcttatgttcctatctagcttaaacagccctcccatcattaacttttatcatcttgagttttgtcctttaaaagctggttataatacagcatttgttgatgaacaggtttatgcccagaatatgcacaaaatattttggcaatcctacttcaaagatgatgtcacagtggtagatgcaggaatcttcatcctcagagctttcagaggtcgtaggctgctggctgggaaatggttttctggcagtgaggggagaagtcagttgacttcataaatgtaaatagcaactatgtacagtgcacaacgataatgccattcccacccttaagtactttgcggcgtaggatataacatggttgttattatgacagcatggtttccagtgtctttctccattaactcactgcataatctaaccctagttcaatctctggcttgggtggaacacacattttgttttgagcacagctggcatctttcctagcttgactggctccaagtcactaccaagattgttcccatatccctgacaagatactggctcctctgctttcctaagttctaaagagtgggaaggaaccctccacacagaaggagagaccaaggcccactctgatttcatcttgagttgcctagtgccttctccattggcatatctgccatctcatcccatagatcctttctccccaggtccacaccagtagtcgtgggccatgaactaagaccccagatcacaagaatctctccccatgaatggcagtaaaacatttctcttaaatctagagactactgacctttcaagcttgaattcctgttctgttccaactattcatgattccctttgatctcctctgacctgtagaaagggaagcacccaaatccatagccctatggccaaatctcaggctggggttaacttttttttaacttattcatcgtctttcttattcacagactggattttctcagatgtaaaggtgggccaagagccaggacggcccatctctttcaagttagacttcagcagggccaggaacacagatggcttgagatgattctaaggctagggagggaaggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagcattttattctttacaaaaccctgaggtatagcttttatcattgccatttctagtggagagaaccaaagtgcagagaagttgggattatttcttgtacaacactggggtggcattgggcctgcaggggtcattcagcaggtggctgctcagcttcggactgggagggtggctggctgactggccatgcctgaagccgaggccttagctctctgttgcctttcagatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagcttttgtttacattgtcttggtcagttcctaaatcaagtgacctggcctagcacccctcttcagaagagatggtgggagcaccttcaaagatgtcacatgggggccgggtgcggtggctcacgcctgtaatcctaggaccttgtgaggttgaggctggaggaatgcttgagctcacaagttcaagactagcttggacaacatggcgaaaccctgtctttggaaaaaattagccaggcgtggtagtcccagctactcaggaggctgaggtaggaggatggcttgagccttgggtgtggaggttacagtgagccaagatcacaccactgaaatccaacttgggtaacagagccagaccttgtctcaaaaaaaaaaaaaaagaaaaaaaagaaaaaaacaatgccacatgagcaacagtgcttacatttcctgcttgcttatcagtaaggttaactgctgatgtgctgtttcttgtgtccaggtattgcgctaggtgctgtagttgcctctgcagtcctcaaagcaactttctgaaataaacattgctttgcttctctaacctctgagaagttagacttgtctaaaacctcatggttaaaaagtggctatgcagaatttgaacctagctctgatgccagagttgctcttaacccttccagtaccacataagaaatgagaaacttgggccaggtgtggtggctcatgcctgtaatcctagcactttgggaggctgaggcgggtggatcatgaggtcaagagttcgagaccagcctggtcaacatggtgaaactgtctcaactaaaaatacgaaaattagctgggcatggtggcgggtccctgtaatcccaactactcaggaggctgaggcaggagaatcgcctgaaactggaaggcggaggttgcagtgagccaagatcgtgccattgcactccaggctgggcgacgagcgaaactccgtctcaaaaaaaaaaaaaaaaaaagaggaacttgagctattatgcaaaaatgttgtgaaatctcttttaggtccaacttgacttgactcaggatggttgagttgagaccaactgtcatttcagtgcagctgggagtggccacttctcagagtctgttatctcctgactgtgcagtgagtaacacatatggccttgggtgctcagaatttattagtccatcaacagagctgaaaatacctgtgaacaccaggaggcagatgcccctgtgctttgggcagaaagtttgtgtggctaatagtaaagaaaaaaattttctgcttttgaagatcaaagcatgtaaatcaaggcctcccacttgtttgtctgcaaccacaattggtagtaactggcttgagcaggtcatggtttccctttagaagcagcataagttgccagagttttgtgggcacttgtgctttttgtctaaactttttttttttttttgagacagagtctcgctctgttgcccaggccggagtgcagtggcgtgatctcagctcactgcaaattccacctcctgggttcatgccattctcctgcctcagcctcccaagtagctgggactacaggcacccgccaccacgcccggctaatttttctgtatatttagtagagacggggtttcactgtgttagccaggatagtctcaatctcctgacctcatgatccacccgcctcttcctcccaaagtaatcttttgatgagactctggaaatcttaacatttcctccaaattggtaacttggtggtggcaagtctttaaatccaggccatagaagctaagcagtaggtgctggttttgtctaaacttaaattcaaaaattcagatttatacagtcttagtttaaagcagtttaatgtttactcttagatttgtgtattaagttttagtggcttctttatagaaagagtacaaaatgcttggtggattttttagatagtagtttgaagtaaccctggtttattagccagataatagaaatgtcagacaacagaaatgtttagtgtaacaggcttgatacttggaaattggcttgtttggcagagggcaagcatttccccctggaatttgaatttttaaactggcatgcctttctaccccctccccccccttttttttttaaagacagagtcttgctgttgcccacccaggcagagtacagtggcatgatcatagctcactacagtcttaacttctgggctcaagcagccctcccgcctcagcctccccaggagctggcatataatgcataccaccatgcctggataattttaaacaattttttttttttttttttttttttagacagagtcttgctctgttgcccaggctgaagttcaatggtgcaatcttggcttatcgcaacctccgcttcccaggttcaagtgattcttctgccttttcctcctgagtagctgggatcacaggtgcatactacactcccagctaattttgtatttttaatagagacagggttttaccatgttggccaggctggtctcaaactcctgacctcgggtgattcgcccgcctcggcctctcaaagtgctggggttacaggtatgagccactgcacccagccccatgctgctttaagtaaattttttaaataggtcatgtcatatggataagtctgcagtggaatacagtgaagtctctttatcccatcttcacaatatgaaaggatgtcatttgaggtgccatggtgtcttcctttgtaaacatcagattccctagaggaagggacagagcctcttttctaggttactaagctgtgatttgacacagcaaacattcccttgggtttatggtcctttcattacttcatcagacatggcgtgtaggctcagagtagttgcttgtagcatttagcctcggctggcctcatctttggctcattttaaaaataaaagaggctggggacggtggctcatccctgtaatcccagcactttaggaggctgagaccagcagatcacctgaggtcaggagttcgagaccagcctggccaacatggtgggtgaaaccctatctctactaaaaatacaaaagttaactgggcatggtggcaggcacctgtagtcccaactactggggaggctgaggcaggagaattgcttgaacctgggaggcagaggttgcagtgagctgagatcataccactgcactccagcctggacaagagcgagactctgtctcaaaataaataaaataaaataggtctgtacagagaccatggatttgtactgaagtacaatcttactggattgttcagtactcttgggagagtttatggccactgtgttatacaatggcctgtcctgaaactacagatctgctgtgtctctgctgtattgcacatccatgtggtggcttggatccccagccctggcagcccctccctagcagacctgtgtgctccaggaacccttagaggagaaacactgccttctaaccctgagccctacttcccttaactagtcccagttgcagccacaaatctgtcttggctactaatgagtgactacgggatccgttcaccagagaacaatgattaaccttaaagcaattcttaaggaagaggatgactttactggatatcagggtagctatattattaatgtttggaggtttggagaactcaggctgtcaagaaaacaaatattaccattcatgaggacactgcattttaaacaatcaatcaggcttacaaaagaaagtcacatttttataaaccatggagtgaagtggattcctgagttaaattctggggtacagtggcttcaagtgtctttagattgagtcaacaagggtctgtggatttaaattaacaggagacatgtatctagatgagatctttctcttttttttttgaaatgcggtctcgcggtcgccaggctggagtataatggcgcaatctcagctcannnnnnnnnnnnnnnnnnnngactctgcctcaaaaaaaaaaaatgtttttgttgttgaaagaataaattgtatgtgtgtatgaatgtgtgtgtgagcatgtatgtgagcatgctgtgtatacacacacacacacacacacacacacacacacgcatgcaggaaaaattctggaattatagataacagcatgttaatgattatctctgggagatacttattttcttcattttgcttatctgtattgtcttttttttttttggagatggagtctcactctgttgcctgggctggaggcaatggtgcgatcttggctcactgcaacctccgcctcatgggttcaagcaattctcctccctcagcctcccaagtagctgggattacaggcacccaccaccatgcctggctaatttttttacttttagtagagagagggtttcaccatgttggccaggctggtctcaaactcctgacctcaggtgatccctcccaaagtgctggatccactccacgtggccttgtctcattttaattaaaactgttttgccatagtaaaaataaaagggacaaatagaaaactcagccatcagcaagaaaaggcttcttccacaggggcaacatcgtacattgctcttatcaatcactgaggaaggaggttggttactttctccatcttcagattcactagagcagttgtttctgtatgtgaatatgacatcgccagcagggtcctgtctttaaaaaaaattccgtaatctaaaattacttctcactggtttctgcatctgccacttggggaagccacctcatgaccaagtgtttcctacagccaccatggcccaaggctacctgtacaggatgcagcctcctgcagttgctcccactgtctcccaaatctggcgaacttttaggcaatggtaatggcaagtagccatggaattaattctgtgtggtaagaggcacacagacagatgatgagcagctcttctccttaaagaagtctgtgtctaattcctacgcgtggccgttgtcagagtatagctctttcccgttacctttactagccagaaacagcttgcttgctttctgaagaaagagaaatgacgcaccacagggtacatcagatgaatcagaaattacattgtttggacttcaaaacagtgtttactgactctgggcttaaacttctagtccactcctagaacagaaaccctcaaagttcaagagtggttttttttgtacaattgtttatacaaattcaacaaaggtaaaatcgcatcagggaaggtctaggaaacaccaccttacaacaatggcacttataaatgcagaactttacaactaggaaatagccatgttacaaacctaaatgagaactcaactcacacttcagaggagagaagcaaaagcaaaagaaaggctatgtgggagcatttattctacgtcttgactcactgtataaattagatctatgtaagtacaagagctcatgctggagcagaacctcctgagtgcaaaggctgaagtcgaaattttaaaatttgagaaaagtgaattctctacagaggaaacttggcagagtatcttactttgactataatttacatttatccacaacatgctcatgtaactcttgaggtacaaagcagactctcaacttccagttaaacatgcttttaagtggaaggtcttagcctactttgttagatctgggcacatttgtagatgggttgtgtcgatgaagtacacgttaaattctctcctaccttaaggaaatcaggaaaattggcaatctcaaaacaataaaaacactggtatgcattcaaaccttgcataaataacttttaaacaatttgtacaaaaatagttctgcataatgtaagatgtaacaaaaccaaccaaacaaaaaaaagtgtcaagacggcagcagatgtggtgtgtggtccactttatgtcaacacccaaaacctcggtgttgcaaggaatgaagtgtccaaaacaccactaccactaacagaaactcctaagctcatgcttcagtatgagaatttctccgaagtccaccctcctctccgacaggaatgtcttcttgtaaaggccgccttagaaatggtccagaaagcagtgcagttacgattcagaaagaccaaaggaaagtgtcggctcactcatcccccaaacgggtggttgaacagcttctcccttggaaagacttgcaaaatggaattgcgttgtggtctgttgtcccacgttccaaatggaaaataaaagccctcatttttgtaaagtctctcccctcccagagcccgccccgtatttacatacttatccttggactaactcagtttttgcaggagtttttcttctacttgcccaaactggacactcacagacatctcggctatgaactgctcacagccttccttggtgacttgcttgcagtacctcaggtcaatatgacagatgtttccacagcgtttgaagaaggacaggcactgatcagtgaccttattgcagtctgcagagaagaaatagtaatgtgaggtgtgaaggccaggagccagaagcccccccgccgccagacccaggcactcagcagtggggacaggtcagagctctacatattccagtccctgctgtgctgcactaaataaaatgttatttgcttaaaatctctcttcttcaaacggggaagggtctcacccgccaggtataaaggttaatatatgcctcaaaagcattcagataaccacgtgaaaatcacttctgatttaccacacagctgcctctatacgtgcgtatgctcatgtaagtagttctatgtgcttttacaatgataggttcacacaccatgtcaagtagcttgcttttctcatctaatatgttgttgatgagtactgctctatgtctattactgtgcatttatttgcctcctcccttcagataaattcccagaggggcattgctgggtcacagaaagaacatccctaagggcatcttgggatcatttttgcttttgcaggccgcagtgctttggagcaattcacagcatgagggacagctgtttggccctaactccaggactgaccgtgtgccagcagcctagacaccagaccaacatgcccttctagcaaaagcagaattcagacttcatcacaccctcatctgcagacacaccctttgtgctttttttttttgagacagagtctcgcttttgtcacccaggctggagtgcaatggtgcactcttggctcactgcaacctccgcctcccaggtttaagtgattctcctgcctcagcctcctgagtagctggaattataggcgtgtgccaccatgtgcaactttttttttttttttttttttttttttgtagtaagtagaaactgggttccaccatgttgtccaggctggcctcaaactcctgacctcatgtgatccgcccacctcagcctcccaaagtgctgggattacaggcttgcgctactgtgcctggcctcaatggtattacatttgtgacctttgctaatcatccttagtatcaacactttcatttctttattaaattgagtgggaataaaaatacgaagggcaaaccgcaatcatgcatacaacatctgtgctatctacatgttatcaaaatccctgcaagccaggaggtggtgtaaagtagtaaagtcagagcaccacatacgccaccaaactgacttcctttatacagctagtcctttcagacagtggcctccacatcagcacagaatcttcaaacagatgctcaccaattcgtgaacctggagcagtggtgctggaaagctgtctacatacacataggcattcacaagtgaaggccctgcttttggactgaagatgggaaaacgagagatgcttcaacagataactcaggttttcatgggtttttttcttttttctttttttttttttttttggagatgatggagttttgctcttgttgcccaggctggaatgcagtggcacgacctcggcttactgcaacctccccttcccaggttcaagcgattctgcctcagcctcccaagtagctgggattacaggtgccggccaccacgcctggctaatttttttaatttttagtagagatggggtttcaccatgttagccaggctggtcttgaactcctgaactcaagtgatccatccagctcagcctcccaaagtgctgggattataggtgtgagccaccgtgcccggcaataactcagtttttcaaagggtatcccttaatcttctaattaatccctcaagtagttccccctcaaatggctgaccctctttataatcttactgcaaaatccaatgatgaaggaagttgtagaatgttatcatacaattccttcgggaaactcatgatccccaaaactcaatacttgattcattttaagtataaagaatagggattttactaatatgtttattttcatatacttttcatttttcattatttactatgacatgttgaccagttagatttgaactcctggtctcaagtgatcctccccacccagcctcccagaccactgggatataggtgttgagcctgtctgaccaggatggttttcttagaggatgtcccacattcacacttgtcatcttaaaggtgtcatttagcttgttccatctctcctgtttttcctataaactgcagatatcccagaggcttgcttagattcaggctagacattttcagcaagaaatcaccctcagaatcttccatcttgaccctgttcccagctccctatctgccttccagagcactgtctagctcatccccagaatgcgtctcattccttactcagatgcagctatgctgtccccactccatcaccagctcagggatatttttcccctgtaatgtttgcctagttcctggctagaagggactgacccaagtcctgcctctcccttgacaccttcaagcaccagagcaggcagctcccatgccagagaactctgccatctggctggcacactgctgtggcctgtagctgtcagacggctgagggggcctcaagtgcatcctggcagttacctgtcggtggtaaggcagcacttggtgtgaagtgagacctggaggcccagctggctccttttctgagttgtctttgggtactaatttgggccctctttggaggctcattcatgcccagccagcattcttcctggcttgtggttcacatattccccaaaactggagcccaaagacccttccaacaaagaagctagaaggaaaagactttctttggtccctctgtgcgttagagttcactgcagcctggtttctcggaccttccacaggcaggctgacagatgtttcctgctggcgcgtggggcccgcctgcccgcccgccagcctgtggaggaacatcacttttgttagcatcctcatcagttctccctccgcctttaaacattttagatctggaatctcactactttgcccaggctggtctaggacacctgggctcaagtgatcctcccacctcagcttcctgagtagctgggactataggtgtgtgccaccatgcctagcttcaggaataaatttaaccaaggaagaacttgtactttgaagactataaagcattgctgaaaaaaactaaattagacataaataaatggaaagtcaagacttaatacagatgtcagctcagcactacccacagcaatctacagattcaatgaaattgctataaaatcctagtagtattttttgcagaaatagaaaaatctatcctaaaattcatgtgaatgcatggggctccaagttgtccaaacaatccaaaaaaagaacaaagttgaagaactgagctatactgaagctgaggtggaaaaccacttgaacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggtgcctctagtcccaactacacaggag

SEQ ID NO: 113 - DNA, 2515 bp, Homo sapiens
ttttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattgagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgactttaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagctttt

SEQ ID NO: 114 - protein, 403 aa, Homo sapiens
SPPRGKEVGSVRSCYGAEFPGRAGRAEAVAAMKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

(The sequence listing continues in the following parts.)

We claim:

1. A method of diagnosing prostate cancer in a patient comprising:
    a) determining the level of an expression product comprising a nucleotide sequence at least 98% identical to SEQ ID NO:1175, in a patient sample comprising prostate tissue; and
    b) comparing said level of the expression product in (a) to a level of the expression product in a second sample, said second sample comprising normal prostate tissue; and
    c) diagnosing prostate cancer in said patient based on an increase of at least 50% from the level of the expression product in (a) relative to the level of the expression product in the second sample; wherein the nucleotide sequence encodes sialophorin.

2. The method of claim 1 wherein the expression product comprises SEQ ID NO:1175.

3. A method for diagnosing prostate cancer in a patient comprising detecting differential expression of sialophorin SEQ ID NO: 1175 in a patient prostate tissue sample, and diagnosing prostate cancer based on differential expression of said sialophorin.

4. The method of claim 3, wherein sialophorin gene expression in the patient sample is up-regulated relative to sialophorin gene expression in a normal control.

5. The method of claim 3 wherein evidence of differential expression is detected by measuring the level of a sialophorin gene expression product.

6. The method of claim 5 wherein the expression product is a polypeptide or mRNA.

7. The method of claim 5 wherein the expression product is a mRNA having a sequence at least 98% identical to SEQ ID NO:1175; wherein the mRNA sequence encodes sialophorin.

8. The method of claim 5 wherein the expression product is a mRNA having a sequence of SEQ ID NO:1175.

9. The method of claim 5 wherein the level of expression product in the patient sample is compared to a control.

10. The method of claim 9 wherein the control is a known normal tissue of the same tissue type as in the patient sample.

11. The method of claim 9 wherein the level of the expression product in the patient sample is increased at least 50% relative to the control.

12. The method of claim 9 wherein the level of the expression product in the patient sample is increased at least 100% relative to the control.

13. The method of claim 9 wherein the level of the expression product in the patient sample is increased at least 150% relative to the control.

14. A method of diagnosing prostate cancer comprising:
    a) determining the level of an expression product comprising a nucleotide sequence having at least 98% sequence identity to SEQ ID NO:1175, in a patient sample comprising prostate tissue;
    b) comparing said level of the expression product in (a) to a level of the expression product in a normal control; and
    c) diagnosing prostate cancer based on an increase of at least 50% from the level of the expression product in (a) relative to the level of the expression product in the normal control.

15. The method of claim 14 wherein the level of the expression product in the patient sample is increased at least 200% relative to the level of the expression product in the normal control.

16. The method of claim 14 wherein the level of the expression product in the patient sample is increased at least 100% relative to the level of the expression product in the normal control.

17. The method of claim 14 wherein the level of the expression product in the patient sample is increased at least 150% relative to the level of the expression product in the normal control.

18. The method of claim 14 wherein the expression product comprises SEQ ID NO:1175.

19. A method of diagnosing prostate cancer in a patient comprising:
   (a) contacting a polynucleotide that hybridizes under highly stringent conditions to the complement of a nucleic acid having the nucleotide sequence set forth in SEQ ID NO:1175 with nucleic acids of a patient prostate tissue sample under binding conditions suitable to form a duplex, wherein hybridization is performed at 50° C. to 60° C. in 5×SSC (9 mM saline/0.9 mM sodium citrate); and
   (b) comparing the amount of the duplex formed to the amount of duplex formed when the polynucleotide is contacted with nucleic acids of a normal, non-cancerous control, and
   (c) diagnosing said patient with prostate cancer based on increased levels of the amount of duplex formed upon contacting said polynucleotide with said nucleic acids of the patient sample compared to the amount of duplex formed upon contacting said polynucleotide and said nucleic acids of the normal non-cancerous control.

* * * * *